United States Patent 7,868,149 (PLANT GENOME SEQUENCE AND USES THEREOF) - sequence listing, part 34

SEQ ID NO: 17382 - DNA, 9979 bp, Oryza sativa
tcacacaccttcttcaatcattctcacctaatttcttaatatccgtgccaacctctacggaggaagtactaccattttcctggatgatgctgtggtagttagagtattgactaatgactactctgcatgacttgaatcataagcgtctttgcagtattattgcagcatctggctttaagactatatggtctccaggtctctgttatcctagttataaaattattgctgatctttttgtcttattcttctcttaaactggttggactgccaccaaacaaagcttttactggtacaggagtagcctttgctgacttaagagttcaggaattgtcatgcctgtctctgctgcatttccacattgtatcctttttattaaattaattaattttcagtaaaattggtgagtgtgagcctgacattgacgtagtgctatgcatcagtagttcgtcatatttgtgatttatgattgtgaataaggagatacagaggatatttgtgattttttttaaataacaattatgacaattaatatgccgaattttcacttggaaacttttgcagaggaacagaatatatcatctgaaaaattgatatagtccaatctaagaatgactaattgggtgaggccaaatggagcaacgtatgttagtactccctccggttccataattttgatgttttaaataaggtttggttaaacaattagagctttatttaaaatattcagtttaaaaatattacaacccgatgtatagattagtcttttaaaatatattttgataaaatcaaatagttacttatttttttgtatatattataacagaaaatcgtagtcaaatatatgttttagaaaatcattgtcatatccaaaacgtcactttgtagtttgtactactcatccatctgttgactctgccatgccatttggttgaatttctacctgacagagaataaggcatgctttagaatataggatttccacataaatttgtagaaatttcataggaatcaaactataggaatcggtaaaaaaaattcccatgctacaaagggggcctaagttgaaggttgctaatatccttgagagctataaagagtttttccatcttcacctcaactgtctagctagtgtcttaaattcttagctaaatactagtactacactgcacaggtggagcaaacggcatacttttaccatttgaagtgctagcagagcatccaaattcaatatttgtaagtcacggcaacctcaaatattgtttgcctgaagaatacatataggccctgtttagttccaaagttttttttttcccaaacttccaacttttcatcacatcaaacctttcacacacacataacttttcagtcacatcgtctccaatttcaaccaaatttcaaactttgggccgaactaaacacagccataataagacgcttatgctaaataccgacgagtccttgtcatcgtcgtcatcgtcttcaccgtttgttttttactcaaatacgtaatgatcttcttgatttgttcgtgtgatagagagaacgcaacatgtctaattgacaatgctgcaagagatcttttcaactatgaattatctgaattttccaaaagaaaaatgtacatgtacacaatcatttgcatgaaaaaagaatatccactcatccatagcaagtccaagccgtatgtgtaagtgtcaaaaacaaattgtatcaatagaccttatcatcttgtctaatctgagtggtttctttagggtctttgagtcgtgtattcagtctcaaaataaattaaagctattgtgcatgtttgacacaaagggtatcttagattctcataaaaacaaatttgccaagaagaaaaattctgatttgttcgattttctctgcagcctatgcttagtacagccatttcttagtcaaggaggttaacttgaccagaaccagaaggtcccgtttgttggctcatgtaaatatataattatttgttttaaaaaataagtatactattaaagataaaactaaggttggacagtgcatatcccaggttcccaatagttcagtattagctgctcttatccaacaaatccttaagctggacacaacataaaggttctagaatgcttgcaagataagataactgtactttcattgaccactaaaatgtttgaacactagatatgacggccaaatctgaaattccccaggttacgtgtgtactagcttgattcagactaagaaggtgactgccactaatcataaaaacttttcatgtctaagtctgatagtattcccttttctctattttcatattgttcgtatcagaggatgatgcctagtattccttccgtcctaaaataaattaatttttacatgttcatatttgtgtataaaaattggtttactttgggatggaagagtgcatactacaagtatgcaacccaccgatcttacatgaaaaaaagaaagtatgcaggtgcaataaccacgatttgttattttacgacaatacagttagataaaagtagcttccaagtttaatagaatattctgtttcacttccatatacggattcctatttgatctgtttgcgcaaaattagcataatagagtgccttttgaaaatccacccaaatacaaaccaacctttgcaagaactcacctgcagatgcaagtaaagggcatttagggttgttcagattataaccaaaataaaccttatcagattttagtactttagtaatattaccaaaattttgacataatttcttatatatttaccaaagtttggtaaaaataaataaatagatacatatatttaacaactaaaaaatggtatggtttaaaataatatcgatctgaacatgcccttaaatattactgcaagtcatgcgacaaccagtttccagtcaacctcatccatgaattgtattggtataaatctgtaggtgagttctatgcttgtaagtgatgctgcctgacatgagcatctctccggcctatcctgaccagaaaaaaaaaatctccaatcaaccgaccagagagaaaattacacgtacaagcaacagtccaacaagaacaacacgaatctcacggcactcaggcatggaagagatgctgcaatcatcagaactttttgtacagtaaagccacgcatgatcttctgttctagcttctagagacagcatccatttcatggcatgccatggacattacctggacaagacaaacaaaagatataacgcactttgatcttcagtggaagatacagacaagtacaaagatgacagccacttggcaacttaactactactattcaagaagcaagaatatgctgcaccatcggatcgtctcgagatttgtactaaaagaagaaagaaggaagagctactctcctccttgattgaacatttgaaccttccaccacaatacatgtcttagttcttcactcaaaccttccaaagaagagacaaaatggagtggcagttccatgatggaaaggaacagtacaatgtgtcctaactcatcaagaacttctcgagtctaaaattgattgatacttagtatttcagaattgcactgtacatataaacatttcctttggttctttctggagaggagtgatccaagaattgacaagggaaaaacttaacttagaagtgaaatatgttgaccccctcttgtggcagacaatcttaaacatgattatgcatgtgatatttcacatcctggcacacaaatccccccttgcgttatatgaggggtgagagaggttcggttgtctgttgtgtggagattcctcatcatgggtccaaccaaacgaccacgcgttcagatttgcagttgaggcatgtcataacctttattttgtcctcgatacggaattattattctgtcctccatgaggaaaaagaggggaaagagagatagataagtggggcccacatgtcagtagtaatgatcaagccacatcagcatccatgttgatgttggtgtgccacatcagattttagacctctagtggttaataagttcaagtgttctaaaaatgtattgtcaatgtttatatagacctctagggatggcaacgggacggggcgggggcgggttaggctggaacggccccgaccccgacccccgaactctccacccggccccggccccgagtggacatgcgggtgtaaaccagcccccggccccagcccctgcggggccccgcaatccgatcggggcccgcagtgagtagcaactccatcaaatgagcacaaaatgtataagacaatcgtcaatttagcaaatgaaaaatatggtacataatagacacaccatcaaaaataacatgaatacttgaatagcatcataaaaagttcagcaaaaacacatattgaactattcacatggctatgctatgctgttgctgccagccaagcaaacacacgacacacacacatgagttcaagcaatcaagccttcaaggttcaacacatcacatccaagcaagcaaaagtctcctgtccggttgtgaggttgtcccctcgccggccccacacttgtcccctcgcgcagtcgcgctcgcgactcgccacaggcagccggacgccgcgcttgtgcgccgcaccctcaccggccgccgccgcccttgccgctcgaccgcgcagccagaaaggagagccagagggacagccggagagatggaggggagaggaggggagaggggcagagggcgatcggcgacggcaagatccagaagttcactgtgcggcgtgcgccctggcgccgcctctgccgatgcagactggagcggtggagcggctggaggggagatgccgagatgagatggggagctagaggctaaggtttgtttttatccctcagtattttgttgggtcacccgcgggtgaacttttccccccggcctctaaccgcaaaaatacggggccccggccccgcctcacccgtgggtcagaaactgtacccgcccccgtagtacggggcgggtccccgcacgggggaaattgccatccctaacctctaatagtgtgttctctctctagaggtacccgtgcataaattcaagccggaccgctatacattttactcgaaacaaaatcagaactaaaaaaacatcctgcaattaacaactgccagcggcttaattaaagctgagttcacatgtacttgtactcacatcccaacccacatatacagaagtagaacacactgataaattcagttattgactaccaaagagaagggggtaaataagcacgtggataaatcccactgcaaggtacaatagacttaaaaatgccactgaaagtctcattggaagtcgatggcattttcataactaccatcagaccaccaattacagtggcattttactgatttacctagataaatactgacgtggtcagatcggcgaacaagtaaaatggtacaacatgaattaggcttggaaaaaaccctttcattatgaaataaaacaacacccaaatgcttgattgcttgaaagataattcaccaggggttctggtcctcaggaactggaggagactccttcatgacactccatggcttggctggctgatgctgccccattggaaagttccagaaggaatcggagcgctcgtagaacatatagaacaggatggctgacactaggaaaagagataagagtatgagccagacttgccattctgcagaagaataacacaaaaagatttcgttagtatggtaaattataccacaggagagccaagaagcattttatgagacatgtacctttccagtcagcagggacattcagctttgtcagctctgctccccattgatgcgatgtggagattacggccctgcggtatcagcaggcatcatgttataacataaacaaagagatgctccggaaattggagaaggacaggtcatttagttttaagagaaacatttcttgcatgaataaatgaaatgcataagggccatccctaccaaacccagcaggaggaagatgttatcttgcaatcttttccaggctaaactaaagcaaatttagtaaaagatgaacattcagactcacatcccacttaagacattatgcagtgcagcctgcaggcatacacagacaattacaatctatgaagcattgatttataacttataagcatggcatttgatagtctgaccatggttgttaaggcggtaaggcgacctgaggcgacccacccacgccttacgctatagcggtaatgcgctaaggcgtggcgacgccttaatctacgtgattagcagcgatcagaagagggagagagaaaattagcctagcaggccagcccacaaaagcccaataaccttcataccagcccatggtcaaggaaacaaccctaatacccacaccaggtgcgtctctcctctcacagcgccgcctccgatgtcgcttcttcctcacgcctgtgcatcgcttcttcctcgcgccagttcttcttcctcgtgctagctctgctcttctatatgtgctcctttctcccctgatctttttcctcgtgctagctctgctcctctatatgtgctcctttctcccctcattcagaacgaatccagctatgcttctcttcccttggatagatctggcgctgctcccttagtcaaaatgaatctggcacaggagagagaggaagagagtggaaaccagagctgaggagtaagatggcaatgacatggagcagagaacagtgaaaaggggtagttgctgctgccttcacctctctctttctctctctctgggttatggcgttaagcccttaaggcggagggacgccttaacccctcggcacgccctagtgctatagcgacgccatagcgacgccttaacaaccatgagtctgacattatggcgcctacatgccagtgaacactaagctactaccttactagaaatcagtacaacagcagtgtacaacaaactagaaatccataagattcaagatgtgataaacatgccatctttacagagttccagtacctttcagtaggacaaaattcaattgaggaaaccggagaaccaagatggaccttcttgctccagtgagaaacatccatcttctttacatccacagcacagaaatcaccatcatggctccccctgaaagaagaaatacagaattcattcacatgtcggtgcactaaatacatcaaaagcaattcagtttagaatatgttagctagtattggggcactgcatatttattaggaaaaaaacattactccagctgatactgtcactattacaatttataatgttaatgtttttcgtccatttttttcagagctacgcaacatccttgtcaactagagtaattctttgttattatttatgtgacagttgtttcaagttgttgatatattacatgtcaatgtgagaatgtaacaaaaaaatgcaagcaagtttttgagctcttcaaaaaggacaaaatagtgaagttactaggagaaagtagcttatgttagtcttgaaatttggcattgtaaatgttcctagaaatgcaatggagttatatacttgttcagtatgataagatcaacagtatttatatgtacttacaaagccagatacttcccatccatgctaactgaaagtgtggagataggttttcccagaagtctcttgtatccaattcgactccagtcacttatgttccagacaacagttacaactttgttacctgttccaatgacaaagcacatatatagaaaaatcatctgatatgcataaatctatttctggaccacaatagaaagtataccttttgcaacggtgcaaaacaggaatggtttcatgccatccctagaaaagcggcaacattcaatcttctcatcctgcatagaaaaccagaacaccaaatggttaaggctttcagtatctcaacaagagaacatgacttgcacaaatttatcgcatcataccgcagatcgagtcaaattgaccaatggtaccccctcatctatcttccatattcttgcagaaccatcagtggatgtggaaactaaaaattctgaatctaagctacaagaggaaaagcagcagtattgcaaaagtcaattcacaataaagcacagggacgaaaaccaaaggttcaaagaatcgcttcggtctaaaaaagagtcttccaagaccaaaatgcttcattaaggtttggaccaacactactgctacgttatcaaagttcttggttactctctcaagataacggctacatgattgcgccatttacaacaacacttgttcaacagatgagaatatcctgggattcttttgcaaataataaaggaaaataattatgcttgcacttgccctaacctgatatccatgtcccggaaggacttatgagccttgggttcatctaagagcacattcatgctcggccaatgaaatattctgagatgcccatcctatagtggtaaaaataaaataaagcattgtaagaaccatagaaagatactttgtacaagttcagctagagagcagcattattatcaaactaaatacactgggcaataacaccagaccataaaaaactgaaccatctggaattctggatggaataatctgacagaatggtacaacagtggatattgtgcctaaaatcacatggcttctataatacacatatagtacttcttaacgatgtataaatgcagcatatggaaacacataatcaccaaatagaagcaaactagaaaatagagagagagagagagagagagagagagaactgatcagtaaaactccaatatcaacatatagcaatccgatacctcaccaccaatggcaaatttagatccatcagtgctaaaagcaagacacttctgcggtccaacggattcaagtggtggagcgtctcttgaaataagtcgaacagtgaactcttcaaaaatcagcttgaatagccttcagttcaaacatgtggtttaattataaagttctagtcttagtgaaagagaacagaaaaaagagaaagcaggttgtaacagtgcaaacagaaggctttgataaaatgataacacaatcagaactaaaaagtacaaaatggcatggaattatatatatatactgtgcatttataatttgattaacaagtcaacatgtgtgctattctaatgatcatttcattgaggtagttaaccctactaaagatcaacttcggtggccctttttattttaggttgcaacatccaagccaacccttctatagaaaacctgaagtgtaaagcctaattgaacgttactggaacagcaaatgatcaaatgaacacagaaagtcaattccgcactacaatctaaacataattagccacattgataacacagacctctacaatctgaagtctaaacagacggattcacactgctttctaaatcacctaatccagccaggcagccagcagcaaccaaaccagctcccgcatcacaattaaccaaattaccaccctcaaatcagctgaatcgaactaataatccgaaatctccgacactacacaggcattagctcaataatctaccggtagaacaccgaactcctaactaatcatatcacccctcccctccccgcctgagaaattcccgcaaatgatagaacagtcaacgagaagagaagcagtggaggcacgcacctgcaccccttggccgtggcgcagacgagctcgtcgccgctggggtgcaccgtgatgccacgcggcgcgtcgcccggctcctccccgagctccgccctcgcctgcagcacaaacaaacaaaccacacaaccacgaccccggaagtcaagccggcgaaccaaacctcgaattccttgggagctcggaggaggaggaggaggaggaggaggagaggggggagctcccgtacgtaccaggggttcggagagggagcactccttggagtcgaacccgagcacctccacggccggcggcgaccccggccggccgtacgccg

SEQ ID NO: 17383 - DNA, 17440 bp, Oryza sativa
tcctttgactgttgggttgtcaacgctggatgagggttttctctgcttatttttggttgccccgttggaagattggcttggttcgttgatgaatttagagaataataaggatataataatcccactatttttagagtctaattgttgttgttaattatttgtgtgttttgatacgtgatatttgcgacattgatttgttataataaaaatggtaaagtgtctttccttttggagtagtgcatcatcgaaatttatctatttttttaaaaaaaaagaactgtctgtttatttcattattgtttttctaaactggaatatgtagctaccaagatttacaaaaccacacggttaccacttgcagtaacctttttagtttttaaaccacggtatgtctcgcggttttcgcggtaaccgcgtggttaccacggtaaccgtcttactgtgggggtgcggtaaccacgctaaaaacggtaaggagaactctggtagctactactattgatgtaggaatgagttttattgctatggtgatgattcgtggtaagagttctttaactcatagacatgggtataaaataatggtcgatggttaccgttcagttttgtttagttttgtaaaattagctatgtaattaatttatctaagagatgaaaactatagcacatatcatcttaagaaaaaaaattataaaactatgcattcgtataaaaactcggcaagtataggaggataccattttagctatctcaatacacttgttgtacaatcccaaagcatccactatactcatgatatatacctaaacgttataaattcgcaaataaaatctttctatcacatgctttttatcaataattaagaaccgaactagtatatgtgaaatacgtgtgtggctcaaatcgagattttgttcttggagagttagagttacaattcgtttgtgttttgtttcttgtgcgttcttttcacagtgtagtctcttcatgtctagtatagttgacaatcagccgagattcaatcatatattcattatatatctgttgactttagcatagtcaaagccaattgaagtttcttttattagtggtatttaattactacttttccctttcaaggctggtcaggtttgtccagttggatggatcagctacatacttgctgtcagggttatggatgccacatacccaatagtaatcaactaaactcggcggagcccactattgttaacagtgaaatttgataagcccggagtagtcatcggcttagagtcagcatcggcttcgaagtcctgagattagccgatgagagttatcaagtcgtcagttgtcggattcttgctatactcggttaaggaaattgatctactaaaggaaacttatccagaagagcccgagttcaaagagaatgcggcatggcaagttatctatgaatagtttgttagtttctttttatctttagtaaagtgtgtttagtgtcctataaggactttatcttttccttttatatttaggaaagtttctttcttgtccgacaaggacttgtatcaacccatgggtataaatgtgtacacccggggggttataaatgtgtacacccggggtctatgtaatatatcttcacgatcaatacaattcggcgcatcgccaccttttaccttttctactttattttatcgtccagcgggacttggcacctgacgtggggctgcatcggtgttcgatctctggctaaggggcaagtccaatgttccaccggcccaggcaattgtatcgtttacgtcggcgtcgttcaaggctgcatcagtacattcgacctcttggattgctctggtttggatgatatatttgcctacctatttatcatatgtctatgttaatctagtcttagcatatcgatttagctctatcggctgcttcttgttttagggtttctgccggtatcggctaaattgcattgctagattagattagcttagacatctaccaccctgaaaactcagtcaacggcttgattgtctagatattatgtttcttttcatacttagtgctgcatcagttaagtttgatctactaagtcgtgcttagaaccataatctctagcctgcttcttgattgccaataagggtttcatcggggtttcagccggtgagttatctggacgttgcatcggctcataagggttgcatatacatataagttggatttagccgatgacaacaaaggtttcactgtttaatctaatcttgtggatttcatggcatcggacctccagccgatgtgtgctttaaccttcggatcgatgcttatttatcatatcattgctagccggttggtttatattggattatattgttattttattatatcatcatcagtcgattgcctctatatcattatctacattggacatatagccgattgcttaaaccctatcgctatcggctggtatcggcatcggctattatcggctatcggctggaactactccatcggcttgtcagctgatcggctgttttgatctactatttgcatatcttgtcagttgcaggatcaaactaactggcacgcccgcatctcatcaacctttggacctgcactggagctaagcagatctcccaggccggtgtattcgattttttcgtcaacaactatataccaagtcttatacggaatcatacctcgtatatagaatgagtttcggataaggaaggacaagtagagttctatatggaaacaacaaggactacttggattatatccatattggtctccctaattctacttagacaaggggacttctataggtataaatacaagaccccctaagggaaagagatgacacaacaatagatagacacacaatacacaagccaacacatgccgccagacatcaacattaaggataagcctagacagaccccgtatggtgcctgtggaggccgacaagagggatctagtgtcatctttgatctcgatgaactcatactcgaggaggaagactaccatgtcatcgactacgtgttggttatccatgccgctaagtcgagatagctagataggttatctcaaatattgtacttgtgtgattcagataattaagagtaccaccggcttcggccaacaggagtagggttattacctatcagataaggggctcgaacctgtataaaatcattgtctccatctcttttacctcaatcttgcatataccctgatatcgacgatcctcataccatgcaaataccgtagtcaaacctaaaacgtccacacttgcctccaacactccttgttgtattggtaaagaaaatatcaatgattatatttaggctccttgttaatcgtgctactgttgatggctgttaactaccaaattaacaccatcaatacatgcataaaaccataaatataaaacatccaatgtagtggtagggtttatttctaaccactttcacgagcattggtgtatatttggatgcaggtggcaaacaaccaaagttgagacaaaatatacatagaggaggaggtgaattaaacttccatattgaagcctatggagttttggatccacaaacctaatgaaacacattcaaatgggccaattgcaagtacatttgggctgaggggttctccaccagagcccacgagaaaattcggagcaaaacatgccagcaagggtttggccgaacccgtagcttcgccgttcggccccaaattttacatgccggcaattaccgacttgttatgacggtttctaccgattttacctaaacaactgtcatcagctggacacatggcaagagtagagtgaagatgctatttagatgcttagcatcttcacaatcccaaggcatctctccacctataaataccccactctcgctcattcacaacacacacctacatatagagctgaattataagaggctctaagtatattttaggttctttatatgttttatagtatacttagaatagggagagagtgaagtagaagaagtcggagaaattccggaggtcatgttgatttaaaggagtgctcattcttgcaatttaaaatgcatgatcttgtcattcgcaattctagcacctaaagatagccataatgaagtgaatgtagctcaattgattatgtttcttaaggtgaaactagtttatccggatttaagttttagacttgataaatgtactcgtatttatagctaactattatttcagtggtaggcaacatatccatcgtcagcgagagcctgtgatgactttgtcaatctcaacatatattattccaattttttgaacgtactcatagcttaagcttttgtctcgaaccgaccatcgaattaacactagaaattggactagttgggcgcttgggctgggcccaactcatttcaggccaagaaagtaagaagtgcccctaccaaaatgacacaatgccatggcccatgggtcaaggcttgggatatacccaacaattttacaaggtgattgtaacatgtaacaatcaaaagtgtaggctcgtatatctgtcagaacaatccttcatatgtggcttccctttgccagggtcatctttgtgctcctctttggtgcatccgctgttcttgtattcactggagctatgcccttcatattcatccaatatgccgaggtggtgtccagggtcaccctcatcgtgggctgcttttgaggctggagtctactatggctcgctggtcacggcttctttggctcgctgatcactgttgctgccgccgtctataggatgcgctatttctggaaagaagatacgtgttgagcttatggcctcggcagggtgcaacgtctgtggcattgtttgttgggcgtttctgcatgcttggggctgtctaccatgtccaaggattatagggtgcggcagtagtatgttatagtagaggggcggccttgtgccgaggtggtgtccagggtcaccctcatcgtgggctgtttttgaggctggagtctactatggctcgctggtcacggcttctttggctcgctggtcattgctgctgccaccgtctatgggatgcgctatttctggaaagaagatacgtgttgagcttctggtctcggcagggtgcaacgtctgtggcattgtttgtcgggcgtttctgcatgcttggggctgtctaccatgtccgaggatttgagggtgcaacagtagtatgttagagtagaggggcggccttgtggtttgattactgatactttggtttcatgtcatgaccgctcacggcatgtaagttattctgtgacctgtcatgatagttggaggctgtgaacatgataagtggctgtcgacgtttgatgtcgcgattccagtatttgcatagtatggggatagttggtactaggatatatgcgagattgtagtaaaagagatggagacgaggatttttatataggttcgggcccctgaattgtcaggtaataaccctactcctgttggccgaagccggtcgttgctcttattcaccataatcacaccagtacaatatttggggtagcctatctaactgttgtcaacttggcggtctgaagtgctgacttgtagtcgacaacagggtagccttccttctcgaatccgcatccggcaagatcaaagacatcgctatgtctctcctatcagtatccgtagacaccgtaggggactagccatacttatctctgaagtcgatatctggtgtcttgttgttgacggtcgttatcgatcaatttcgaccgtcaatattactaaaacaggagagaactagtgatgcttgcaatgcatatgtttgttagaataataatattccactagtattaggtctactaaccttttgcagagaatgacaataaagtggaagagaatcgacatcaacacaaccgataaatcaatcggatgatgtcgagaaccagacttgtgtgtgaataggccaagaactcagaattgacacgatgaattgggccaaaattcacaagtctgaggagtggagcaatagaggaggccactagccgaaactgggctggattgggctagccccaggttcggccgaacctggttcggccgaaccaatcctggcaccgttggatccaggttttggcgtggacgtccaggattgcatcccaatgacggttggagggcacttcagacaattccccttccacaaccatcatacctacctctatataaggagctcactctcttcacttcaacacatacctcaagcaagaactctctcattcctctcaagtttagtttagtagtatctagctggtggaatagaattagaataggaatcaggagtccggaagccttcggaagagttcgggtatggctctagtagctttcctttcctcttttgtaagccttgtacttttattagaatactcttctaaatacatttctggtattggaatactttccgagtatatgagtacctactttacattatgttcatgttatactgaatatgctgctagcttatctgggagatgcgttggtgcaggtatagtgtttgcttatgcaattactctatgtcatgatgatgatattagagtagtatctggtagtttagacgtggtgtctagattacaggatattattatttggggttatatactgcagatgagaggtgggccgctgatggtgacagctcaatacggatattcctccgcgcctatatataatcctaagttaatttcctggggagggtattcctccgtatttagccccggttggatggtcatgacgggctgttgtaaggaactcggcagtcaggggtggcttctcgaagtaccaggagggcatcggatagagggtattagctagtataccagttaactagaatttatgtatactatgtatattggaagtataggaatagattctctttctcttttctttccacctagcttagattaattattatgaggatgagtagtaatgcttgtgtgtcactctacccttggatttatcttaacccctgcttagaatatgattatcacaattaatatataagttattagttgagttctctttacatgatcttcccacgggataaaataaatacgatacccttggaatactcttgggtgaaatgctacaatattatatccgtgcgcttgcggatgaactctgtaaccataatataccagaagtatttctgcgtcattgctgggaattatatttctaataatgtcgttaagaaataccaacacttgtcttgtcgtatgttggcttgcatgttgatcttgtgtcttgatctattgttccgtgtcccctctcctcctaaagggctttgtatttatacccataggtgtccccttgtccaagtagaactagggaaccaatatggatacaatccgagtagtccttgtcgtttccatgtagaactctattcatccttccttatgcggaactcctcctatattcgaaggttgtttccgtataagacatggtatgtggtgggtcctgccgagatttagtcaactactattaggtatgtggtatccataaccctgacagtagcccccgactttaatgcaaattaacgagttcatattctcaatccgaagacctcggaataactgttatcgagctcacatgaccgttcttggtaagttcagagataacgttagacttcccttatcagcctcgtgcgggcaccatatatgtcacgcccagaaattcacgaaccagaatttctaagctgaatgggtattaaacccctgtccaggaccagccagggtacacaaacgacaattgttgacatacagatccacgtcttacaaaaatataaaggattacaaatgcagcggaaaaggtaaaagcgagctaagcctgaagacttgactcctgcagcgggcgattccattccacgggcaacccttgacggcagcgacgaaaccaacctcttcaagacacctccaactgagaagaacttcaactctggtgtgggggaaaagagcaagactgagtactacccactgtactcagcaagtcataccggaagaggaggcatgatgcaggatataaccaaaggaggctacggggttcatttgcataaagcaggcatttaaaaccagtagttgaaagatttaaacagttgtaataattaattagtatcaactatccactgtccaacactaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtactcacaagacacagccccacgacacgtttccgtgcgctgacatgccaccacgacatatcggaaagaggccgtgacaggacccttcgcataaccccctctagccaagcacaccacacctcaggtttcacccccatccccagtgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcgtcccgcgaaccggtccttaactgccatgggtgcgaccagcaaaaccatgcacccacagcccaccatgtgatttattttaattaaccaacaccaaagcggtgtcactaatccaacaaaaccattagaaccaacagtctaaacattaataggattttccccaatgtgaactagttgaactaggcatggctaagcaatccctagtcctaactctaatcatgttagaaccccaagttgacaaagaaacatggtacatcaacagcatggctacggcaataggtaaacaacccatagtatcattctaaaaaatgcaatatttgaaagaaaacaatagagcatttgcaatataggatcaacatgttcaagtgacaagcatgacttgccttgctctcgcactgatggaaccacagcaacgtcttcgagaaaccacgaatcgacgaaacgggcgaaatctacgcgacaaacaaagcacacaagcaaaacatgctataagactactgaaacaggaaacaaaaccatttttaatggattctatacatttttatgaatttactgagacttgaatggacttaatcggagctcggatgaattagttatgatttttagaagattatctgtgtttttactaataaagaaaaacccttaatcaatttattgcgcaataattcatcccagggctgacgtcagcacaaggaggggtggcgccgacacgcaggccccactggtcagcggctcaagggggagggaggggtactggcaggcggggccctccgggcggcggctcctgggggaaggaggaaggtggcctggctcggctcggcttcaagccggccggccggttatggcgagggcggcggcagcaagcggccaccgacggcggcggccgacgacgcgggcgacggtgcatcgcggcgacgcgcatgtggggagcggcggcgcgcgcgggaggaagagagagggagttctcaccggggttcggccggcgcgggaggagacgacggcaaacggcgacggtgagcgaccgaagggcgacggcgaacggcggccgagctccgggacaccttaagagaggaagtgtgagaggttagagggagagagggtgcccacgacgagcgagagccatggccgacggcggcggctatggtggtactcaccggcgcgcggggagaagcgggccccgacggcgggattggatggggatgcggcggccggggtagcttttgcggcggcggattggctcggcggcggctccagcagcggcgagcggcggccggaggagtggaaaaggcggcggcggcgggtgtagcggcgcgggagcgatagagggcacgggagggagcggtggaaagaggaaaaggtggaggggagtggagggatggtttatatgggctcgggaggggcggacgagcccggaaaggtgcccggatttttcgccgacgtgcggaatggagagaaagagagagagagagagagggagagagagattcgaattcgaatccctccgttgcggggtgcacgcgcgagtggaaggagtggggatggtggccggcaacgtgggcacggggcgcggagtggggcccggaaggcgggggaggcggccggcgtgggcggctcggcggttgccggcttggggagcggcggcgggaggttagggaaagggctgacaggtgggccccacctgtcagcgcccgagagggagaaggaggccgggtgaacttcgggagtaggagggaggagcgggccggcgcgggaaaaaaatgggccggcggcccaagaaaaggaaaaaggagggaaaagaaaagataaaaaggaaaaaggattttcccagggatttactattgcactttgcttattttaattggttaaaattatttccaaggctctgaaaattccactaaaaatcctgttagcatattttgacacgtagaattcaagaaaaattccacatgtcgattccgattattatttgcatttattaattagggattcatctctaggttaaattaaacaatttcttcggacgatttattttatgaatttagagcaagggaggggaacttcagggcgtgacaatatagggtttatctgagtcaatctccgacatcaaccaagaaagtacagagcatacgactaagtctctcgtcttgctgcaatcgagaatttggattgaagtcaaaaaattttatctcggcgggtacaccatcttttcattctgtatttcttatcgagatccaccaaccgttctcgaatggtcgagaaggcgcagagtctgcgacgaagccttgtcaacatttgtcgcactcaccttagtcgatcttggtgtagaaccatagagatatggagtcttcgacaatgtcgaatagaattttcctgaaatcaatactcagaaaagaatattagatagaaatagcccccgagcgaacgctcaaagggtgacatgttataatatgtatggaaaactagaaatgaattaaatttacagaccaatgttttgtgtacgagcatcttctcttttatcgacttcgatcagtcagtttgttgagtcatacactctccctagcccccagcctttcatcggagataagttctcggaggagaatgctcttggaccgttgacctgccttggttgaaaaaacgcttaccctaacccccagccgtgaagttggaaaacccaatttccgaatatacggcggagggcacaacaccaccatggctccgatagtattctctaattaattcctcgacgactagctagctagcttgattcaattcactgaatggctagcgatcgagctggatcaacgatcactgatgcctggctgccatgttactactactcccatcgcgaaatctatttcgagagcgcttttggtttagctctatagcgcggcgtatctcagagccgtctaactgtgcacgtcgtcatgatgtcgatccacgtgggtgtctttttcctttcaaataaagttcacgtgggtgtctttttcctattcaaataaagtttcctctcaaattacttatccaatctacaatccgattacaccattgtgtacgttacaattaaatcttcacaacaagatcttacatgattatgttacgatgaaaaaaatatttatatttgtaaattacttttattatatacataagttacttttatcatatatatatatatatatatatatatatatatatagttacttttagatttgactaaattacttcttagacatataaaagtaaattcaataaagtctaaaagtaatttacatatattgtaaaagtaacttaaaacaaaacggaagtaactttgtcacgacattagaagtaaattcgttgtagggataaaatatgactttttagttagttccataatttgtgctgattaatttaatttttagatagagttatgtttttatctctacaatggatttattcaaatgacatgccaaagttaccttcgttttgttctaagttacttctataatatatataaattacttttagacttactgaatttacttttatagtttaagaagtaacttagtgaaatgtaaaagtaatttagacatatcataaaagtaatttgtgatttttcatcaaaatataatcatgtgagatcttgttgtaaagatttaatgcaacgaacacgacggcgtaatcggattataaatcggataagtaatttaagagaaacttctctaagaaggaaaaaaatatatagatattgagtgtactagtaactttttttttttggaaagaagggtgtctctctagcactatccagctagtactctcggtgtagtcgcgtcctactccaatacatataggatggagaagctagcttacagcgatccgcttaggagtcgaacgctactgatcgcttcggacttcgaccgtgtaccggatggacgtctactatatatacgcttggctcgtgtggtattcctcgactatagatggccataagacccgagacccgacccaagtatggcacggcatgattgctatcggacccgtgccggcgacggcgaggcccgacggcccagccgatgtcacagcacggtgggctggctcagcactgtacggtcaaagtaaaatagttgagggagccaaaataaacttaattaagctatataacggcatgggccaaagagtagagggatgcaaaaaagtcttatttatccatataagaaactcgccaaagagtgagaaaggaaaattagacttaatccataaagaagcacgatgggcagccgtgccttcgggccggcccgagtattattgggcttggctatgcccaacaattgtacaacacaatagaggtgattgttacatgtaacgatcgataagtttaggctcaaatctctgtcagaacgtgagaggtaggtgactaactggaccgactgtcacaaattcatcgtacctcgcttaacttgctaactggttgctatatgttcagacaacgatttcaaaatagcatgcacccagtgtgtgaaaaacaaggagaaaaacagtggccacatctctgaatttaacacatatgtgctgtacacaaaactttgacgattgatcgtattggaactgagagagacagattagaacttagcagagatcgagagggtcaaacacaaaggtattagacacacggcaagcaaccttcatgcatgcacgaaccaattcattatgatctgactcctctacgaacctgcgctgcatggagccaagtctcagaactatttacgaaatgtattttttttcttttgtgaaatttttatatgaactggtccagttccttgcaaatctctccaaaaattcctctgttccaacggatgtttgttttttttaacgaagaaaatataacttttggtctttttaccaacttcatcccggtgcaaaatttatggtttgtttagactatggtagctacgaatatggatgcacctgtttaaaattcctataaaatctatgaatttagacaaactagttattacaccaaatttcgtttaattgttcaacaagagtttgaccacgatggttttgcccactggcaggtgatagatagctcatccaaggagatgctctccagccaattgcatttttgtaagtaaaataaaagacaggtggcaccaaggaatagtggaagccatggagaggaccaaatcggaagcagtgagaagaggccggagagatgaaagggagatgtcagcattcagcaaaagagaccaatctccaaaagcaacccgtcttcttctcctccacagaagttgatgccctggagccccccaagcatctaccctcttgtgccttggatcttacatggacctagctcatggaccaaatgctgattagttgattttctcctttattccgcttaatttgctgtctatgcaatattgcaatatgcttgtggtttatatagtactccctctctctgtcccattttaagtgcagctataattttctatgcccaacttcaatcgtccgtcttatttgaaaattttttgaaaaaaaaattaaaaacataaatcacgtataaaaaactattcatgttttatcatcttataacaataaaaatacttattataaaaaaattcaaataagacagacgattaaaattaagcacggaaacttatagttgtacttaaaatgggacggagggagtacataagagatattacacttgtaaatttcctaataaccacatttaaaacttgtattattggacttgttgctaatgaaagtatggagcgtggattttcaaatacatcatcatatattgaggtactcgataacgctatgcagtgttgcacagtagcttacagcactgcaacaacttcgtaatcatgctagcacactgcaccagcacaacactgtatagcgcaaccgaacaagtcctatataggtgggtgaaaccatgtatgtttatcatatcgccaagctagttggctgctttggcaagtcactgataaaatctaacaagcgagcaattggcattagagaattggaattttctatagtacatgtgcatttagtacatgtattcctttaaaactttacagtttactgctcagcgcttaaaaactaagttaaaattctcataaatttgaaaattaaaccacatacacgtaaaatttagctaatttaacttgtgcctatgagcctatcactatatacatactttatcacttgtggagtttaacttgtacggttttctgaaaccttccatttaaccttgtccatagacagcgtccacccagcagattaagcaggttaacggccaagaagagtccccggcgtccccgcatctgaaaccaacgctcactcctccccctccactcgcccgcggaatcttccttcctccgattccctcctcctcttcttcttcccctcctccacctccgcgccctccacctgttcgacgaaatatcccacccaccctccccctctcgccgcgcaccgccgctacttatacccgccattttcacctcgcccccccgcgcttcccgccactaacattcactgacttagctcgtggtagtttgtagtttggagtcgtactgcgatgctcaaggcgctcaacacgccgacgccgccgctccggctccgcccggcatgccgcgtcgcctcgcagtgtggtgggcggccgagcacgaggcgcaggggggccggaggcgggccgcgcagggcggtgccgcagccgcccgtgcgccgaccgtccggggaccgcgcgtgcacgccgtggcgcggcggggtgggtgccgcggcaccggcgccggtgacacccgtcgccgcggcgggggcgagggatgagctggaggcgttcttggaggtggtgccggcgaggatgaggcgcgggctggcgcggcacccggaggtgagggagctggtggaggtcgtcatggacctcggccgccggccgctcgcgcggttcccgtccggggactgggtgatctccgagcaggccgtcaccgccgatgatctccaccaggccgtctcaaaggtgtggaggcaccaactaattcacaaagattttgtcaatcttgaaatgggcttgagctctacaagtctagatcaatgatcatgatgtatgataatacctcagtacctcagaatttgctagatagttaaggtcatatcaattgtgattttccccccttttgtgaatatgttgtgtttgctcattttgaagatcggtgattcttgcaggtaggcgacttctctgaagacaaccgatccgggatcaaccactcgttgcacaggatcagcgccatccggaaccgcaaggctcatataattggtctcacttgccgtgtgggccgggctatatctggaagtgcagagatgatccgtgatctggttgtgggaggcggttcaatattggtgattggacctccaggggttgggaagactactctgatcaggtatatcgctagttaatgctactaaaatcttgtagatcaggcagtttttgttgtcatgtaatttacatcataagctaatttggcactttagttggaaagttcgaaaataagttgatcagtgttgtgatatgatgctaacagtttgagatgctttcaacaatacagggaaatagctagaattttggctgatgagggtaagaaacgtgtgatcatagtggacacgtcaaatgaaataggaggtgatggggatgtgcctcattctggcatcgggcgttctaggagaatgcaagttcccaaagttagcatgcagcataacgtaagttttcaatattgttttatatgctttatattatcaaagaattccctgaaaatttttttgaataaagttatctcttattagtgaagtataatgatatataggaaactttctttctgtaggtaatgattgaagctgttgaaaatcacatgccggaagttattgttatcgatgagattggtactgagcttgaagcaatggcagccagcaccattgctcaaaggggtgttcaacttgttggaactgcacatggggtgacaattgagagcataattaaaaacccttgtttgcaagtgcttgttggtggaattgaggtacagttttttcatcaatgttatctattcactcattgtttgtattctgttgaagcatttactatcttctgcaacagagcattaaagcaccatttgtttcagttaatttgatagtgaaaataataatcataagttcattatacagagtgtgactcttggcgatgaggaggcgaaaaagcgtaaagttcagaaaacaattcttgagagaaaaggacctccaacattttcatgtgctgtggagatgatttcaaagactgagtgccgagtacaccacaagttagaggctactgttgatgctattcttgcaggtaatcatcgaactctttactctttagatgtataacactcctaaatcgacacctcttacatgaagtagaacatttatatatatgttcaggttttcatggccatcaattcattttttatttcacactattacagggaagcctcctaaatttgaagcacgtaagatggattacaaggctactgagtcaggaagatcgttggtgatacctgaaagagaatatgaaacagaacccttgccttcataccaggaacatcattttgccaaggcaatgccatccgaagataacttcgatgatgatttcagcacccggagaacagaaagcaagagtgtaccatcaaatgataatttcaacgatgattttggctctacaagaaaaacaaaaggcaaaacatctgtacctggaaaatctccagtccatgtgtacacgtaccaggtaagtctgggctgcaggaat

SEQ ID NO: 17384 - DNA, 18643 bp, Oryza sativa
aaaaccaaagggcaaacatctgtacctggaaaatctccagtccatgttgtacacgtaccaggtaagtttgagataaagaacatgaagttctggattttacctttttattattgggtattgtattcatgtaaagacatattaaatacatcattgttatatgacctcagtaactaacagtcacatcctggttgggagctcaccactttgccttagatcggccttgttgtgggcttaggactggtgcaatgcccatggcagacatcaactgcatgttcttctatactgtttaaattctttcttaggttctatagttcgcagtatacatttttttaatcttgtttacaattgaatgctagccccttagaaaaaacataacttaggaaaatcttttatttgttttctagtactttggtgtccccaactattaatgttgaatgatatggttctcctatattttcttataacggatgtttgagttatactataatctggttcctgatttagtgagagataacaaagatctatttctattttcttctttcagatttcagaagctgatatcttgcaagtagcaacagtgatgggattcgatgatgaattagatgtgacggatgacattggagctgccaatgtgattcttgcatcgagttctgagatgaagcagaatcactggattcgcaatgtcgccaaataccacaagcttcccatatttgttgttaaggtcattgcttgatctttgtattttgtggtttcaagtgtcaaactctgttatgctcgttttaacatactcggttttacattggcacaacagacaaacacaatggctcagatagtaaaggctgttagaatgattgttgggagggataaactcaatgcaccaacacgcaagcagcctaaggttgtggtgggagagatagagattgaagatgatgctccaaagaggaagccatcattggaggaaattgatgctctggaggtaattactttgccatacattgtcttgaaaaataactaaaactatttcaggttccatgtaagaaaaactgatgccatgtagaagtactataacttattgaaagatgcagcctctgtagtacaggaattttcctaacaaccacatttcattcactacactcgcaggaggcccgcctcgcaatcgagtacattgtaatcccaggtggagagcccgtagaactcctcccaagatgttcagaaatagttgcccggcaactggagcttgttgagagctaccagctcctggccgaaacctttggaactgactccaactcgaggttgcagattcttccggtgaaaataaccaagaagagctcaagcaaaggcagtgcaggatcgatgcccaagcaaggcagctctgacctgatcgtcagcgacaacggaggcggctccagtttttctcggctgccctttctgccgaaatgaccattgctagattgacactctgatctgatcaccgttgcccccaaactgtacatcattcttctttcctctgcattgtttttttgttgtacataatacatacctgtgcagtgttgtaaatagtgtttgaatgttgaagaatcgaaagagcaaagctaattgtaattgccttccattcttttacagaaataaaaatatcacatttctggtgtcttagccagattaactcacagttgtaccctcatttttgtttggctgatgtttactaacgctctttgcatttcttttgtttggatacccggatgacaacgcacacactgttaggcctcctttggaacacaaaagttccccgcatcacagcagtcagcagtgacatcttcaatttcccaataaaacgaatattttacctttacgaaacccgtaaaacgaatatctcattatctaaaaaaaataaaacgaatatcagtattcttgtatatatgtatgtaagaagcaaaaaaaagaaaaaaaacttttttttcttaggaatgtctcaggagtctgcaggaacattgtttttttattctttggagaaattcaggaacattgtttatgtaaagtaggagagtaaacagtgtaagacctttgctacgaaagcaaaaaaaaaaaaaaggtttctcaaaaaaagaaaagaaaagaaaaactcaaagtagaaagaggtaacgtaccactcccgtgggccggaccaacactccttcccaaaaaagcccaaaaatatccaatcgtctcgtaaagggggctcaaaacaaaaaggcccacgaaccaatttcgcatgtgcgacccgtgcagcccatctcacgaccatctctctctatatatagaaagccccagatttttctcctctcctcctcctcgcctcattccatttcatcccctcctctctctctcaaaaccctaattccccgacccgagcaagccctaggtcgccgccgcgccgcgaggtaggtctcgcctcccgggagctcgcggaggcgcgaattggtgccctgattggttggtgcgcgtttcgggttctgaggggttatttggtttttttttggtggtttgtgtaggttggaggagttggatttgggtctgatttgattcggattgggcgtggtggagatggcggagaaggaggtcgggaggatcttcgtgggcgggctgtcgtgggacaccacggagcgcacgctcgagcgcgccttcagcgagtacggcaaggtcatcgagacgcaggtataatgattgaaataaattttgttcaagcggatgcgtgtgagcctcttttcgtgcgggaggattgttttgtagggtcgaggaacgaaggttctttttgcttaatttttgtccaattcttctgtctgtttatgcatcgcatggttcctaggcaattcctcatggatttcaattatggtttaacttataacctagaggtaacctcttgctaatttgtctcttttgatgaaaagatggtaagtgtggtagatccgctttttgttggcccgattatgtgataaacagagtcccggactataccttaacttgaatagagtatcgatgaaaaccgtttttagcaatcaattaatttttcattaataaggaaaaaaaagaagaaaagtagcagtggaaccatgtttattgagattcacgaaaaagggtaaactgttgcctacctgttggtaactgatatattaggttattaggtggatagctaataaagtcctatcgaattcacgattacaggaataaatgctctacgaagcttccaaagatggagcacagggtgtttattttgtttctgcttttagtaaatgctcttttggctttcttcattttcattctaatagcaattattgattttcagagcctgcagtcccttccagttctatattttaggaagttaatgaagttgaagggaaaagaaacacattaatcaattgggcccatggttatacattttcggggtgatgggttcagtaaaaatcaatttcaagtatccacaccgttagtcaattgacagctgtgctctgttttgtgggcagaagcagagatctgtctttgcgatgctagttctgataactgatgtcagcttaagattgcagcaaatgaattatcattgctattattaatgaattcaacagaattaaacatgactgcgagtgtggatgtgacatactgcaaaaaaattctgcataatggttctggatccgttttgataagaaaggcagaggcagatttgtttgaatcctatgattagtcaggtggtacagatgatgctgatgaatgagtgctatatgctcttacatgcttctcatttgcctggaagacaattatacggtgccttgacattgccacttccttgaaatggacatgcttaactgtgcacgacaaagaaacagcagaagataagaattaagaattagtttagatactgcaagtattttgccttgaaggtatatggcagacccaactaacatatgaccatgttcttattagaacttcatctgtaactcctttctttgcgtctgtagtgctggccaaatacttgatctttgtgtcagttagtttgatggtgagcttacctgttcctgcagcacataagacaaagaagcctacatgttgttttggcagtgtgcagtgcctaccgatatcctctagactctggcacatacttaaagttctgatctggagatcactagcatactgtaccattgggcagttaacagatttgaacttccatagggtgtttgagcagtggtaaaaggggatttgcctgttatcctttcagagttgtctgagatggtttgactggttgcatgcatgaaatttgcttcagctgttgtcacttcatgtgtcccaatttgtatgtgcatgccattgttagcgtttgattttttaggttcattatcattacagttgctatgtacccatcagttcactttcattgtatgtataggtcgtattggaaagagacacaggccgctcccgtggatttgggtttgttacattctcagaacctcgggctgtggatgctgcaattcggggaatgcataatggagaactagatggcagaaccatttctgtgaacaaggctcaacctaggatgaacactgatgatggctatggctatggtggtggtggtggtggtggtggtacttactcatctggtgctagaggtggatatcgtggtggaggtgatgcagttccctctgcaaatgatgactgcttcaaatgtggccgtgcgggacattgggctcgtgaatgtccttattccagtggaggtgggggtggtagaactggaaggtactcacccccttccagatatggcagtggaactggtggtggacgtggtgaccgctttggaggatcagaccgttttgctaaccgctatgttgatgaccgatatgatggtgggcgctatgttgatgatcgctatggtggtggtggacgtgatcgatatgccactgatcgctatccaccaactgccgatcgttttacaggtgacagatatggtggttctgatcgttatgcatcaagtggatttaccagggaaagaagctatgaaagagatggaggacggtccggtggaagttactatcgtgatgaacctagaggctctggtggttatgacaaaggtggcatgcgcatggggagtggtgacagatacgggaccggtggacctgctcgctttgctgggagttacagagataggcctgccccatatgatcgtcccagccgggcagcagcacgcacttatgatgaccgctactgatggaggttacttcggagcattgcagaagaccagaattacaaatatatgttccagttcgcagttcctactttatttgccttcctgtattagtacatcgactctttgagtgttgttcttccatgcagtttgtttaattactagtgagacaataaggcagttcttgaattgttagtatgttggcacattaagctccaggcagtgggtgattctgattccctgttatcgtggtactgtgtaattaccctccagtgtaataatcgtgttccgagtgtgctgtcttatataattttattctggatagcattgaagattactgtgacacatgtggtttctggaacctggatagatgttacatctgctggaaagaaaattcatactgttcttatctgaaatgctcatttggcatcaacattccgtagtccatactacatcagatttgctcttttctgatagatattatgggctgagtagaaatggtgttatcaggccttatttttgtgaagacagtggtaatcagtgaggaatgtatgtctgcttccagttttagatgagaacagttcgttgagatcagaaggagcaaacagaatcatgtacattcaagcatatgaaatgccacactgccaagcttcagcttcacgcatgcatcattgaagtagtgaagtatgcatcccgcaaaactgaatgaagaaaagcagaatatcatggtagaatttatttctagttgccaggttcacatactggagatgagtacatgtacatccgacaacagcacatccgaaactgttacagcacctgaaatttattaacttgctgggttggctacaatccagtgccgttctaactgtttattattgtaaatcagttgagtagtgaggcagtctctcccgcgatctctctgtccataatgactaacttcttcgcaatcaccatcttattctctcgaggattgtatttactgatttgtcttctgtagctcgtagtaacctgctggtatataaaatgaacgctggaatgattaaaaagcacgctattttgtgttggttggtagatggccgatgtaagaacaacggaagacttaccgtttccagctacaggacggactgtgggagaaccttgtaggggttcaggattgaatttgggtcgagcaacttcttgatggaagccatcagttgcacctggcaacattagaacattagttgcacaattaaatggcaatacatagctagagcttaatggagaattcaatgtcaaagttaggttggtcaagtaatgcacaatgaggattactctgaagaaaacaaacaaacaggccctaagcaggacgaacagcccttaattgaagtagtttgccaacataaataagcagtccatggtgacttattgttcactaagaaaaaaaacataaataagcagtccatgatgacttattgttcactaagaaaaaatgcagttcatgcttgcataaaattcttcgagacagaccttccacacaacgacttattggtggatgccaagttggaaggtaacacgtaaggacttactgcctcagatgacttgctgtagtgaatcttctcggctttcattagacccaatccatgctctgcactaatgctccctctctgtttggaggtccactcgtagacaaatggttcaatttgtgccagcatctaacattttcagtaaagcacccaaaataagcaggctgtccacaatcttgagataccgaactagcttgactacatctaaattaagttacgaaccacaccttgtcgctgtactttgttgataagatgttcagatgcaggttcccatcaccaaggtgcccatagcccaatacttgtcccatatcacctacaaaagaaaggtaatcagtagcttatacactattaatggcacaaccaagtagacaattaccaacacggctgcgcatttcttcaacaatatcatatagcttctctacgggtatggacaagtcatacttgtagacagccccaactttgacggatgcttttgatataccctacaacaaagacatactaatttcaatgatttttgcccattattagactgattacacgagcaatcttaaaaggtgaggacatttgatacaactaactttggacctgcattacaaggtggtaaggacgtaaggtttcatttgtttattagatgcttcaactaaagagaaaaattacacataaggctaaacatatgatcacctcacgaattctccaaaaattagaggcttggctaatatcttgtgctataactccatcagctaccaggccatcttccattgaacgcaacaaaaaagcttcaagtttggctctacaaaagaaatgcaacataatgactggatgatagcacctctgcgatgtggaaatctacataaattgttttccagcatagctgcatttatgttatttcaagtagaaatagtaaatgtcagttcataatgactgatatgttaaaaattcaaactagaatatgctccacggaccattggcttatacactcaggaccacatttttctcaaatcactttctttgcagcccaaaaagcactaaaagaagagaaaaaagacaccctacaccttgatgaaagtcttaaatagatcaaaacgtcacaggaagaaaacaaccaagttaaattgcagtagtgttctcctaaagataaaatcagtggtaacttagaattagcagtagcaactactgacattgttagtttattacggtaataaagaattagctacaagagcttacttacttatcatatgactcatcacttcctgtcgtctcgattagaacataaaaattgaacggtgatacaggtagaggattgtgaactccttccaaatatttcatagccttcaaaaccaaataaactatcaaaagccaatctatatacacaagcatacatgattagtgaaacgtatttcttatgtagagcaacacaataaagaagcgcaagtagtttcttctcgtctgctaattgcatgaataaggaacccaatatataataaattacattaaattgatcaaaattggtaatgaactcaccacttccctactttacagaaagtccacatggggccttaaaatgaatatataaacatatttgcatgtaatttcttctctatgaggggtctaagggttaaaatttgctcaggtaagtaccagattaatacaatgacgatccatgaactcaaatgcagagagaatctcaccccggctcctcctgggtgccagtaataatttctggatacacaaacagtaagaaatcactatcttcaagatcacatacacatgaagataaagggcaaacagagcctagaaacggaccgcctatccagacctgacagcttatgtagtcattgcaggaaagaaatgcaacattagttgatggtagctttgcaggagtaagtattgcaattttagtgacaattcctagtgagccttcacttccttgaacagctggaattagttagtgtattcattactaaccattgaaaataatcaatgtaagcatatagagaacagttgaaaatagttattgtatccaatactaaccaataaataagtgcttcagatcatatccagtgttgtctttccttaaagtagtaagcatatcgagaacagttccatcggccaagacaacttcaagacctgaataggacgaaataactcaaggatctcctcacagttgtctttaaaaaaaagataaacgtgcagaaattttatacttgcaaattgcaattcaaagtcttaggggatgggtggagggggttctctccaatcccatgctgccatgcatcaagaacttgtttcaattgtaaaataatttagaaaaggatatttctataagaataacagagagagagagagagagagagagagattatgaggaacataaaaacccctttcaaatggaacaaagggacagcaaaagttcaaaatacaactagcactaggaaaaaaaaaggaaggaactactttaacttaccaagtacacttccatgaagtgaaccgtaacgtatgaaacgtaggccaccggcgttagttgaaatgttgccacctatgtgacaactaccttttgctcccaggtcaagcggcataataaacctgaataagtgatagagtatcttgagttttctttccttgcaataaaaataatcatagatggatcttacaaaaacacatactggagtaacaagaatgacaaaggtactgacagtggcataccacaaccatcagttgactatgagcagactaatgagtatgtgtgagtattatgaaatccaacaactcaaaatagccaacaatatatttatgaacataagaaatccagtgaacataatttcaaacaaaataataatggaaataagacaggttaccccttattttccacataggagcttaaattctccaacacacaaccagcttcacaagtaagaataccatttacctacaacatataatagccatgctcagaacttgacagctgctacgtgaaatttttctgtgattgctcataacaatggatagataacatcaatctcaaaaaaccaatcgatgagcagatcacagaattcaacatattgaatacaaactgtaccaagtaccaacattgtcaaaggttattattttgtccataccaccaaggctgatgataacctgcaaacaaggggggagcacttgtgatctcagggcttaaacataagagcagtagtaaaacagagaatgcaattgaactgaaaaggaaacaaagatgtaattgatatgcatgttacatcgacaagtataataagagattctataaactggattgaattttgttatcaatgaagtaaagataatattaatcacaagaatggaaactgaatgagttcaaataatatatactgtgtttctaaaaatctaatagatcatgcaaaataaacagttcatcatgtgtcacagtacaggacaaagtaaaaagatcaccaaggcagcatcagcaactgaaagcaattcgatagaagtaggataaatcctagagaaacaagaaaactagctgaagcaaattcggacctaaaataattaccaaataatatatcttatcattaaacagagcttgtgctttatagttacctcatcataaacaggcacactgccacctacaagacctgtgttcccaccctgagggaccacagccaatcgtctggagttgcaataagaaaggatcttagaaacctggaatagaagaatggtttaataaacaatctgaacatgaattttgttgcgtctgaatcttaatacaaagatacgcaagtcttaagcatattcccccaaaaaagaagatttcttttattgtgtctaaccatgaatagaactgaactagaataagggagtgtttgaagagaaggggattgaggagattgggaagatacgcaaaacgaggtgagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgagacacaatctctcctatctccacctaaagaacactccctaagtgagctggagaaaaaaggaaaaatacctccgcagtactttttggtaaaagcaataactgacttgaacccttgtatttacccatccaatccatatttgcaactgatactctgtcttcatcctgaaccacaccactatcacccaagatactcttaaagtaggagacatcatcagaattcagcactgaatatgcaggattcctctgaacgtgtgctgctgcagaactgaatgaacgcttctggacttcaaaattcatgcgtgcgctttgttgtgtgtcatctgtttccacattagtcctgaatccatacaaagagcgttgctgaccttgaatcgaatagaatctgctaaaagcatggtttgcggctccatattgtttaggatacatgcctagaaagcaacattgatcataatatttcaggtaaaagcatctcatgaagttgcaggtatcatccaatatatttattgcaactcaactttggagttttaacaaagcatggaaactagtgattttctgtctgataaaataaattataggaacaaaaatgctataaaaataattaaattgtacaagattatttaggaaatctcagaaaccttaatgctttcaccatgtcgaaaactagttgcgaacctacttcagctagaaagattggagcatggatagtgcaaacaaggatatgcgactgtttcaacatagaactatacaaaggcaatcgtacttgcattatttccaatggatgtgatgccatatatacacatttttaccaagacatttaaccagcgagaacaacctctccaagcccatatacacaaaattcgagctaataaaacacacattataatagtttctagtacacaatgtacacttaactacttccttataccaaactagaatccggtcgcaaactaaatcccatttaaaacaacaaaacacacccgagatttttctcctcgagactaaagtgaaatcatccgagatcaccaaccaccaactgctgtttcagatttacagcgtatgtgttgctgcaactcaaagttagtagttcacagcagttcacgaaccactaccactccccagtcctcacttccccgcaccacacacacagcgagcgagcggccatgaccgaccggatcgttcgaaccctagcagggagggggggagagcgagagggtcatgggcaggcgaagagcaaattaagccaatctcacctcgcgcctgcagtgtctcgccggcggcgaggggccccaggtggcggcggaggagccccgccgccgcgcgcctcgccatccgcgcgccctcggaaggaggagggagaggtggtggtggggggagcgagctcgagcgtcgagggcagcgcgcgcggcgtctctgcccctctctctctcgaagaagaaaacaaggaagtgaacgctgtggaagagagagagagaagaggcgtacggctttgtagcttgtccagctggcatgatctactagctattgtgtcattctgacgtgtaaagcccttatcattactactagtactactcttttctaatttgattgattctatagtttacccggggacagttggtctcaaaataaccaattcctatgtttttttaaaaaaatttacctactactactacataaaaaaacgaatttctagctataaacctagacacatgtgtgtctagtttcgtagatagaattagtttttttagacggatgggatacttattaattaattgtgcactatttaggtgcctaggaagggccccaaacaaacatggccttatttttattttatatatagagtatcttaagattaaagagtcgaaaatgacactccttccgttttatattacaagttgtttaattttcttctagtaaaacttctttaagtttggttaaatttatagaaaagtatattagtatttacaacacaaaatagacatattatcaaaatatattaaatgttgaatttaattaaactaatttaaaatttttaaatgttgttaattttttctataaacttgatcaaacttaacaaagtttgactagacaaaaagtcatacgacgtataatatgaaacataaatagtattaaactggttggcttatagtcatagccgaatttaaattttaaaattgttgattttgagtgtttttatagtagttagtttttttaacatttctttaattgctaatatcacacatcaaaagaattatctataaataattataagccatagtgcttattacaagcagttattataaactgcggtccgggttctaattgttttgccaacagaagattataatccgtttagtgcaaacaaataatttacgccactaataatgttttatgtgacatttgattatttatcttatcaaaaagtgttgcttattttgttgtgacttaccttatcattaaatgaactttatgcatgatttatatttttatatatttacactaaaatttcaaaaagatgaatgatttttttaaaaaaaaatcaacggcgtaagacaatccaaaaaataaactatttcctccgttttatattataagactttattggcatatatgcttagattcattaacatttatataaatatggacaatgctagaaagtcttataatctggaacggagggagtacgatgacaaatattgaaatcaatctgtacgagagctcggaatcgctgaagtccgtcgagctcgttcttgcgtggatccggccctgactcggaataagcgagatacacatatatattgcatctggtcgattgttttctaccttatatttcttcgtcttcctcttgatcgagagataacagtgtgtgagagcgtacgtactgtgaggcggcagcatgatgatgacgacccttatcgccccgataatcatcgccgccgcgactacgccgtcgtcggtgccatcattgtcgccgtcgtctacgcagctgccgccgccccaagttatcgccatcgccgtggcgccacccatttgtcacgttctatgggccgggcttcgagcactgggatttggtctaggcaaatagggtgcatacttttaaaagagaaggcaacagcaacagatggggcatcgataaagaaatcaacacaactgaagccaaggcttcttcctcctccaatttcctctcttctctttgttcttctaatcctaggctctgctctcttattcccagtcccctgcttctcttcccaatctacattgctaattccttccaattatatccaaattacttgagtgattaatgctgtgaattatcggttgcttccggtgttgggcattgatcggtgggtgggttgaggatcgtaacattatggtatcagccaccgatccgtgggattccaaacaaggacactatgtgggggacacgggatggaaggggcgacctctgggagcgggatttgagccatggaagtgttggtgctagtggtgcccgccaggtgttcggtgaaatgccgagctggctgggaggtggcgcaggcgctactcttcgtgtctaagtgagtcaagtcctttacccagtgaccggcgaggtactgcatcaaatttataacacctatggagcggtggtggtgcaggtcctcaccacgagctcttagggtgttgaggctttcgtgtggttccggtcatgctgtgatgcagagatgactctttctgtcaccaatggacgcaacatctatgatgggtgttacctgcttgatgtccagcacgtgcatcctttcaacgggaacggtgtcgacatgacgcccaccaagtgtttgacgttgggaccaagcagcatcaccactaggccagcagttgagagttctcttgctgcaccagaacatgtgtttccagccactatgaactcatccacaccctcaactaccgcagctgctattgcaacaccgtcaccatccatcaaaaccaacaaagccgagggcgacatggctcaagttgagatgaaaccaaaggatacattccaggagttgtgtgccaagattattgccacgctcaacaacatgcttgtgacatgccgcaacatcaagcttgagtcaatcacgagcgttggtatcaccagagtggtgacagctaaaagcaccaacactaaatctgtccccaacacattggaggtcagtgatgaggccaattcaatcagcttggttgatactaatgagttctacatggtgacaactaccaagtgtttgacgaaaggcaatgaacaaatgatcaatgatgatgacgatgacatggccaccgaggatttagttgagctcactaaagtgaattccaagttcacactactgcaaacaggtagctctccaccagtatcaccttggagagcggcaattccatggtacaaagctgagatgaccttaggttatcgtcctttaccatggcatgatccatggttgagtcaagacagcggaagcgtggtgatgacgaagctcttacatccccagcaaccaccttctcaagcagaagttaaagctgaagttggagcactacaattatttggctgtgtacactacaagaaattccattgaggttgattgtcaaggtgaggcttcaaagacaccgatttcagagaggacgtgttatattgagttgaggccatggccaccaccttatttcctgctaaatgaggtgatcaaggaagtattggagatatgtcatcaagtaaatatgaatgggatttccagctatgtatgggagaatattcaaggactattaatgctggatgatcaagtctttcaaagctcgacacagtggcaatctgctatgtataaggaaatgaactgcttggaattgttgattggattagagctattgcgtggacaaatacattcttgttggagggagatggctcagctgaaaataccatggacacctcctcttaatgcatgtgttgttacattacttgcgcatgctagagagagtttttcatgcaagtgcaagatcaaaggaagttatactatcgtggggttatggaagcatgagttctggcaggtaatcaggtgtcaacagaagagtgcaattcctctcttagctggcaaagtgcataattggtataacctcaagtattcttggtcgcgtggaacttttatagaggttcaggattcagttttcactctctggtctgcagagtataatgagctccaactaacaatacatgcactcaatccatccttttgctccagttcagtagttgtgccaatggtgtggttgtgtagcagattccttgaaatattgatggctttccatgacaaacgacaattcttattggtgaagactatggcattgtttggagatgctgcaatttggacattacaatgtgagtttctctctagtgcagtattgcaatgtctacagcctactgtgaagactagtgactggtatacaaagagttgcacatattcatgggtatcactgaactccaagttaattaatctgaatgaagtgattccagttgacatgttgcagctaccaacttcagatgaggagtttgtaatatggcccagacccattggatggtttgcaacaagtaatcagtttgccaatctcgggttgggctattcttcttatcatctagtcagggtaacaactaagattgtttcactgaagaaatcttggttgtgggaaattgttgaggagcattccaaaccaggaccacaggacaaacattggaaaggcaggataacaagctctgggagtcactgttgcttagtgatcctgatacactatgctccttgcaactaatatgggattctggaggcatcaaaggcatcggcttggggacaagctgaaactaaaggaagggagaatgtcacgttctatgggccgggccgagcactgggctttggtccaggcaaatagggtgcatgcctttaaaagagaaggcaacaacgatagatggggcatcgataaagaaatcaacagaactgaagccaaggcttcttcctcctccaatttcctctcttctctttgttcttccaatcctaggctctgctctcttattcccagtctcatgcttcttttcccaatctacattgctaattctttccaattgtatccaaattacttgagtgattactgctgtgaattattggttgcttccggtgttgggcattgatcggtgggtgggttgaggattgtaacaccgttgccgtcgatgatgaccatccaccggccgttccacgccggcaccgccggaagttgggcgagaagatacactcgctcctctgctgcgtctcaagcgcagcagcatgaactaaccatgaatacttcacttgttttctgtagcttagcaatagcatgctcagacaagctaggcgttaaccctacaatttgaattcagtgtttttgccatgctaatccattcgatttctcaatgaatccttgcaaaaaaaaaaaacctgaatgatgacagggcacaagtgttttttttttgttgttgttcagcctttcaagttcacataggcttggagtttgagctgctgtgttgtaattctaaaagattcaaagatattttcgggaaagtgatttcatccctcgaggggatatcccctcgtttcgtgcatgtaacctaaatagtcataaaaaatatgaaaaaaattggcaacatatattaatatgaaatatatcactccacaaacatacaaatttaaattcaacttctacaagttgtaacaaaaataacaaatatagttacgaatgtgcgatgactattttcagtttaatttgttatttttgttgcaacttgtagaagttgaatttaaatttgcatgtttgtagagtgatatatttcgtattaatctatgttgccaattttttttttcaaatcttttgataacatttagatggcatgcaaacaacaaggaatgtcctctggagagatgaaaatccacatccgatactctctatattagcctttttattttgctaggtcaaggttgcgcaagtgcccacctagatgtactacgtcaaacggtatattcataaaataaacctgctgtgttattggattcaaaaactgcaagccaacgtcatgatttattacgttcaaatatgtaatgtgtaaactttttcccattcacactttgattcatccatcacctcaattcattggtggagtccgggcgacgaaaagtgtttatgagcaattgaattttttttttgcatgtattgcccaaaaaaattagtgaatacactagcgacagagctaagaaggccgcctaactactagaaaaagcattttgcagatgtggggcttttttttcacaggcggacatgaccattggagccaaatgaccacctacaaaaaatataaaccgggctgaaactcgttatcctcctgcgaaaatagaaccacttaactggtccgcctataaaaataccctcttatgtagtctgcctgtgaaaattggcgtggaatataaatagaggcgacatcggccgattttttctaagtaccatttctcctctcatctcccgttcccacttccccctcccctccacctctcctctcctctcccctgccgccgaccggaggcggctactgggtggtggcggcgcactccggcgcggacggtggaaggggcggacgcggggtggccggcagcggctcccctccctccttccctccctcctagatctggccggaggggggagggggaggccggtgaccggcggcggggtgcgtcatgtgcttgtcggccggcggcggctcccctccctccctccaagatctggccgaggagggagggggaaggctggtggccggcggcgcgggggggg

SEQ ID NO: 17385 - DNA, 29670 bp, Oryza sativa
ggggggttgcgtctgtgcggcggcgacggcgaggagggtggaggcggtggcatctcccctccctcctagattcggcggcacggaggacgatcgcggcggcagctactggcggtgacggtgaggagggtggaggcggcggggtttgttttgattttcaaagttaatttgtgatgcgtttgatatgattgtaaactactatgatgtttctatgttaatttgtgatggttttgtgaatttgatttggtttgacggggaatgaaaactggattggatggggaatgggaggagaatgagaagctgctagtaccggccgaaacggtggtgggcggtggctgccctttttttttaatgctggaagctattttcgcaggcgaactagttgcccgccgcaggcgtttttttgcaggcggacaatagtccgcctgcgaaaacctgtttagtccggaaaaaaaaaagctttttctagtggtggtaattgaccagccccggaggtggctccaccgttgccttgattcaacaacgaatttcatttgttcttggttctattatcctccatcagacgtgcatcatcgtatttgtaaattatgacgaaaacgtatcaatggctcaatgccaccaaacaaaactctagatcccatcagcgcgtcccctctcatcgcaattctcttaccccctcttattctctctggctagattttagtactgcgacatcatcaaataactctccctctctccttctgcgccacgacctcgctcggccgtctgtggaccatgttctgtgttcctcaactttcttgcattttcttctcttctcaatcatattcaatgtggaaggtcgtgctaaatggatataaggcactaaaatggacagtgagtgaaaattgatgttatgccccaccagtccctttcaattgggtgtgagagagtttttttttactacaaaacattagtatatgttaaacctaccttgctatatttatggcaccatattttttaacaaaaaatagtcggcatatatttacattgtaagttactaaattacatgtaattttagtatatttacaatgtaagtctcaaaatttataggtgtaattattgtgtaagtgaggtgtaagtgtggtgtaattggtgtgtaagtgtgatgtatgtgaggtgtagatctgtataaaaatacaattagagaaacaaagtcatccattgctcttaaccaacgtgagcttttgcttcagatagcggcagccatgcttggcttgggtaacgagcaagtaaagcacagcgaggagaggaccaactggtgccgaccatctgtgtccaaggttggaaatctcgatcatttcggttacttccgatacgatattacttcagtcgaattttttttaactttttcataaattttggtaatatttattcaaattcaactaaattttgttcaaaattttggaccgaaattttggtatttcgatgaggcccgatcaaatcggcctaaccgataggattaaccctgtctgtgtcagcctcggtcaacagcacgcatctgagcgtcaatttaatgggtctcgtaccacttcggtcgatagcacatatcttaacacaaagatccaacgcaccaaaatttgactgaaatcacgtaaaaaagatgccgacataattttagcaaagctgtatatatatttaaagaaacatagtataaaaataaagctcatatacacgtgcgcacacatgcacaccctatatccctatccctataagaatctccgtatgactattggggtggatcgaatatcccattgtcacgcacgggcaatatggctagtaaaaagaataattaaatcctataaaaaaagaataattaaacaaatcaatttgctcacccccggctctcacacacgtacatgggcctttggttcatccacaacatgtctcatatataccagcgacaggtaggccgcctcggcacaggcaaataccaggaagatcaagaggaaaacccattccaacgatgcagcaggaagcatcatcgaaatacggagcagaaaggagacgagaacgaacgccacggccatcaccattcccctcttctgcaccttggttacggcgagtttacgggcggccggtgccaggatggagaagatggagagagcgaggctcgtgagcaggccgaggcaaatcaatgccaggtttacactataaagtgcgccgccggcgggcaatcgcggcggcggcggtgtcgtcgtcggtgctttgcccgccgccgtgaggttggcgaagagcagaagcgacgccgacgccgcgaagagggacaccgtctgcacgctcttggaaacgcgcttcgcgtcggcgtcggcgtcgtcgtcgtcgcgcgccacctggtgatcaccagctgcggctgcctcgatgtctagcgctttattgccgctggatgtggccgtcgctgctgcgcgtgcctgtggacgagatgcggacgaggatgatgatgcccggcccctgcttcgttcagcttggtctggttcccgaaggagacgaagaagctgatgacgacgcagagcctgcagctagcgtaggttattcgagaggaaattgaaagctagcatagcttggtccggactttttagctgcgtgcctataaacagaggtcggagatgtaacccatttccattatctaaaaaaagagacaattgaaaacgtaagatcggaaaaatgatacacccatatatagaggggtgtgtagccagaatttcttaagcttagagctaaactaatctttatcttacatattctgaggttttaaaatgtaatttgtaatggatatataggctcaggagtcaggagcaggactaccctactcctgtttcctccactgcatatatatcacttatccatgacaataagactggttcttctgtatatatgatgggagtatatatcacatatccatggcagcaaggccggtcctgaacatacggggcctaggcgagataaaattcgaggctctgtatttgaatgtatgtatgcactaataatggttttattctagtggaaaaagtattgcttcatgaaacttgaactgcatatgctaatcatgggaatattatagttccttaattaaaattttctgaggaaaatataacacactagcttagctaaaaggaaaaaagagctgtagatcatgttagtgtatgacattagctaaagacagcattttcgcacgaataattaatagtataagatttggtaggagtaactaaagaacaaaggcacacctggatgctcatggttatgtagaaatcaaaatagtacaaagaagaatatgtacctagaagccaaatcctcaatcttaaataatctgtgagagaagtaacaaatattacaaagaaaaaaaggtgcattaccttgagaaaattagtgcagaggagaattacaagaaacttttggatcgaatctctggggttggtcttaccttggagaattattaaccatgaagataagaaggaattactggtgttgatcgtgcaaaattgacagaacaaaaggcccttcaacggaaacgcgggtggaaaggaagtattgacccatctcccaacatgaacgcttcttaaaaacaaaatatatagaaaaaaaaatggagcttctttgcgacgggagagttaaattattcatatgatctttttctttttgtgtcataaattggataaggggttgcgatcgcatggacgacgtaccatacgccgttgaagtcgtcggagcctcgtagcaagggcgagaggcgcagcaccgccgggacggggttcagcagcgccgaccgcagcgctccggcctccggcgcgccgcgatggattgatgcccgtcgtgttgggcatcttcggcgacgaccctgagatggcgggtgacgatgagctggccatggatcgagtcatcgaaacgcgcagcaggtgtgtgcgggtctagggaagggatgctttggcctttttatagaagcagtactctgctctctctgtgttccttctgaagtccgcgcgccgtttcgtctctttctgaggtactccgggactgctcatattgcagtcaaaataaatcttaccaattttagtaagatggtactattgttaaaattttaacaggatttcttatgtatttattaaatttggcaacaaagtaaacgcagacatttttttgaaaactttaaaaaaatggtatggttgaaaatgacatcaatctgaacagcccctccctccgtttcgtctgattttttttatcaaatattttgaagtttgattaagcttatagtaaaatatagtaacatttttaacacaaaataaatattgtatcaaaaatatattcaatgttaaattgtagtaaaatacagtagcatttttaatataaaataaatattacatccctaaaaatatattcaatgttaaatttaatgatactaattaaatatcatagatgttactattttttctataaacttaatcaaatctaaaatttttaactaattaaaaaaatctgacaacttctaatataaaacggatatagtatttataaggaaaaaagaatgctaagagacacgtagacacagctgggtcccaaaaaaccgatgtacacactgcaatcacactcagaaaaatcgatgcacatcttacatcgatttatggatatcatatatgagagcagctccagtgtcaacccaaaatcgatttcggtcagcaccaaaaaccgaaccgtgcacattgtggggggcgaccagggtttgttttaccgccaaccgcacggttaccgtggttaccgggcttaccgcggggtacggtaatataaatgccacggtaacctccttaaatttaaataaattgaaaaaataatttaaatttttgataaattttatacggtttttcacggttaccgcggttatcacgtggtaaccctggctctggcagtttgggaaacttgtgggcgactggttcgtgtcagatgaaaaatcgagttcaaacgagaggtcgaacacagaccataaaaaaatatttgttgctaccggatgtgagagcgagaggaaaggtgagatcgagtttattttttctgtgggtcccagaaacatcaaactgtgagacataataatcgaatcataccactgcagccaccgaaccctgttgtctgacaaccaggagccaactcaggtcgagttagttctaaaatttttcttccaacttttaacttttctatcacatcacaacttttctatacacataaacttttagctttttcatcgcatcgttctaattttaaccaaatttttaattttgatgtaaactaaacatatctcggttcgaaccaatcaaataaaaatatacttcctccgtcccagaatatagcaacttatgatgggtctcccatatggaatactaccatatggaataaataagtattatctatctctaattatctctcttttcctaatattacattgtatctttatacattatagcacatgtatgtaggtctaatctatatggtttactttgggggggcctaatgggcgatcgatcgccaggggatcgcccaagcgatcagatccgccccctcccctatactactcgatacactcctccctcctctccccccttcgtcctccccttcttctctttctactacagtacaccacataaaaaaattttaaaaaacaaaaagttaaaaaaatttatgtatagaaatactatatataaaaaatttgaattcaaattcaaatttgaatcgggtatgtaaacttttgacttataaactttgggtctatagactttaggtgtataaactttagatgtatagaaatactatatatagaaaatatttgaattcaaattcaaatttgaatcggatataattcaaattcaaatttgaatcgggtatgtaaacttttgacttataaactttgggtctataaactttaggtgtataaactatagatgcgtaaaaatactatatatagaaaatatttgaattcaaattcaaatttgagtcagatataatttaaattcaaatatgaatcgggtatgtaaacttttgacttataaactttgtgtttataaactttaggtctataaactttagatgtatagaaatactatatataaaaaaatatttgaatcggatatataaacttttgacttataaactttgggtctctaaactttaaatgtgtaaacttgaagtgtataaactttagatgtgtaaacttgaggtgtataaactttaggtatataaatttactaaaataggaaagtaatacggtgccaaaaaaggaaaccaggtggatggagagagggggattgattgctacccctgtccccaggcgatcgatcgccgattaacacttccggtttacttttactatatatatattggtgatgctctacttcttacatcctactaaatataagagattttgaacggataagatgctctgtttagattcgtagtagtagaaggtatcttatctgttcaaaataacttatattttaggacggagaaaataaatgtatcagcatgcaagggaacccctataaccctctaggggcatccacaatgtggtgaaaaattcagccagctagttctattgtgcacctagtccatatgaaaaaaaatatacacataaactacctatatgaaataaataatattatctatctctacttctcttttcttctagtgttatcttgtagtatctatatacattgtagaaattgctattgttaaagtttatatatatgcgatctcatctatataagatcattttttgcattaacgatgtccttaccgtccgattgctccatcaaaatacctctcatctgggtgagggtggtcgtgtgtcagataatgcgatttgaatattcgagcacacagcgtaaactattcgagctctactgcctctataaatttttatcagcatgagggacggagccacagatcatccgaacttaccgaagaaaactctattaaatttttatgttgttgaattaattgatgataaattttttttagtaaatactaattatagtgaagtttgcacatattcaaatatccactgtctacacagtacgtactaggcataacgaaattaatcggcctcgttgccaacccaaccgatggaacatggaagtacacggtttgctacgcgctcttgcttttttttttattcttttggttgcagagcccgtccgtctttccccatctctgtttggttcggtacttcggttgctaaagtggatgcgcggcacgccggcacacgacacattgcttcgcgtcgcgtgcaactgcacacgagggaccgcgttaaactcactggccattgttgaccaagggtgagtttgagaggaggggaaaagagaagattgggaagatacgtaaaacgaggtgagccattaacatatgattaattgagtataaactattttaaattttaaaaatggattaatatgattttttaaagcaattttcgtatataaattttttgcaaaaaacacaccgtttagtagttagggaagcgtgcgtgcggaaaacgaaacaatctaactcacaaactcctcctgccgaacgctccccaaatgttcatcaggtttcatttaggttaataaaatatatctacacatatcataatttttaggattagaaaccagtattaagaaagtaggtataattaaataggataatgttatgattggttgaaaagtgaagacatgtgagaaaatgaatggtacatggtcataattgtagagaagagaacgttggtgaaaaagctattatattttaagacaaatcttatgagctagaagttgttatattttggagttgttatattttggaacggagagagtatataagtaaaaactagcatggtgaccgacgcaatttacgcggctagcatctttatatttttttcctcacatattagcatatatattttcactttttaattttgaattttagttctttctaagtggtatttttatatagattcgaacctctactcgtagtttccttattatttaattgcgaatttcaattagctctaaattctatacttttatggacatctactatttcaatattctttattttttaaatttgtaatttaaattatttttaaattatatttctatatggactttattttctttttttctatgaatatgagaatttctatgacgagagaaagagagtgaatgtggaagttttttttctgttactttaataagttgatagattagaatcgtgcatattaacatcattgttggcggatggcatgaggcccttcgactaaatctgccgaaacccgtggcgaaggctatggagtaagaacggcgtgaggcgaagagtcgtacgagtgccttgccaggccagaggcgtttcaggcgaagggtgcaaggcgaagactacctgccgaaggaagacgacttcgccatggcaagttcgcccccgcgagggccgaggaagcctttccggcccatcaagcctaagggctatagggccggcgatcgctagacgacccatcaggggcccatgagcccctgtaacattatgtacccctataaatgtccctttcgtaagggtaatcatgtaaattcccctgtacaacctaaaccctagtagcaagaacctgtaatagggctataaatagtcccctagggccatgtaatggggggatccccaagtgaaattcgaaatttaatacacttagtttttccaaccactgttgagtaaccacgtctttcgatgtatgcggttgtcgtttcgacaacagctggcgccgaccgtggggacctccgagcgaaaccactaagagcgaatgccaccgaagagggtcgtgaaggagaaggttaccaggcggaaggaaagcgacgccggaccggacatggccgccgaggaaggagcagagccttcggcgcccgtggctgaagatggaggaggacaagcgccatcacaaccgccttcggcccctgcaacctctatgcaagtgccgaacgcggtcgacgtggtgaaggcggctgcggcggcaagggcactccagaccagggcggagatcctttcgacaagccaaccggtggtgccccaagccactccatcgcagccggcagtggccccaattgcgctcgccgttgtgcaggcccaagtcagccctgaccccgaagcacaagccgaagccgacatggaagccatgcgacagaacatgacacggctccaagacatgcttcgccaaatgcaaaaacaacaacaagcatacgaggcggcaagacggaccaaggccacgtcggctccaatccttcagtattcggcaggttatgtcccacctcaagtccatccgcaagtgacgacccagccctttccgccacaagccgctcaagcgccggtgtacttcgccgggcagcaaccggccgtagctgtgcatctggcccctcacgtgcaactgcaagctcaactagtcgctgcccaagtacaccatcaaccacctggccaagcgccacaaacagtggtggaaggggcttcggctctgcaggcgcaactccaagctttccttcagcgactcaaccaaccccactgcatttcaactacaaccccatcggcccacccggaggggaatacaagtcaaggtacgcctaattggttgccactgattcagccgggcctgggagtttcgccgtggaatcaaggaccgcagttcgacttcgtcaacgctgctcaagcgccaaccgttcggcagcaagctccgactccaggcttcggaacaaaccaagcaccaatccaagctgccatgacgtggtcacagccgatttttgacccatccatggcggctcaacaagtacctccagttggtgccgggcagccgaatgccatggcccaacctcacgcacaagctacgatttcgcccttcgccacaccgtacccgcagcaaggtgcggtaaacagggcgggaggcgaaaaggggctaccgctgagtgggggaatcaagactcgtccaatcccaccccagttcaagtttccacccgtaccgcgctattcgggcgaaaccgacccgaaggagttcctctccatctatgagtcagcgatcgaagcggctcatggtgacgaaaataccaaggcaacggtaatacatctcgctctagacggcatcgcccgttcttggtatttcaatttaccagccaatagcatttactcatgggagcaattgcgcgatgtttttgtccttaactttcgaggcacctatgaggagccgaagacgcagcaacacctcctcgtcattcgccaaaggccgggggagtcgataagggagtacatgcgtcgcttctcgcaagcccggtgccaagttcaagacataaccgaggcgtcggttataaacgccgcatcggccggtctgctcgagggcaaactcacaagaaaaatcgccaacaaggagccacagacgctcgagcacctacttcgcatcattgacgggttcgcaaggggcgaggaggattccaagcgacgacaagctatacaagctgagtacgacaaagcctccctcgtcgctgctcaagctaaagcacaagttcaagttgccaaaccacctcccctctctgttcgccagtctcagccggcgatcaaaggatagccgccaaggcaaggccaggcccccataacttggagaaagttcagaacagaccgtgcgggcaaagctgtgatggtggtcgaagaagtgcaagccctccgcaaggagttcgatgcccagcaagcgagcaaccatcagcagccagctcgcaagaaggtccgaaaagacctctactgcgcctttcacggacgctcttcgcacaccacggagcaatgctgaaacattaggcaatgtggcaacgcgcaagacccaaggccgcagcagggaacaactgtcgaagcaccctgcgaagcagttcatgagcaaacacccccagccgaacaacgccaagatgtacagcaaagggtaatccaagtgattacaagagctgacccgccaagccagttgtccaaacggcagaagaagatgcagacccgtatggtccacagcatcacttcggcgggtgaaggggcgccgcagtatctgaaccaactaatttcttttgggccggaagacgcagaaggagttatgttcctgcatcaagatcccctggtaatctcagctgagatagctggtttcgaagtccgatgaattctggtcaacggagggagttcggccaatgttatcttcgccgaagcatacgccaagatagggttgcctacccaagcccttaccccagcaccagcatcgctccgcggtttcggcggcgaagcagttcaagttctcggccaagcacttttgctgatagcctttggcttgagggagaacagacgcgaagagcaaatactgttcgacgtcgtcgacatcccgtataactacaacgccatcttcggccgtgcaaccctgaacaagttcgaagccatttcccaccacaattatctcaagctcaagatgcccggcccgacaggggtgatagtagtcaaggggcttcagccttcggccgcttcaaaaggcgatctagccataatcaacagagcagtgcacagtgttgagaccgaactgcatgaacggccgaagcacacgccaaagcccacccctcacggcaagataccaaaatgcagattgatgatgccgaccccacgaagctcgtatcactggggggcgacatgggcgaagaggaagttgagagtatcctagaggtgctcaaaaagaacatcgatatcttcgcctggagccctgacgaggtggggggtgtcccggcggatctcatgatgcatcacctagcagtcaacccggacattaagctaagaaaacaaaagttgcgcaagatgtctgccgatcgccaagaagcggcgaaagccgaagtacaaaaattgctcagggcgggggttatctaagagattgaccatctggagtggttggtgaatctagtgctggtgcggaagtcgaacgacaaatggcgcatgtgtgtcgatttcacagacctgaacaaagcgtgtccaaaagacgacttccccttgccgcgaatcgaccagctcgtggattcaacagctggatgcgagctcatgagtttcctggatgcatattccggttaccaccagatccacatgaacccgctcgacatccccaaaacatccttcatcactccattcggcacattttgtcacctcaggatgcctttcggcttaaggaacgcaggagcaactttcgccaggctggtgtacaaggtccttggcaagaagttggggcggaatgtggaagcttacgtcgacgacatcgtcgtaaaaagccgcaaggctttcgaccatgcgatcgacctacataagacattcgacagcttgcgcgcggcaggcataaagctgaatccggagaagtgcgttttcggcgtccgcgcaggcaagttgttgggtttccttgtttccgaaagaggcatcgaagcgaatcccgagaaaatcgatgccatccagcaaatgaagcctccgtcaagcgtacatgaagtacaaaagcttgcaggccgaattgcggcactcagtcgattcctctcaaaggcggccgaaagaggtttgcccttcttcaagaccctccggggcgcgggaaagtttaattggacaccagagtgccaagcagcattcgacgagctaaagcaatacttgcaaagcccgccagttctgataagcccacccccaggaagcgaactgctattatacttagcagcttcgccggtggcggtcagtgctgcactcgtccaagaaacagagttcggacagaaaccggtctacttcgtctccgaagcactgcaaggagcgaagacaagatacactgaaatggaaaagctcgcttacgccctagtgatggcttcgcgcaagcttaagcactacttccaggcccacaaagtcatagtgccatcacagtaccccttgggcgaaatactctgaggcaaggaggtcactggccggctcagcaagtgggcggcagagctatccccgttcgacttacattttgttgcacgctctgccatcaagtctcaagtgctagccgacttcgtagccgaatggacaccggtacttgcccccgaccccgagcccgccgaacaattctgggtgatgtgctctgacggctcgtggtcgcacaagggagcaggcattgcggcagttctattttcgccgaatggtgtgccgatttggtacgcagcaagactgcagttcgacacaaccaacaacgcagcagaatacgaagccattctcctgggcctaagaaaggcgaaagcactgggagtccggcgcctgctaattcgaactgactccaagttggtagcaggccatgttgacaaatccttcgaggcaaaagaagagggaatgaagaggtatctggaggctgttcggtccatggaaaaatgcttcaccggcataacggttgaacacttgcctagagaccagaacgaggaagtagacgccttggcgaaatccgctgcttgtggtggcccacattcgcctggcatctttttcgaagtcctacatgctccaagtgtgccgatggacagctccgaagtcatggcaatcgaccaggagaaactgggcaaagacccatatgactggcgaaccccatttgtgaaacaccttgaaactggctggcttccggtagacgaagcagaagcgaagcgtttacaactcagagccacgaagtataagatggtctcgggtcagctttaccgctccggggtacttcaacctttacttccttgcatctcttttgccgaaggcgaagaaatggcaaaagagatacaccaggggctatgtggcacgcaccaggctgcaagaacagtggcctccaaagtatttacacaaggagtttattggcccactgtgttgaaagtctgtgttgagcaagtaaagaagtgcgaaagttgccagcgtcatggctgaagccaagccgcgccccagtatgatctgtagcccattgcgccaatatggcccttcgccagatggggactggacatcatcgggccgttcccggtggcgcgaaacgggtataaattcgcaattgtagctgtggaatctttctctcgatggattgaagccgaaccccttggggcaatcacttcggcagcagtacagaagtttgtatggaaaaacatcgtttgtcgtttcgaagtaccaaaagagttcattaccgacaacggcaagcagtttgactctgataagttcagagaaatgtgcgaagggcttaacctggaaatcaggttcgcgtcggtcgcacacccgcagtagaatggggcggccgaacgtacaaatggcaagatcctagaagcactaaagaaaagactcgagggggcagcgaaaggcaaatggccagaggaattgctatcggttctctgggccctttggacgacccccacaagacctaccaagtttagtccgtttatgcttctttatggcgatgaggcaatgacccccagcagagctaggggctaactcaccaagggtgatgttctctgggggcgaagagggacgtgaagtatcgctcgaactcttggaaggagtaagagtcgaagtgcttgagcacatgcacaagtacgccacaagcacttcggcaacttacaacaaaaaagttcgacccacggagctgatgcccggtcatctcgtcctaaggaagaaggcgaacccagtagcggttggcaagcttgaatcaaagtgggaaggaccatacctcatcaaacacaagtccaggacgggatcttttcgcctagcgacactcgaaggcgaggagttcgaccattcctggaacgccgcctctctcaagcgcttctatgtctagaatgggtgtcacccaaatcgccaaattgtaaaaatgtacatactgtcatgtaagcccttcggcactatgtaagcccttcggcactatgaaagcctttcggcaagaaaaaaaaagaaaaaaagaagaagaaagagagaaaaaagaaaaaagaaaactggatgtagggctattatccaacatggaggcccgaaccagtataaaatctctgtgtcctccgccttctttttatttttcgtgtgattgataatttgtggaaaaacctcaaggcaaacgcctgatcagcgaaaaaggccaggggggcgaaacgaatcggccaaagcattgctcgccgaacgttgaaaccgcaacagcttgtctcggaaaataaatagccgaacgacgttacgtccaatcagcataaaagctacagatcaaaaacgaacgacgaaaagctgaaaagtcagtacacctatttcgctaatatatgcaaaggggccggcatgttccgacctaacaaaagcacaaaaagtgacgatgcaaacaatagcgaaaaggaaataaaacacgtctttattaacttcgaaaaaaaataatcgaagaatagaagtttcacaacacgatacaattcaagtaaattacatcttcatccccataatcactatccctccctaaggaatgataaggcgaactaggttcgtcatcactactaatattgtacacaaccttaagaggagtagggggcgaaacacagactaaactgtaacgacgctgaaagatcgtttcctgacgtttagtcttctgatggtttcgccaaaagcgagccatatcctccaaacgtcttgaatgaacaaggtcgtaatcttctaaggttcgcccggggtgcgcccgcagccagtcggcaaccttgaaaaccttatagctgcgaccgtttatctccatttcgcaataaataggccgaaatggacatcgcaccttcggcaggtccttcaatgccacaaatttctcgttttgacttcgccagctcccggaagggggccgaatgcacaactttcggcgaaccccctgatagacagcgcagaaaaagcaaaacacagcttacatagtaagaataggcggaagaagggggaggtatggcataatgcgagatgagcgaaaaaaataatatgccaaagacctcgatcatcaaaaagcaattaagattgtgtcatatattccaaatgtacaaaaaaaccttttttaaggttcagcggcagcctgctgaatgtacatcattcgcctctccaggcaaacgcaaaagagggaggaaaactacaaaaatccaaggaaagggcggagggcctcacacctctgggtgatcctgggcatcgcctccagcctcttcgcctgccgcgccctctccttcgccccgatctgccgcctccgccttcgtcagttgctccagaaggcgcgctttggcagcggaccggccatccttctgccagaactgttttcgccacgcgcgaagagcgggcgaaatgttctgcgcactaatctcccagtcccccttcgcataggtagggaactcggcgacgtgctcgcagccgaactgttgcaaaaggcctaaggtaaaggccgccgatacgcgcgcacagcaattgccgtacgtggtggcacagtccgaaaccgatccgccagcctgctgggtccactcagagaagtcgaaggctgaggcatactcggcagggaccccccgcaccttcgcgcccatgtcggtaagggcgaggcggagcgtttggcaagccgttctcgtggattcggcggtgttcgccatctcccgtgaaaaccgctgcgactcctccgcggcgctcgcttcgaccctgctagccttctggcgaagagcctccatcttcggctcagtaaggttgtagtaatcgatgagcaccgccgaatggtccttctccttctccagttcggccttgaggcgatcaacctcggcccaggcctctttccccttgtccaattcggaatgaggcgtttgacttcagttttcgcctccttgagggtatgggccagggactccacctccaggttcttacggcttatttcatcatccttggctcgaagacggctcttaaaaccgtcaaaacgggcccgcacggttcgctctgtcgaacagtgagccgcaagaatctagatgaaagataggagcgggcgaaaagaacaaaaggttaattgcgagacgtaaaaaaaaagagagggaagaggaaaacgaagaaagaagaaaaggcatacccgaaccgccaaacttttaatggtggaacacccctcgtcgaactcgttaagttcggtgaacaggctcggggtgccgacgggcaagacaagattgcttactccctccacaaagagaataaggtctgcccgggtctcgaagtcaccaggggcgaagtggggcgccgcaagggaatactccgaggcagatgcttcgacggccgtacacttccctttcgccttgaccagcggcgaaatggctggctcgcgcacagggctcccgaaaaccctcgccacagccgacacgatccgttcggcggaggtggcagcttcggcggcggcgctaccgcctgccccagcaacgccgagcagagcaaggggagcagtcgaaaggtccaaactgcggccagcaggtgaagtcggagtctcgacagaagactcgtcgtcgctgaaaacgcgagcgatgtcgacgagtcccttcttctttgagatcttcttgaccagacctcctttcgccgccttgcccgacgagaacgcaactagggccttcgccccttccaaatcctttcggcgaaggggagagctgttcgactccaccccggtctcgttgtgacctggacttggggtaggagtgtagccgggggtgttgacgcggtcttctatcgccttgttcgcggccttatcagccacagcctccacctcctcttcttcctctccttcctcctcccgtcacgttcttcggcatcatcctcgtcgtcggcgtcggagtccgacgaagcaggaacccttcgcttcctgggggcaagcttcacttgtccacgcatccgctttcgcgaaggccctacatcgtcgtcggctttttggggattcgcccggggaggcagttcgccgttgtaaacccggttcgcccgcccagctgcttgtcgtgttagcagctggctatactcgacgaccgaaacgtcgccgatcatcctgcgggctttggcttcagcctggtcgagggtcgacactgcaaaagtaaagggtgtagctgcgttaaaggtcagacaaggcaaaataacaaagcacaggagtgtatagcaaaagaacggtcttactgttcgtcccctcaggaagaaccaagttcggcaaaccgttagcctcttcgcattgctcgaccgtgacttgccatgactgggagaggggaaagatgcgaagcatacagaactcctccaccaagtcacggcagctaaggcgggagcaaaccttgcgcagcaggacgaaccgcgcctccatagccccgtccacggcgatcttgggtttccggttcggcgcaatcgccctacgccggcaccgaagagcttttgccgagtcagaaccagccgcgaaggggatggtgtgatagaaccacctcgccatccaatggcggtcccacttcgacatggcagcgttcaccggccagagatcagaccgctcggggcgaacgttaaagttcatgctcccgaacactgtcttcttcgttccagccggggtaatcaccgtcttcgagttcatgatggcgaaaaatatggcgtcgaagagctcggcgctggactcaaacccggaagtccggcacgcccagtcaaagatggagatccgaactagcgccgatgggctcaactgcggaagctccacctggaaaaggcgaaggatctccggcaacaacacgttgcacggaaactgtagccccgcctcaaaaaagacggcgaacaccaccgtccgattgtcgacaagcttcggcaccacggctttccccggggcgaaagcctgcccctcaaccaacgccccagagctgaccaacttcgccagttcgacgtcgtccacgagagaaacccccaaaaaggcggtgctgtcatcatcgacccggccgggatccggtccttttgccgaagctgggtttggcttgcgaggggccatggcaaacggcgtgtatgcagtggcgaaggaagataatgggtgaaacacctgaggggtcaagaaatgctgtggaagaggggaacagaagaagagagcgcacgcagtaaaaatggcaagtgtaccagtgaaaagaaaagaggggtgggaatatatagctcacccgagcgaccgttcgcctacccaccagtaataaagcgccacgtgtcgcaaggataggcgaaacggtaaattcccaccgtctgagcagcacagtaaaaagcccacgatgggaaggcccaatactgtttcgttcggcccgagaaaagaaaatatatataaccaccaatcgcaggaggcgaagcgcggcaaaataataccagccgcacaagtaacaaacttcattcgtaggaataatgtaggtttcggcaggagcatcggtcgaaagggggcgccgcataccataccacatggtttgcacggtctcggccgaagctccaatctcacccttgcccgtgaggggcttgttggcggatggcatgaggcccttcgactaaatctgccgaaacccgtggcgaaggctatggagcaagaacggcgtgaggcgaagagtcgtacgagtgccttgccaggccagaggcgtctcaggcgaagggtgcaaggcgaagactacctgccgaaggaagacgacttcgccatggcaagttcgcccccgcgagggccgaggaagcctttccggcccatcaagcctaagggctatagggccggcgatcgccagatggcccatcaggggcccatgagcccctataacattatgtacccctgtaaatgtccctttcgtaagggtaatcatgtaaattcccctgtacaacctaaaccctagtagcaagaacctgtaatggggctataaatagtcccctagggccatgtaatggggggatccccaagtgaaattcgaaatttaatacacttattgagtaaccacgtctttcgacgtatgcggttgtcgtttcgacaacaatcatgatcacgaatggcccttcttaacaaagaagttctttaattaaattagtaaactcgtggagtatggactaaaaagttgggcagcaaaacatgggagtgtgttgtagttcaagcttagtgttgtagttcaagctgagctaggcgcctaggtgaggtccgtgcaattctctacattgcatatcttgcagtcgcgacatgcgaagcatgatatttctttcaaataagtgtcactgagagggatgaaaatccacattcctttaaaaaaggaaagtgatttcatccctcaatgggatatccactcgtttcgtgcatgtctcctaaatatttataaaaaaataaaaaaaattgacaacatagattaatataaaatatatcactacacaaacatagaagaccaaattcaacttctacaagttacaacaaaaagaataaattaagctgaaaatagttatcgtacattcacaactatatttgttatttttgttataacttgtagaatttgaatgtaaacttgtaagtttgtggagtgatatattttatattaatctatgttgtcaattttttaaaaaaaatttaataactatttagatgacatgcaaacaaccagggaatgtccctttgagagatgaaaatccacatatccctctcagaagtatacattatttgttgcgaaatctatatctatatacctaataaaaaatacttaaggttttcgttgtattttttccttcggtgtttggttctgattcctatttcgtcgctgatccgggcaatacaaaattgggacacacgtgaccaaaaaaaaaaaaaggaaagctagctagcaactagctaaagcagcagtaggccagcccagcaaaaagcactcggagcccagcagcaagccaacatagcccctgtttggagaactagtctagagttattttaagagttattttttagcacaagaaaatagtcctccaataaaatagccctaagttgtttggatccaagggctattttgaaagctatttggcttttaatgtaccttctcatggagagagatagagataaaagacactttttcagtgggccgcacctgaaatagccccaattagcaccctttgggtgggatagttttttttgggtgggctatttccaaatagccttcaaatagctcacccttttggatctttttgagctattttgactatttgagggagggctaaaaaatatcctttggatccaaacaggaccatagcagaggagcagtagcccaacacagtactgcacgacactgtagcaacttaggaattttttacattcttttattaaaatatttaaaaaataattttttttcaaaattttacaaatctaaatgcctctcgctctttgggagggcgtttttaaaaatcgcccttccaaagggcattaagggacctaaatgcaatttttttatttgagttcaaacccttcctttttagtgttttaattgcttaaaaagttttttttgacggcaggcaaataaacttaaaaactaattaataatgcttattcgacactctagataatgttaaatagaaaattaataaactctaaaattgtagatctcattgagatctataacttttatataaagttctagaataccctatatagtttgctatatattggaacggatggagcattttacgtgtgttcttttggagtattttgcctccttaagtaaaacaaagagacggattaatatatgattaattaaataatagcttaaaaattaaaaaaataattaatatgattttttacagtaacattttataaaatatttttaaaaaacgcattgttgtgtagtttggaaaacgtgcgtgacaagaggaagtgaattgggaactatgagttaaaaaagaacacagccgaattcatcgtcttcctctcgatcggctggcgagcgaacggacgtgtgaggcggcagcatgatgctgacgatgaccttcgtagccccgataatcgccgccgccgcagccgccacgcctgtgccatcggccaatcgtcgccgtcgtctaagccgccgccgccaccaacgccaccgccgtggcgccacccgtcgggtcagagatgaacaaggaggaggagggcaacgtacgtcggtgaccattcaccggccgtcccacgccgccgccggatgttgggcgagaagataccgctcactcctggagaaaaccagtaaaacaaaattttcatctcccacgtcctgttctaccgggcacactcgtcctgcgtcttcttcatgtgtctcgtcttctgaaccatcttcttccgccgacgatgtgccctcccggccggactgggcccaacgcacctctcttcccgacggggccttccattgtttcgccctacatccaaggagaaaatggtcgatgaaaaaccatagaaactattggcgaacccataaaacaattcatcctttcttccattgttctagatctactagttcttctcggctgcaactgcaatgtgggtgtggatggaacgaaggaagccgaatctcttacctggggtggggtgggcagcgccgtcgcggagcgccgggatacgtcgttctccaccggcggcaacccgtcggcgcttcttgttcggtttggcacggccgcggaacgtccggtggaatggggaaagtggaagtgaaaggggtagggaccgtcgggagcacaaccttgctggcttggtggagtgggctccacgcgtggggccaggccagtgtatttctcgtatgcgctggggaaagtatggaatacagcagatattcgctgatatacctcgtccgtatagagtgtacgcacgaatcttggagccatctaatggcggtgagcctaggtgcagctgcacctaggttcagaaaagactttcccgctcactcctttcttgtctcaagcgcggcagcatgaatattgaatgcttcacttagttttgtgtagctaccagcatactcagacaagggcattcatgcatgcatgcagagcaagatggtcttatagcaaaatggatatatatattatgcactgcatgttatatactgcaaattaatctgatcattatgtaataatcattttctgcgagggcgctaaccctacaaattcagtgtgtttgccatactaatccattcagttctgaatgaatggatccttgcaaataataaaaagaaaatcctgaataatgacagggcacaagtgttcttttgttgtaattcagcctttgaagttcacatatgactgggggaagcatcagtgatgtggtggtgaatttgtggatgcatgactccaccaaccagggtacaaatcctgatgcccacgaatattacacatatgtagatgggctttcaataggattttagtgaaatcagggatgtgcgctggttttcgtctcttagagcatgtgtgaggggacgtattcgcgggggtgtgagtgtggtgttgcgtgtatagtggagtgtgtgtgcatctgctgtgtaatctcaaaaagaaaaaaaaaagttcacatatgactggagtttgagctgccgtgttgtaattctaagagattcagagctactatagttattagtattactctctattccgcataatgggtcagaataattttcatttcacaggtttcgcaaaataaacctccagtgttattggattcaagaactgccactattgcagtgtgtggcataaattagatgacccttcaaaattgcattaaaacagattaagacaacattttttcttaagaaagcctccaatccgatccaatcatgaaatttcatacacagtttatcatgcttgtgagggtagcagcgcgatcacgggtctccgatgtaggggatgtgccgaacaatccaccgatcgattccctctaacctcctgtggaactcttcaggcatcaatgatccaatgcacagctgctggagtgacctaagatgcacaaagccctgtggcacagatgttaagcttttcaagctccaaagctcaagtctccacaagcttctcatggcgccatcctcaacctcaacctccctgagctcattcatggagctcaggtacaggtgtttcaggttagggaaccatccagcgcgaaatgtcagtttcgccccgtcgaagcaccggtaaaggttaagatggcctagattctggaacatggcagcaaaagaagcgagcggatcttcatgaagaccagagaagcagaggctcaagcttctcagtttggtgaagctggcaaaaacgggaggaattgctcctttgtgtagcctgccacttatcatcagcttctccaggtgagataaaggttttaagttgccgagatcaagggcgtatcgatcacgatcttctgcgagaacagacaatgaattcagagatgtcatcttgctgattgaggtccatagatcagtgttgtgggactccagcaccttcatgataccgacacttctcatccttgtcaagcatccaaggtttttcactatgtagctattggcttctatgcttctcagagtctgtagatgttccaggcaacttattttgctactcgctgacttcccaaaccgcccgacatctataagtagatggtgaagcttagttaacattgtggtctcactgggtaactccagcacagaaccattgagataaagcgtttgcagattgctaagcttccctatcgaactcggtatctctttcagttttgtgtatcccaagtctaggtagtgcaagttaaacagctgagaaacagaatctggtaccttgtgaacattgcaatttctcaggcacaagacccttagcaatctaaagctttggtagcaatctgtgaaccaagacaacgatatttcctctgtaaacatgagcatggaccgaagctgagatgaacattttgctgcttggactaaattgccatccttttgtaaagaaacacgccgtgatccatcggtaactccatctgagttaggacagtcccatgtagtagcaaatttttccttcttagatatggttagggatatttccctaacaagatcatgcatctggaatctctttggccttccatattcattcctattcacaacctgaagcaatgatcgactagcaagttccttcaggtaacatgcagctacatctgtcaatgttgtctcaggtcctctatcctgaacaaatccttcggctatccacaatctgattaaccgttttctctcaattcgataatcttcagggaacaggccgcagtaaagaaagcaattctttagataactagggagatcattgtaactgagattcagaacactagcgacccagctcagctctggattgttactgagctgccacctaagttgattatagaacaactcccactcatgctcatccatttctttgtacgataaaaggctccctatagctacaagagccagtggcaaaccttggcatttctccacgattctttcagcgacggtcttcagattatgggggcaacttctgtcatctaatcttgagaaagccttttgacagaaaagagtccaggcttcctgctttggtagaagtgtaagcttcagttcatagtttgcatctgctagagatgctaccgtttcgattcgagttgtgataactactcggctgccattgttgttcttaacaaatgcattatctagtaaaggccaggcctccctactccatacatcatccagaacaattaagtatctcctcccttttagatatctttgaagttgttccacaagactcacacaatccatggtatcagccccatccataatattttcagttttgctcatgagttggactaagatctttttcaggagatttttaacaccgtgattttgtgagacagtgatccatgcacggcaaataaatgttcttttaatttcttccttcttgtaaatgctactagcaagagttgtcttgcccaaccctcccattccacatatggagattacactgcgatctttttttgcatcacataaccattctattaatcgcttcatctcttctgcattaccaactaaatcatcatcatcattcaagtatgaatattcagataaatgatggtgcctacttggataactcgctgtattctctcttccactgcttgcaaatgagatatcaaatctatttttcgcttcagaaatcttttgtagacgatcctctactagttttgcctgagctgaaagcttgcgccatttcttaacttcgattgcttggttgaatgctttctttaggaaactgccagtcccttccgtttggccaacaagataagtgtattcatcgacaatgtcctcagcttcatgcgctgctagccttacctgttccatccaggcctcaagtaccatatcattggacctgtccacagccacttgagctatgaatgcttgcaacattgagaagtcgctttgaagtagtctcattttattggttacttcaagaaggtcaggtgcttgcttcttcaacttagaagcaagtatcttcgatccttcttctgcaagtgccgatgaaatcttttgaacaactgctatgaccaaagcttctaccatgttcaaattttagctttaaacctataactggaagtctggaaccttggctatccttttgcgggtttaatcctgcaaccagagaaaaccaatttacatgagtaaatgttgagaataggaggcattccatagctggacattgtggattatggaaaagccagcacccttatggacttatgcttgcttgaacaagtattccttacctaagattggaccctgagaaaacacaactaatactaggttggcttttttttcttaagactaatattagattgacataacctagatagtgaaacactgccattaactcatcacataaacacaactgacatcgacaccgaacgagatagtctcagcaggtgtatcatccacaacactgatcatcaccgcaatactccgatctccactgaaatgcatgtgaagcaccaacaaaggactcttcatgtagcctagtggttgcagtgacctgaatagcacctcaaggtcctgagttcaaatctctataggagtgaatttcagattgggttatttgagggctagttccttgttcgataggctaagttcctattagaaaaaaggctgcatatatccggttggatatagaggccgggtaaaaaatactcttctctaaaaaaaaaaaaggactcttccaatttgtgtttcagcatcaataacaactccacaggaataaaaattactcatctacaggtgattctttaagccccagcatgccataaattgcatagaaacaagaatcaacatcgccaagccgatacaactctccctgcaacaggaggatctccagtgagatccctgaatcaaacccttcactcactaggatccaccaagtggaagccaagaaattaaaacccaaacaatcttttctctaccagccactcactaccaattatcccactaataacaggcaatccgcaagatctgatctggttcttgagatcatctcgaggacaagtacggccacaaaatttgacaaccgttcaacagatgcaaccaaggagaggtggggaaccaaccaacaaaatctctatacctgacgctgcagcttccgttgcctgtacgtgctaccggcggcggcggcggcgacggcggacctcgccggagccatccacgcgaagggcgggggattgagtagacgacactacagcagtgtggctgcactgcagctgtcatctctgacttgcagaaaagtaatcgcgaaatgtcggcttaattgaatttccggacataatttgggtcaacctaacagttaacacagatcgaatttttttcgtttttagatttttttttaatatttacataaataatctatcggccaaaaaaaatcgcaaaaatagaccgtgctgccccaatggtgggcggcaagctgacgtggcagacggtgggtcgaccgcgccgtctgccgccatcggccaaaattgcgattaggcccttgccgcccatacagaggccggcaaggggctaattacaattttggccgcccataaagagcttgcggccgtactttttgcatctgggtcccttgccgccccagtaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtacctcattcgacgtattagtactcggataattaatataggcctatcgcaatctcggtcgtagaaacattatatggacttaaacaaggagaattatgtaacatgaagaaatagtagtacaatttgaacatgatacaactattttcattacggttacatagatgatattagatttgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgttctggtagttcaaactgcacaacacggctaggtggagttagaacccttctggtgtctatccattctctgtattgacatctccttggtggttcctgggaggaaagaatagatgtaaagcgagtaaagttagtaaatgttgtgagaaaataaggattcatgtaatcaaaatattcttaccatgaaatcgtcgtcaagaatatttggacaaacaaagaaccttcgatccaatgttgtaggatttatggaacgaagaacctgacaacgatcactacacctgcatcttggacgggcttcccatggagggagtgccgtagttagcacccgccagtcgctctgttgttcacgacattgtcgttcataagccgcttttctctgtaagtattgctcagtactttcggatgcgaaataccagcgaccttgtaaacaagtggttaggtcgagaacgggattttctgtatcgacccactcgatgtatgcgcaagccgtagactataacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacggacgtttcctggtccatggtaaacttggaatatttgtttgttcgacatatctgtcaacgaattaactagatcatattactctttcatgcaataaacatctacaacgtaatatcttcttgtgtaagccaatgcaacggtaatgtattgattccaaactagcagatgtacgtagttaccgatatctacaatacgcacttctagattagtacaactaaaaccctaaaaatataatgcatttattcaaacaaattttttaaaaaatacacactatttaactcaatagtcacatataggatctatgaatattacctgaaattggcgtctgaatccggcagggcttcgccccttcttctcttctcctcccctctcttcttttattttcactggatttgaggggggaggaatgagggctgggggctggg

SEQ ID NO: 17386 - DNA, 12379 bp, Oryza sativa
  unsure (1)..(12379): unsure at all n locations
gcccggccagagggcggcaaggggccgcctgcaaaatgcccggccccgactggcttttttgcattcgggcccagggcggcaagggttttcctgcaaaaaaccctccctccgtcaccgcccgttcctcccccgtttgtcacgtcagcttgccgccctagaggtgggcagcagggtctatttttgtaatttttttggccgatagattatttctgtaaatattaaaaaaaatctaaaaactaaaaaaattcaacacagatccagcatggaattattgcggccatggtgctctcggcccgattaaggaccgggctgaccgctgcactttaggcccattaggaggtaaaatcagcccactcaactttcaggtaagaaagccgttgctcatcaggaacttgttcttatggtgtgttccccttcttggggaaaaaaaacatatcaaatttattaccaaaatcaaccttatcaacatttagcactaggggtggacaaaaagcttggactcgtgagctcggctcgggctttggctcgagctcgtgaagctcggctcggctcgaggactaaacgagccgagcccgacctccctccacagctcgtttgcaaatcgagccgagcccgagctagctcgcaagccgctcggtaggctcgtcgagcctatgaaaaacatgacctgacctggcccattaacaaattgtctccgtctggcccataaaaaacagagaaccctaccttaactgctccgtccgaccctccccatttcccatcccacgcaggcgcaggcacgccgccgcacgcgcgcacgattggcgtctggcggcgactagcgagaggagttgccggccgccgtctccggctccatcccctgcgccgccgcccgccggcccgccgcctctctcctttatccccagtcgcccgtctgtgccgccggctcgccgcctccctcccctgcgccgcctccctcccctgtgtggctgcacagcttcggccttcctccccagcggcgctcgacggtcgacggctcgacgctccccgtgccgccgtggcgccgcctccctcccccgtccccagtcgcccctctgtgccaccggctcgccgcctccctcccctgtgtggctgcacagcttcggccttcctccccagcggcgctcgacggtcgacggctcgacgctccccgtgccgccgtggcgccgcctccctcccccgtccccagtcgcccctctgtgccaccggctcgccgcctccctcccctacgccaccggcccgctgcatccctccctcccctgtgcagctgcgctggctctagcctccctccccagcggcgctcgatggtcgatggtcgatggctcgacgctccccgtgccaccgcggcgctgcctccctcccctgcgctgcctccggcctccctcctcagtgccgctcagcctccctcacaagctggctcgagccggctcgagcttttaaatgagccaagccgagctgcactttttgctcgtttcatttatcaagccgagccaagccaagcctgttcttgaccaagctttcacggcttggctcggcttggctcgtttccacccctatttagcactataaaaatttggtatattttgatgctaccaaattttgatagcattggatatgtttaatttgtaatctttttaaagtttggtagtgtttttgtgagaggaaacttcgaaaacttacagtaaattttagtaaggtagagatgagaacatgtttattttgttaccttaataaaatttggtaacacaaaactgataaggtcagaaatgaagtaaatagccccttaataagataaaagtaaggttaggtgatgtttggtttaatacctcacaaattttagtagacttttgtgagtggaaaatttcaaaactaacaaaatttagtaggattgtacattagtactaccttacccaaaatttggctggtgatgtcaaattttcatttgggctgagtttatttccaaactttttctttaaactttcaacttttccatcacatcaaaacttacctacacacacaaacttttaacttttccgtcacatcgttccaatttcaaccatacttcttaagccatttctcgcccccgttagctgactacccacacagaaatgcctgcattaattacgaagcgtctcgaaaagaatcaaagttcacatgatggattgatggtacaagaattctccaaagacaaacgcagatgacagactcaactgcatccaatgtagtatcaatgtatgatcagtgataacatccatacgggagtcctaatgcccgcgaggggcttcatcacccgactctaccatgctaattctgacgctgctaaaaacatcatgcaacaacaacaggtcgtgtcgtctcctaatacaacagtctcaggttgaaaagtttatgtacaccatgcgactgacattacaggaagggactctcgtggtcgtgggtcacacacacttgccatgacaaataaatagcattacaccaacttgagaaggctttgtacatccaggtgtatctcgtcaatgaatctggggggcagtcaccttctccgtctttttgactccacctgctgaagagattagtccaaatgaaatgtttgtctttcagaatcgcagaatggtgattaccaaattaaaaaagaactaaatagtgcatgtaccttggatgggttttatttactgtatgattagattatgcataatataagagtgaaactgtacaagctaaagtagggcaaattgtgcagtatccaaaaaaaaggttacagcaattgccacagtaatcaacatgcaaaagttccccaatcctttatagttgtaaaatcacaccagactttttactgccatatgaataaattggtactgtttcccaactggtgctttgtgtcattaagtattggaaatttgttcaactacagtagcgatacaacaggacagacatctcatatattataataatattattaagcagcatgcctcaatatcattgaaaattatgtgtagcctatgttattaagacgacatggtgaacccgggagaccctggccttgatgtattaccatcgcactactgatagctaaacaaatcattaatgataattcagtaatcccaacatatcatattttaccttttcttcggattgcgctgtagcttcatgagaattctcagccatctttccattttccgcagtacagctctggcagaaaaaatgctctagtttttttgcatctttaatagtcattccaatgcaagaagggtgaaacctggaaagcaaaagcagcagatatttgttgtgacaaaaaaatgataagaaagttcatgcaaaagtaaaagcagaagacaaaacaaattaaatgttttattatctcaggaaaaggtccattttactccagtgaaccatcctcttcccaacttctttttgctagtacttttaagttcaaaccacgatggttgatactatcatattctatgctaagaaatattttcaaagttgtaataatcatttgcatagaagttcatatctcagtccttaaaccggtattaggtgtttccaaccaagtgaaatagtcaggaaaaatcttaaaatattatagaacacaatagtacgaagtaatctgtcatacctcaaagttactacttgtacaagaaaaacaaaatagacaaatgatgttgagtagtagtgtggcctagttttaatagtttgccatgtgcaatgaacaaaagaatatgggcctgtttgacaaggctccaactcctagtggaatctggagtggagcggtggagcggcccaagccccgcttcacccatctagttcattttttggaatcaatccagcccattccactccccttttaggtggagctgaaactgtttcgttgggctccaggtctaggaaaggtggagctggatatatatattagggggttaagagctccagagaaatagtttagagtagagtggatttctttcttcacttgctaaacccttcctcatcttttggtgttcatatatatattgtactgaaaagtgtatatgaaatgtgaagcctactcaaaagcaattctattaacttttgatggtggattccatggacatgtagcttgaggtcatgaatttctttcagagcgtgtgggggttggggtgtgtagagtactataaccgccaaggttctacagctagcaaaaaacaataactcagtaggccatatggggtttagcttgtttccttatgtttgctaggatatatatctctctatagtttttaccagcgcattaattgtttccttattttaaattagaattaggacaagcgaacaaggaaattttttccttcgtctctgcattgccacagcaaggaaagagttaagagagtctagtgtggcaattgtaatagtgcttattcccattaacaatatataagcacgacctacattattggccaaaacatcagcccaaaacacatgtttcaacaaattaatatggcgatgtaacaacaaagacatgccatgcatattgagaggcccactttgtagccttgctctcaggaatttagagtatagacattatgcaatggttatgcctttatatctgcacaaatctctttggggattgtgaataaatagagccaatgagtgatttgttctggtgtaaaaaaaatggaaaagcatttatttctctgacggctaactagttgccgcccatcccaataggcaagaataagataagggcaagacacccaaatccattaataggtaaaaaaaattggttgtcctattcacccagtggcaagagggataaaaccataaaatgtacaccagcgcagttcaggaaaaagatgaatttaaatgaattatttcattactcaccaatcagagcattcctcacattggatcataaggtcatcaggattgtatggcatctcacacttgcagaacctgtcatattgttagtaaagggatgagaaaatcaaataaaatgatgatattaatgcaatacataaatcaatttaatagatagcataggccagcaaagcatagcaatataagtgatatttggttgagaatgtagcaacagtaaataaaaatggtcgcagttcatccactacagccaaaaatctttattcatgttattcggatagaactaccataataaacaagacatccattttgtaaaatgaggaatcatggtcaaataaagaaataattgaaaccaactaacatgataaggaaacacccagagtggcatacagcattacaaagtgtcatatatgcttaggatttggcaacaccacaggctctaccgaacaggtacgaccatgctgatggttggcagcagcatcgcaagggcagggagataagaagaacgaaggtaaggaaccattttgttatttcttgcttaatactaatgacacagtcacgtgtccttatataagctagctatgcgccaaacatccttgtcaaacttataggaaggataagagatatgcctatccaaaagttagctaacaatcttaatgacagtacgacagcaatctggtggttcagcctatgatgcatggatacagaccgtaaacatggcatggtactgatacagggaattcgccatccccccccccccaacacccacagacaacacaaaacgcccacccacccaccaaaagggaaccacaatatggtgacacactacatatttaaataaaaatattatgtatacattattttcaattgtttgacactgaaataatgtatggcaagctgtaaaaaaggaaaacttatctcaaagacagtccatagctcctagaattcagtcaatactcaatgcatgcccatatgttccaaaattccattagcctggtgagggcacacagggatgggattagggttgagtatcctggctatgtgggctgggccgtgtcgcatacgagtcagagaaaagttgaccacatatttgagaagaaaactaattatttttttatgtataatcgaccaatacttggtcgatacctatctgagttgaacatgtcattggacattcacgtgcactgtgcacaccagctcctaatctcttgatgcgttagccagtcagcggcttccgacagaaccatgcacattcactactgctgctgccttcagaacattctataacctctcacattatgacattgcacccctcctttcgagcagctcatcctcaagcttctaggtggcggctatggctgcagtccaaggagggcccctcatggacaaaaaggctgcagcactggcaccctaccacatgagagcaccaggttgtccagatcgtgtctctaacaaatacgattggagacagccctaacaggcagaagtaataaatcataaccaatcttatctctaacctcgctaacactacatgatccggactaatctagtactatggccagcacaacctatagcctcatctcaaacaccaacagctagatggaaggtacggcatgagctgcttccatgagcctggcacgctgacccctcataagccttctaccagccgtgatgcatcatgcatgtgactcgaaaagaatagttttaaatggggcaaggtgcagaatgcactaaattggggcggtgtagtaagcaatgggttctagctgtcttggtacttatgtgcaatatgggctacaccactacacgagcctaccatagacataccacataatatatcatggcatgcagtggctcttcggtaaaagaacatctcaagtttgtaagagcattttactgtgcctctattttctccaaaagcaagtaataacagcaaatgtggcaagctgaaaataggcacaaaaccttatgcatcccttcatattccacttcaacacagggaaatagttattgtgactctttggaaagataaaactggtgatgcactgaagcctatagaatctagacaggtcataaggatacatatatcacatatcaactcatcagaattacgaacttgttgaccttgggatttcacatcaaatataaaaggcatgtgtgaaatccctaaagaagactggaaaacataatcaacagataacatgatatttaaatatggaaaatgtcatcgacataacagatcaatattgtgcagatgtcaacggaattaactgcaaatacgaaacaagttcttttcagggctatcacatagcggaggttgcattaaattcttacacagcaatgcggtcgggcacgaagcttcctgtggctgatttgtactcaaagcgacagaagaagtcctcagcattgacagaatcaagctttgtgtagctacggaagctgtgaacgttgcactttccctctatggtgtcagcactctgtacgtcatagtgatccgagaggaacacctctttggcaccatgaaatggacgccttccacccatggactcctctggccgatagtaccaccgcacccgtactctcacatttgtgcctcgtgaccctgcagcctcaatagcctcaactcttgccacatagggtggctttgatgtatcagatgccctcattagcacacagtccccagctgcaagaaacatataagagaatcagacaggtatcgagataattttatgcttataaaaaatagtgacatgggtcatcatcaagatgtaaagctggtattggatagtactggcatcacagtgataatctcagagcaaaggaaatgcaatctgcttacagtaaaacaaagtgtactaaacacaaggtaatcaaagcatcaaggttcatggatgctgtcaacatctagatatgaattataaaattaaacaaagggctgacactaaaggaaccaattaagtctacagatatcggtgtaagtagtaactatgtttatctgggcaggtttccataccaaagaatttaacagatatcaaaacttcagaatctgacacctctaacttgaatataagttagattagcagaaggcatgaatcaaccttgaacaaacagcacaaaaggagttcagactagaaagactatgcaacatattgattttgcatttaaggctagagaacactatctagccaaaacaaaactttagggtgcctaactggatagtattgattacataactttaagcagttaagcaaacattttcttcagtaaaaagtccaacagtagctacattgtgtagaaagagattagtcttcatgcaaatgtcaaaaccaaccagaacttagatgcaacataggctagaaggtcaagactataagcaccataaacaattgtaactacagctggtatttgcaacacatgaacacagccattaagatggtaaaaaaatctctaattagcaaaatgacgatcagaaggcagattctagattatatctagcagaagggttctgccagtagtgctaaattgtagctcacaaacagatacaaaactacttacagactgaactcccataatctaaaacaggaattcaggaaatcaaagtgcatttaagatcataacatagctcaacagcacatatatgtattaccctcctagaaaccatgaaaaatattcgtctgttcatcaaggtaatcaaaagttcaccaaacacaaggtaatctgttctcaaaacacacacacacacacaaggtaatcgaagcatcaaggttcatcggtgctatcacacgtctggatattaaccataaatatagaaaaggaggctcaagctagaagaagcatttaagtttgcatagattggtgcaagtaatataccggtaattaaggtttatctaggcaggtttccatcccaaagaatcccaatgtgccaatagaacaatgtcagaaatctcagaatctggcatctctgacctttgcataagctaagattagtagaacgcatgcatcaactttgaataaatagcacaaaaaagagttaagactagaaaaactaggcaaaataatcgtttttcatttaaggctaaagcacgctatctatcaaaaaaaaaacttaagatgcctaactggatagaatcaattagttagcttaacacaaggtctaagccatgagataaagattttcttaaataaaaagtcaaaggtaagacacattgagtagaagttattgttcttcatgcaaatgtctaatactaaccagaactgaaacacaacgtaagctacaagaaattttttttttcgaggggttaagctacaagaattacagcacgactataagcaccacaatgatcataatgctaactgggattagcaacatatgaatccaaactattggcgatcgtaaattgcaattaaaaacgctatatcagcaaaatgacatagctcatggtgctaaaactgtagctcacaacccagacaaaaccatgtaggggctccactggacataatctaaaacagaaaatcaagatgagtttaaactcataacataactcaatagcacatatatttttttctgtattaaccgtcctaaaacccatgcaaaagagagataaacccatgaacaatcaaaaccacaaagagttaacgctccaacagattaagttaacatgctcacatatccctaccatggtttccttttctgattatgaatcgagcttacatcaacagtaaaccagagacctaaacaccatttcatttcgcacggaaacatcagggaaattaaaatgctcccccgaaacagagcaaacatttccgcgacattcaatctaaccggagctaaaaccccagaattccagacctcaacaaaccgcgacccaccgaaacccacgcccccacaaaaaaaatcccccccaaaaaaacccccagaaattccggatcgaagggagcagcggttggggaggtgggagggggagcctcacgcttgatgactttgtcggagcccttgatggtgtaggactcgaggatccgcttgggcggccgcgacttcgccatgggacgcgacggcgacggcgagagggggtgggagctagggtttggagttgggaggagacgaggagatggggaattttgcctatttctttattgggaattcgtggttttctttttgggtctcgaaaatataaataccacggatttcttcgcttccttttttacccgcctcgcccgcgctccatttgatgcgagcagtaaaagttggtaaaaattcggagagaggagggcgcgtcttagccgttgatgagtggatgtggatgcatcctagccgtcgggaggctcctcttctggatggttcggaagggttcgaggaccagcctgctctgacgaggctttcaattacgatgccgttcagcctgctactccagataggctgtactccataaaaaaaaaatcaacctaagtaatagatttgatgtgttatttgttgtattagaaaatatctcatctaatattacgttgattttttttttacggacggagtactgccattttctattaaaaaattacctcatttcattttcactttcttttatccggatattcatatgatgatcacttaaatattagtttaattaacctcttcaataatcaaacagatttatcagtggtgcactggtgccgtaacattatttttttataaaaaaatactcaagatatgttgtactagatacattggcgaatcatctttggtatcgtctatcgatattatagtatgctaattatatttagaatataatgttataatatatgaataagcattttaagcataacttttgccgaaagtcgtcggtgtcacctgacaccggtggtagcttttactagttcatccaaagagtgggagtccaaggggaatttagtgtcatcatttattaatgtaagcatgatgcttagctgaattaaatgccattagatgcgtatttgcctcacggaaagtgaggtagagagcagataatgatagctatgtccatcctttgtattcatgtaagattacatttggtcgtgaggtttggctgcgtttttctgagttctgaaaatttttgtacctttttggcaattaagaatattttttatttatgtgattatactaatataataaaaaaagtacgtaatatatatgtaaattctgttgtttctcatttctcttctttttctgctacagcaaggctggtccagaaggaccaatctcaagctcatagcctcactattccctcaatgacaagcaagacccacacgttagaaccatcttcttctttgccttctttttccatgccgctggaatgagtaaggctgtgttcgttggagggggttgggaacccatctcccatgcacgaaaaaccaaacggtccattagcacgtgattaattaagtattagctatttcttaaaaaaatggattaatttgaattttctaagcaacttttgtatagaaactttttataaaaaacgtatcgtttagcagtttgaaaagcgtgcgagcgaaaaacgagtgagaggggttgggaacttgagttccgaacacagcctaaagcgagccacgcacaaggagttccatcaccgcgtgtccgtgttgttgtgaaaggaagataaccctggagagaaagatgaggataaagatcaggttacggttaagtcattattagtatagatggccatatggcccgaggcccacggcccgcccaaggcacgtcattttggcccggtcacagccgagccatgcttgggctgcaccctcggcacggtgggttggcccggcatggcacgatcgaagaaaaatagtacagggatgaaaaatagacttaaataaccatataaggcaacacccaaaaaggagagaaatacaaaatagatttatttctagccatatgaacatagcccacatagttgagggatgaaaaatagacttattctgtggagaagcacgatgggctatcatgccttcgggccagtccagcatggcccgagtcgtattgggccgtgcctaggccgtgtgtgcagcacgtgtgtgcaacacctcggcccaagcacagccggacctgggccgtgccgtgccgggcggcccatttggccaactatagtcattaggacttggttgtgtcaataaatttccccatacagatctcacccctgtggaattaacagtgggattgaagttgtggtacctcaagaacggtaaaatttctcttggataggtgctatgaaattatcaagtctgaagttcagatccttcatctcttccttggaccagttttttcagaacttttaacaaagctaatggaaggacagctgtttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17387 - DNA, 427 bp, Oryza sativa
atcgcgccgaattttttttaggtttgtacggatctagggtttggcttgccgtgggaaattttcgtggggggaattctgtcgaatttctctcggcttccacggtctggttggattcctgctcatggccgctgggcgccacggaggatacagggactacgaggcaagggagcgggagctcgacgcggaggcttccaggaggagcaaggagcagcagcaccaccaccacccgagcggccgacaccaacgcggcgactccgacccccgctgcgaagctgaccggcgccgtgacggcggtcgcagcaggggcggcagggagttgtcgaacgggtacggccaccgccgctctccgcctcccaggagtcgcctctcagcgaggctcggggatcgcgagcctggcgaagttctgagcggtagtgcgtcagatgac

SEQ ID NO: 17388 - DNA, 410 bp, Oryza sativa
agatcagagatagcgttatgtctctcctgacggtagccataggcaccgtaggggactagtcatgcctatctctgaagttgatatctggcgtcttgtcttggcgtatgttggcttgtatgttgatcttctgtcttgatctattgttccgtgtcttctatggtgggtgtgtcccctctcctcctaaggggccttgtagttatacccataggtgtccccttgtccaagcagaactaggaaaaccaatatggatacaatctgagagttcttgtcgtttccatgtagaactctggttctctttccttattcggaactccctccatatccgaggtcagttttcgtataagacatggtatatggtgggtcatgccgagatttagtcgactactattaggtatgtggtacccataacc

SEQ ID NO: 17389 - DNA, 613 bp, Oryza sativa
atccgcatccgcatccgcgaccgcggcgcacaggtgcgcgggcgcctctcttgcgaaacgggcaaaaatcacgggctcacagcacggtaggagtactagggcagacgaccgttcacggcacggcacgggacagcgcgcgcgcgtcgtccacggaacatctcgggatacggtttttctttcgtaggagaagcccgtaggacagtaggacaacatgagtagcgtttctttttttgtcgtggtcaaaccatgtgtcgtcaattggcattggtccgagtgcgagccgatttcatcgatctccgatttttttttttagaactttcctctccgaatcttcgcaacagcaacgcgacaaacccgccccagcgacccccgcggcggccgtgacgattttaccatcagttgattgccgttatcacaggctaggctagcctctttgacactgctcgttccatcagttgagtagaaatgatttggttttgacaaatcactatctattacatatatacaggtaatttttagggcaatgcactggctccggtttttggcacagctacaaaggtgtgaggatgatggggaattcctaaaggctgcatgccgcagggggctgcaggaa

SEQ ID NO: 17390 - DNA, 5698 bp, Oryza sativa
  unsure (1)..(5698): unsure at all n locations
tttctcaattattactgccacctcatcatccaatcctacatgccatttttaggggcaacacattaagcatcatgttacttgccctcatcgtcatcaacagcaatagcatgacctatatttgaggtcatggagaatgcaacttggcaagtaccttctctcccccagtgtcttgaaggcttgaagctacggagaaatatatcgtgtacatgtatttcaacttcgactaaattttctagtgaaaccttaacctgtttgaatcttcattgtaaattcgagccaaaacgttggaaggtcatggcagaacagcagttttgaatctccagagatcatgaaatctgcattgctacaagtgttcggaatcatcgctatattcagattactccaaacattcacgcatcggtcggagtaaagcttttccatcttccaatttggaagcaggcatccaaaatacagaaagcagacgacaagcatgcaccagtttgctaaccaaaagaaatgagtgagacatctcattcaacctcacagctccacggctccacctgagcacattagctgactatgaataaagcgaaaagataaatgacaagttaaggaaaagatgcacaaacccacggaaacccccaaaagccgatacaaataaaatctccttatctccctagctgtgcacgctaataatgggctgggtttacatgatacgggaaaataattccgatgcatcatatgttggcatctaaatatccgcataatatcagaacataactcctattgacaagctgttaattgcctcacaacagcactgctagatcacagttctctatttgtacatcatctcgatggaaatcttatacaagaaatggggttacttgggttgatcctggcagtgcacacatccaaatcaacatgtcatctagctactacgtttaaagatgcatcaactattcaactggtaggtaatgattttgataatttcttcttcttggaagccaatgctgacaatatctttttccgaggcccctgaaaacaaatcaagatatctaataaatatggacacaaaatcaaggcatataatgctgcaaaactcaatgatatcgctactcataaaggctgacaaacttgaaaaataaatatatgtaagtagattgcaatcggaaggatagttgtacactagtacacaatggacactctagcaattgttcagtttcgttacggcatgcacgcataccatagacaagaaagatcaccgacatgcatctaccaagggcacaccggaattgctaaattttagagcttataggcagttagcaaagccaacatttatgaagtttttacgaaataataaaaaaccaaagtgaaggaatacttagctatatatacaaaagaaaacagggggaaataacacacaggagataaccacttgtacttgctttgtctgcaaccagacgcatgtcatctatgaaatatcattagtggaacactaaaccctaggataaaatctgaaagatgcaaaaggtacacaaaggcacatatgacagtacttataccacttcattcattttagagaatcatcatttaactctattaaaagctactagaaatttggattagtaaccgatctagattatactatctaacaagatgtcaaaagagagacaggtagcttataaagaatgcatcataattctaaataatttgaaacatcttagtaataattctgcaagacaacccctagccccaccccagctcacccaaacacacaggagaataggggattaaatcaagttaatcctcactcttcagggaagttatataacttaaacctgctctaccaacttgcatatttaaaattatgacagtaggaaaggtggcaatacagaggcatctagacactcatttgaaaaaaaaataataataaagaatggactagctcctgcatgtaaaacaaagttccaatccaaattcgtacagtaccattggaattcctaaagacttcatgtcttcctcattcatgtgaagcagagccttcatatcaacctgaaaaatgattaagcattaacaaaatgtagtaggctagtaacacatgaaaaacttgaatacccaaataagtcaaacatgcctcttcagcctgaaaatttattgagtacttctctacatcaagagacttcagtaatctatcaagagaggaatcagtctgcacattttaaacaaacacattattaaaatgttcaactgataatatttaatgatgaaacccaaagtaatcataaaagcatctggacagataattacattggtacaatactatgcagatgaagtttgtattttttaacaagcagtcaagcagattaaacatagataagattatatacaaaaagacaataattcagaataaaggttggagaaacattaaatgctcaagaacaccaccatcacatcattacacacgcgaaatacataaaagggatgtagcataatgatacattattgtcccattagtctagaacaaatatgaaagcatattagttgatcaggacgagagtttgtgagaagataatatgacagtgtcaccaccttttcctggcattgctttggtgcagatggttcgttcactttcttagtagcaggaagggccgcattaacagggggttccctcttttggacaggttccctcttttgaacaggtttagcgctcgttgatatctccggtacagactttgggatctgtacagtactattcaactgaggccgctgaactccagaaacaatttnttnttttacgaagatctggaactgatgatttcctcataacctgagtgttttgctgcaaatgtggtttctggtttccttggatatttctggaaggaactccagcttcaccgtgcaaaacgaaagtaatacagtaatggtaaatcatcatgcaggaagcaaaaatgaattgtatgtttagaaaatatactatgaatgtcccttacatgaactttgaactcccacagagtccatataaagttcacgtctccaagtcccatctgcctgacgaaacctgtccaaaccacaaagtagaagatataagcaataggattgtgtttgcttctgtgctcacaattaatctgggaacatataaaccaaccgatcataccaaccatttgtgaatcttacacatcaggtggaaacactgcagtgatgcagcaatttaaacatgacttaatgatgcgataactaaagacaacacaagaaaagtgacaatactatagtaactataccaaggcgtgcatgcatatagactggcagatagtgataaaggttagctgcagcaacaacagacgacacggctgtccaaaatgctacactctccacagtttcaaaacgaatttaaagcaaatgcagtattctaaccaggtcactggctatcacatttgcagtaagacaaaaataaacacattttcctctcagtctgactaatcaatccgctggtcgcaaccacatgtctcccctctaagtgggtcaacctggaatcaacatgcaaaatgctcatttaagtgcgccctaaagctacaatcaccacgcacgaagccacgaactccctaatttccacgccctaagcggcatttcccaaacccacctcgatccccatacgatccaaccacgagtcgcaagcccgtaacatctagcagcgcatgtacagagacaaaaagcaagcgacgatttgagcctatagcgagctcgaagtcgcacctcttcacggagtcaggccgcgggcgagagcctccgccgcctccaccgccaccgccaccgccaccgccaccgccaccgccgcccgatccgaggcggtccatgacggagcgcttccgcccggagacactatcggagtacatcgcggcggcggcggaggcgatgccgctagggttttcgtcggcggcgaggggggcagcggtggagaggccggaggaggcggaatgggaaaagggggcgacgtggaggtgttcctcggaaattttccttcaaagggaaaaaaaacattaattttccattttttttagaggggaaataatataatgggcttgggcctaactgggctggactttgaaaattaaagcccatcaagtaaaatagctgaaacttatattctggcccaaaattagcccagctcaattggctccacaaatctaagcgcttgtttggtttgaacccaaattttgccataccaaaatattgggagtcaaactgctactcccttcatttcaggttacaagacattttgactttgtcaaagtcaaactgttttaagtttaatcaagtttgtagaaaaaagtggtaacattttcagcccaagacaaatttattatgaaaatatattcaattattaatttgatgaaactaatttagtattataaatattaatatatttatctataaacttagtcaaacttaaaacagtttgactttgactaaagtcaaaatattttataacctgaaacggagagagtacaatacaatttatactagtatggcgaacatttgatatcaaaccaaacatccataaagtacggttgaaactaccaaaaatttggtaagacataaattagcctaaatccaaacaagccctaggaaccaaattcaaacaatgcataaagttaaatcccttgaatttgacagtgagcaagaaaccaaactacataaatgaaatgggggtcaatgcacagtttgactatgcaaggtagaggtggtcaatggagaggagaggaggagaccattcaactcaaggcacttgttgtaccaaccaaccgtgcagtccacttgtatctacacttacgcgggagcattgacttgccatccatccatgcgtctcctcgtcgtcgtcgtcgtcgcagcaagaggacggccggtgcaacgaccggttgatcaatcgatcgattgatcgccggtaatctcaccgttgaatcagggaggaaagagtcgccggatgggaccagatgatggttaaattaacttgttaattaattacgaataggttgcagcagtgtacgtatgcatatagaacaggacagaattaatcgtgtggttagttcgagtaaacaaagaaaaaaaatgagaatgagatggaggtgtttagcttggaagcatcgaacaatccatccgtcgattgggaagctagaggaagaagacagcgatggagttggcgagccggcgaatggtcaaagatggccaactttggtttaaggtgttaattgttaaatcgttcgagctatagtgtgctagtcaactgctccatctgaccaatattttttcactaagaccccttatattttgactattttcgtgaaatgaacttggctctatgataaggatctatatgcagacgcggccttataattgctacctactggcgataagcagtgaactattgaagtactccctccgttacatatacaagtttataaaaacaatataatagtattttcaacacaaacaatcatattataaaaatatatccaatgttatatttaactaaactaaactaatttgatattacatatgttactatttttttaaaacgtaaagaagtttgattagaaaaaaacgacttaaaatatgaaatggaggaagtagtagtttttcttccggtttcgatgtgttaaacaaaattaaggttaaatatttataactttaagtatcaatagttttaagtttatttattttaaat

SEQ ID NO: 17391 - DNA, 7796 bp, Oryza sativa
aaatgagagggtacatagcaaagaagcgacttggctgggccttctgggtccctttcgtggagtttataatcccaggctgcagctgcaagccagccggcctgagagagaggagaggagaaggactccattggcgacaagctaagcttagctatagctatagctagctagcttagcccctgccttccaaggaggaagaaacgaggcatacatacccatcccctcctcctcgacggctagctgctacctcgtctgatcgatcgatcgatctcctcgtcggccatggcggtaagctttctttgctctttcttcttgctcttctgttcttgggcatgggcataccttgcaattgcatgcgaccatgttcttccatcgctctttctgccacagtttaccgttaggcgtaggctaagtttgatctgtccatggttttctggttcaatatctgaacctgaaatttctgaaggaacagttctcactttcttaataacttcagagtaactcgtttttatctgtccatggtttttggatgcgaaatctgagcctggattttctgaaagaaccgtaacaggatcaccacgattttgtttcttgtcatccagtgttagctagttaattagttggaacaccggtttcatcgcttggaaaacaaagtcctctgttgttgtgctcttgttctgcttgaatccacctagtttgctcaacttgaatggtatgaataacttattgcttgtgtgaacgaaggaatatccttgacgtgttcatctgcaagaagtctttcttgatggttgagatgtatctttccatcacattaagttgtttttttttctttgtgaataaacatttaagttgtagtattgtctccatagtattcataccacaattaatcaaactgccatagaagatagatgttgtctgcttaactcactggaatacgacgtcctggataatcaattgttctcccttaatcgattacattattcaaaatctgttctaacctgaagattgaatttgtatataaccaaaactgaagagataagggatgcatcatgcatgatgcatctgtgtctctttgacttgaaatttctcccactttttgtaatcttaatcaaacgtagggtgtcagcaaggtagacctaccttgcgctgtcatttctccagaagctttgacaaattggcacacaaaagagattaattgtcagacctgaacacccaaccgccgcattagcccggtcctgtctggccagcctgattaatcagtccaagtggtgaagccacagcatgtgaacgattgattaattccgattagaaaatcagcacgttccatttgattagtccggccatatacatcaaatgtatgcagtgtgtgtgcaattgaccagttcctggtctccatttttcttttgctaattttttgctggtcagactgctcatttacaaccacttgtagtaggcagtagtacatgattcagcaagtcagctctgtcaagttggcatgttcaataatgtttacttcagcaatgtccttatgagtatgacttttgaaaacaaaatcaaaatctcgatatgtttgatgaattcgcacagctgtttttttgtagttgtatatggcttcttgtagaagttgatctgacatgcaaaagaaaatgttcttttttaggttaaaattgtggcagtggtcatgtcagcgatttttataattcttaagaagacatcgtgatataccatattttatagtctaatttttgttttaccatctagtatactaaaactgtatagtagttactgggattcaggatccactatctcagtatacctaaatttcggatcggaaaaaaaataaacattaaacaaattctgatcgaatttaaatacattttgccacatacgcattttttttttgaatttttcgtgcgaaatagtttcatgcccgggccaaaaaatccccaaaattgtgagaaggggaagaaaatgcatggcggcaatggctgatcatatatagctttgcatttatgcagcagcagcagaagaagaacgcgcacgtgccgaaattcggcaactgggacaatggcggcaacgtgccgtacaccgtctacttcgagaacgcgcgcaagggcaaggtcgccgccgccggcaagatgttcaaccccaacgaccccgtcgacaacccggaggccttctcctcctccatcgccgcgccatcgccgagccgagcccctcctcctccgccgtcccaccacgagcgcgccccgagcgacgcgccgccgccgccgccgccggccccctacgccggcggctcgccgtaccaccgccacgccgctggtggtggcgagacgccgccggcaagaagaggaggcgggcggacaagcggcggcggcgggtcgtcgtacagcgtcgagcactcgccgtcgccgtcgccgctgcacccctactccgacagcgggagcggcagctacggcggcggcctcgtcgccaactcccgcgccaagggcggcggcggcggcgccccgcgcggcaacgagacagtaagctagcttccctccgctccgctcgacctctccgccattgatgacgcttttgcaagcttcgtgaccttgttgttgtgatcgccaatggcagccgacgagggggtcggcggtgccgcggttcggcgactgggactcgaacccggcgtcggcggacggctacacgcacatcttcaacaaggtgagggaggagaagcagaccggccaggccgccgggaagccggcggcggggctcggcaagggcggcgccgccgccgccggccacggcaacgccgccaagcgataccacgacgacgacttcgcctccacggtgagccactccaccaaccaaccattgcacataggggcctcatttttagttgcttatatttatcagccaaaatttaaattttcaaccttaaatttagctgattttaaggttttttatcaaaatttattttttagcctttgcttttaaatcgctagaacacgtatataaaagttttattaacaaattattttttgtttgtaaatatagtgtttcacttattccgcgaataagcgaaacgatggctccgctaggttcttgatttcttttacatttctgatctcatttgagctctacatttttttttaatttgcagaagtgctcctgctttggatggtgcaaatagagatggattttgaggctgttatcaatgtacttgtaaattgcagagaatgggattttcgtttccccagtgcgattcatcagcttcgaaactgcatttggtcatagattatttatttggaagtggggaaatatacattacagtatagttcatgcctgctgtaatggtagattacgtattggattgtttggttccttctgtactggatttacatgcttgtaatggcaggttaaagcttgggctgtttcttgttcttatcgtcatttaatttgtcccttgtcaacacagaaagtccattatgcacgtattaatctatgaaactagatttctggtagatttggagttttttgttttttggatagctttttattgctgaagctggcagtctgctgcagagctcccttaatctgaagactgatgaacggtcgcatcacatgcactctgatcctcaaaagttctagaagcaatctgttctttttccttctgaatttacttaaacaaaacagtgtaaattgaattgcttgaaactattatcatacaaaaaagaaatgcacatacggtgcgtactggatcaagaacactcaaaacccaggggctattcagattgtagccaaaataaaccttaccaaattttggcaagttgacaatattcctaaaattttagtagaatttcttatatatttaccaaagtttggcaacaaactaaatatagacacttttttggtaattttatctaaaaaaaatatagtatgattgaaaatggtatcaatctaaacagcccccaatcggatggcctagtgagcgtagctagtccatctggattcaaatctagttttacagttttatccggcccatctacgtgtgtgggccgtgattgaggcccatcaaaacgagtccgagacgaggagtggtcagcaccggggcccacctatcagaagcccagcgcgggaggagaggaagaggagggcgccaaagtccacagcgactcccctttccttccgatccgtcccgaactcgaagcgaaaccctagcgagtttgcgccgcggttcgttttggttgttcgttcgagaccgattcgggtaaggtttccccctcgccaattcaccccttccgtttattaactgctctgatgatttgcctcatctgattcatctgttctttgctctgggattccgccgcggaagcaagctcgtccggtttccatcgtcgtctgggatcgggctcgctaagacttttcttgatttagtaagctgatccccctcagttcgttgtgaattgtgacggattcgggaaaaattcaggcactcttgatcagggtttggggtttagcagtctcggtgagcatttgtttccccccaaatctttctttctttattgttgttgcgcatctgtgtgttgtgataagttctgcgaaatgtgatataaagttatgtgtgtatagatcgtagagagctgagattagaggatatcattgtaattgatatttgacaacacctaaaaaagaagttttttaagtcggcaggagcatgagaattgcctgattagatgatctttacaggttctttatataccacatacttgaaatttcccagtgcttgcaggcatttctcatctcgactcttgttttgccaaagtattgttgaattgttcccttccttccaaatttccagggttctcagttttgtttttttccccctcttttgctcttctggcgtgcccaggatcgcaatctgcgttttttttggtgcctatctatctttaatgcaatgatacgcaaatcttgtgcatgttgccaaaaaatgggcatttcttgtagaaactgttaagggaattagggtacttaagctgaagattcagcaataagtaattgtggctcactgatttccaggttattccaaatatcataagaatcatgagtactgcaagtactgcacgctctaggaagcgagcccatgatggatccagacaaaaagttgatgttataaacttggaaacaactgctccagtggtgaacactgggagccagcatgaggctctgatccttaggggtacacggacctcacccatcgatgttgaagctctagatgataaagtaagcttttgctttcttctgtctccaattaagcgaatgaataactgaaacctttacaagaagctgaagctgatgtttctttttgatagaggaggagcagaaaaattatgaggcgctctgtggctgtagtggatccggagaaggatactggtccgggaggtaagtacattacttatgtttgaactccacatagcttagtctaaaagaactatttggaagtcttgtgttactcagaaacatttggatacttccaagtgacataagaaatgtgcaccattaattctaacccatagttctgtactgtaggtgaaactgaaacttgatagtacatcggtgtactgtcttatagattattattacaagacactacaacatatacaataattatgattcatacctcacaaatgttcatcatgattccctgttttccctgttccccaaggttatggcgttgctggagctatattttcccggggcagaaattttcagggtgctgtacatgttatatgcctttctccagatagggaagaagggaccagcaaggttgttaatctttttaagttgatcttctttgtactgtgatgataattgcaattccgcattggctggtgtatgtatattgttttcttaatgcttagtattgtactcctacatgcaactcataatatgctctcacctttgcagccgaaaaatgtggcccaaaccagtacgacgcatgccaaggttgctccaaaggaaccaacctttacctgtcctgtgtgtctgaacaaactggacaagccatccacgacaaattgcggtcatatcttctgcgagaaatgcatccaggcatggctcaaggctcagaagaaatgccctacttgtaggaagagtctagggatcaagagcttccatcgtgtttacctccctactcctgctgattatgattaattagtttctgctggcctgaacctcactagtccactcctgcacattcatcttgtgtgcaaaagaacttgagcagtagttaaagagttagacatttagtctttgtttgttagccctgtaggctaacaatgtggtaagaagtgcacaacacgattcttagctcattgactacatctgatctgatttgtatgtaatggcgtgcatttttctcctgtgggttctgaaaaagggaaaatatctagttttccatgacggcatgacccatgaggttcactataacaatggccttcctttacaagtgttacaaaccgctgttctgactcgatcgtgaattgattcatgatttaactactgtacagccactcaatgtgatgtgagatgctaaattctactgtaatctatcggcacaaacttgttgctcgctttcaccatcttcattctacctctaatcgatgccaacctgaactgaaaacaacctgatattcaatgtttgagtctttatataaaaacaaaaagaattgtgggttttatgatgaactcatgaactcatctgagttcacggagcagatagccggaagaggcgccggggagggtcagagatttaggggcgtttggttcactccctcactttgccaaactttgccacactttttaggatatttgtgtatgccaaagtttttcgattcaaaggcccacatgtcatacactcatcttttagccaaaccttgtctaaggtgtggccatcaatttataagccacacatttggctagttttggcatggaggtttggcaatgttcggaagtgaaccaaacaaggtccacaggaaccgtgttggatcgagaatgtacggtccagatgcaagaggggtaaaaaaagccgctgatgctggttcacgggagccattggatcgcaggaatcgtccgatcgagaatgtgcggtcaaaaatcatgcggataaagtgcggcgatgcctccgaaccccttgagtccatgaaatccgttggattgtgatgatgcggtgaacaatcaggcacacagtgtccgtatatttcttgacttcttgagtactgataacttaagcttgataactatactttgggggtttgatgatcttctgattccacagctaattagggattaaatcgccgtgacctgcatggaattaatgcagttcagtcaatgcgagatatctcaagctcattgtggatccaaaccgtcggctctcttttatctgcttctaggctccaagctccagcttccctgaaatgatgtgagagtaggacgtgctcagtacttaatccaagaaaatgacattggtgaaggatcattcattggtgtcatttctgtccatgcaccatgcatgtcggtgaacacaaatcaatatctcctctttgtattatcttcttcttttcgagcagattaacaggttcaggagaagttgcatgatccataccttcttttccattttgtaattttcttcatctttttttttactgtatcttcttattttcctttgagtattggcatcaagaaagaagagcaaaagactagccggatgcagcataatttcacatgacaatatgcccttcctctgcaaaaagtgt

SEQ ID NO: 17392 - DNA, 776 bp, Oryza sativa
gtagatctcctagaccgccgtgttttcacagtaacacgctcttggtatgccctgtgggacagagtcttcatcatcaatcatgtcattaccacccacaagcgagatttttgaagtgcgggaagattttcatgatcgagtgatagaggtatgggataagccggtgaaagggcaaaacactgtccaaagatggaacaataagatgaatgccttatggcgccatctaaaaggctgggcaactaacactagtggcttttatcatatagagaaaggacaattgcaacacaccattgatactcttgatatcaccgcagaaagtcatgtcctagctaatatggaaacagacactttcaatccagagatcggttggcacacctacttgggggagaagaaactaaatggtatcaaagggctaaatctaccgatgttcttcttggtgataataatactaaatattatcactagattgctaatagcaaacatagaaagaaacagattattagcctagaccgggatgaagaaaaaattgaggggaacgatgcttcaaaaaaattacatcacaaaattctataaaaagttttttagaccaccggaagtaagttccctttccctagatgattccaaattagatgacatcccccaagtgtcggaggcagaaaatgatcatcttattgcccctctctccgaggaggaagtaagagatgcggtttttgggatggaaacaaatagggcgccagatccagatggctttcccgctgaattttagcgggctgcaggaa

SEQ ID NO: 17393 - DNA, 696 bp, Oryza sativa
gaattggcatctttcttggtgtactccttgacctttccttaaaggttcttgtatgtcaacttcacatccctgaagataagcagtgacaagatcagtttcaaaatggagtgactactaaaactagtatgcctcccttggggagacgcatatacaaaacttgcctgttatcaggatcaatttcaagtgccttcttaatatccacctctgctaactctaggtcagcaagttgcatgtaagcttgggccctcctgtataaagccttgacattttggctgtcaagttccagaacctggcaacaaacaccagaatgttaccttggtttaccaaaacacataacaaatgggtcttttgcaggaagaactgaatgtaccttggtgcaaagcttctcagcttgcttgtaatctttcagcttcagcttgcaggcagcattgttcaagttgcaggtaaccttcagttgcttggattgtttcttctcatcttcgctaaatgagctgtcatactcaatgaattttgcagcctggaataaaatagatagatcatcagtcagtaagggattatgaaaacaaagaaaatcttgacgaaagattagttatttgaacaagtgttcaacaaaagaagcatgccataccttctcataacgctttgaagccctgacatatttgcccagcttgaacaatgcattcccctcttctttct

SEQ ID NO: 17394 - DNA, 1645 bp, Oryza sativa
aacatttcactgacgactcgcgaatcattgaatcgccacaggtcagcagcaagcaggccacatgaaaatggagttctaacctgcttaggccacactgatcaaggaaaagaatgacaatctgtacatagggaagagacccaagtgcaaaactcccattggcaaagctagtgaagctctctgaactcttgaagctaacagtcatcattaggctcttaagagaggatatttcttaatcatagtctgcctgtagggcgatgtgattcttttggtacctactatttgagatgattatattttgatatacccgtaacaaattaaaatagttaatttgtgtataaagatatggtgcagatattacaaagcaccctcttcttcttctttctgattatgtatgagctggccaattagcagctagctggatggatggaaccatgtattaccactgtgcattttgtctatgatgatagttatcctcaccttatcactgatggtcctgcatttcattgcctgtccccatcatttttccattcgaacttagctacagtttgacattatttttctagatctgatattatattccgttgcttaactgaactacagatgcagatcagcgtggggcccatacagtcagtcacattgctttaggtcgaatttgctcattaagagattagttatgcatgcaaaaaatatgtagattaaccacaagaaaggcaattagggttccatctcaataacaaaaaaaaaaagtattagggcctgttcactttgctgccaaaaaaaccttaccaaaatttggcaggatttcttatatagttaccaaaatttggtaacaaactaaatgtagccatttttttttgacaaaaatggcatcaaagtgaacaggcccttagattttttttttccgtacaaaatgatttcgactgtctagtgtctacgtagtcaaatgactttctcggcggtaggttatgcgtcgctattcggcgatacctggctggatctcattatgcaatggcattatttacgattagctgccaatggatgcaggaggaacgggattttagacaggtttttgtggtcagggagctcatttcaaaggtaatgctaaaaataaatcacgatgaagaaaaaaaactctcaaaaatcaactttaagatgatgcaagatttttttttaacgattcgtactagacagtgcgacgtttatattgatagggtagaaaaaaattataagattataaccctgaaataaggtatgtatagtcatatctctatacaattactagtcataacaaaagcaaaatcgtcctcctaccttcctgtacatagcacatcgccgcaagaaaaaagttaccagagaaaaaaaaaagaaaacctggttaatttgagaaaaaaatacctgagaaaaacaagaaagggaaaatgtttcttaaaacgatcatgtgcttttaaaatagattacaaattcacaaccaacccattctctatgggcacggacatatttactagtctttttttttaaaaaaaaaggaattctgattgtcacactcgttgagagtacaatcatgatctgaacatgtcacgacgagcaatatatatttcttcaagaataaacgtgatgattactactcgcaaaaattgaaattctt

SEQ ID NO: 17395 - DNA, 2672 bp, Oryza sativa
taaacattcattatatttaaaatccctctgttattaaatatatgatgcagttgacttttgaatataatacttgaacattcgttacatttaaaattttagtatgaatatataaaaaaatataaaccatgcttaaaggttctttaatgctaaaatagtccacgacaaaataaatgatacttatataatggtccgaataaaataaatggttaaatgctatgtctaaaagtcaacaacgttacatatttaaaatggagggagtagaagtttttggaaaaaaatataaaaaaatttcacacatgtagggggatatatgcaagaatttatttcaaattatttgagaacttctatatcgtggttttcatattatccacctagctatggttcccatcgtatatttacccccacgttttgtgtcaagtgtgtagacctagttcctttacggtaaaattgcttatttaccgtatccagataattaatgacaactagactcatggacaacatgtcatattatcacacacacttatgtggaaaacaagaaaaatgccatccacttaattatgaggggcaaatcaaaagccaagataaaaagaaagtcaccgtaaattgcccatcctcatctttttatttctcacgtaatagagatgccaaaactcatagacattaagcaagaaaaacttatagtaccatatcaaactgaatataaaaagacattttcaaaggaacacatcatctcctagctcgctatcaagatttaagccctgacagacataacgatacactcgtacctttgtcagtacagtaacaaagaagctgcctctagtgtgcaaaaatttcaactctcttttcgcactcatctcatctactactttactccctccgttctaagaaaaaaaactctacttctggagtttgaattttctcctacaaaaaatcaacttcaacaatcatatctaacctcggtacataaaacgataagttttctcccttaaataccctttacctatctattaacactactacttttctaataatgaggggtattttggttatttttattcttcactagtctcttcttgggatgctaggaatggtttttttttggaacggatggagtagcattataaaaacattctactccttcagtttaaataatataaggatttttaggttatttagtaaatgttaatgttacatcaaaagattttttttaaaaaaattgattgtcaaattttgaattttggatggtgtagatttcatttcgattcgaaatttgattggctttaaaattattgaaatgatagaaatcgtggaaaatcaagaaaaaaatacttttatattatagtctaaaacttaaatacaagaaatccttatatttgaaaatggaattaaggagcagtatcaaaagcagtacttaacacaacccattgccttttgcctagagtccaagacattagacatacatgtcagagatcccccattattttctcgaggagtactgaattcgtgcaaagatttatcacaagtcaatgagccagctgctttctgccggaaacatgcaaccaagaaaggcaaccaaagaaaccaaaccctggtctatgtttagttcagcgcaaaatttagattttggttgaaattagagatgatgtgactaaaaagttgtgtttgtatgacaggttgatgtgatggaaaaggactgaagtttggatccaaactttgaatctaaacacagcccttgccatccagctacgttgcgaatatcggcagaagcatcacatgatatgctcatctcgacccaacaacaacaataaccaacaagaagaagctactggcaagtatgtgtacgtctcggttgagctggagcatggagcagagcttgcactcagctcgtacgatcgatcggtctctcgtaattttgtccatggatggatctcgagagagatcgatcaccagtagctgcatgtatgtctgctagctttgttgcctactccctccttccttaaatgtttgacgccgttgactttattaaatatatttgaccgttcgtcttattcaaagacttttgtgaaatatgtaaaactatatgtatacataaaaatatatttaacaataaatcaaatggtaggaaaagaattaataattacttaatttttttaataagacgaacggttaaatattttttaaaaagtcaacggcatcaaatattttgggatggagggagtatatcccaattaggttcacacttttagagcagtactgatgttggcatcaacatcgtccactcgagaatgcctttgtcggattctcgctgattgattaattcgtgtaaaattcctgtattctaaagacggccgtagtatgtgtttacaaggatgcatgcatgtatgtatattgggatcacctacttttccgttgaccaaaaatacatataaaattcagatcatgccaagctagattcgtgcagttagtaacatctctcccaccttaattgccttattctctctttctcccctcattcctcacacgacgtgtgatgcttgacggaacccccgcctccctgctctccggtaccggaagccaccagcaaaccctgcccgaccggcctcctccctccttccggttcctccttgctatgcccaagcagcagcaaggtgttcctctcctgtccgttttcc

SEQ ID NO: 17396 - DNA, 1027 bp, Oryza sativa
actcaccgtccatgtctgccgtccaaggacatccctataaagttacccttaccacctcccaagtctcaaccccaaccatactaatcgatcgatcgccatgcgcatgcatatctcctagccttgttgcctatcctaattaagttcacacttctgatgttgcctaaacaatatccactcgaaatacatttgtcggattcgtatattgattaattcatgtaaaattcatgcgctctaaaggcgggcctctttcagtctcatgcatttaaaaggatatacatggtttactttatttggtcaaacatctaaaactattactatcaataattgtcaaatatttagtatgtaaacatagttatcaatttctttataactaattttataatattataattttggtagataccatatgtcatatcgatcctaatgaaaatacgccaaagacaagataaaattaacaatgttgtacatttaaaaacagagatgatatataatggcaattgcatcaagctttatttgtttgtgaattaatccgggcgtcggcggctgctgtcgacgggccggccgggttggattgaaagcgacgacggcgacggcaaccggattggccatggaaatggatggatcatgcatggatgctcatgctcctgcaggtacagcagtagcaatccccagcatgcagatgatccaaaacggtcgtcgatcggtccatgcactcagacgcagcacacagcactgttgcatgcatcatattaacaattgagctggtgaagaatgaatggatgaagagatttgctcatgtccagcaaaaagtatctcgaggtaccgatatctgacggtaccaaatcgtttccgatcgttggacctaactgggtaggatgtgtattgttagatccaacgatcatatcctaggatgtatattgttagatccaacgatcatatcctgcccagatagattcaacaatcggaaatgatttggtaccgtgagatagctatacctcgacatattttttgttggaccggagtaaat

SEQ ID NO: 17397 - DNA, 29666 bp, Oryza sativa
attcctgcagccctaactttgattattaatagaaaaaaataaaaaagattaatcacgtaaaattgatgttactagatttgttattaaacaaactatcataatatgcaacccattttatttaaaacatcttatttttatagatattgttggtcaaagtagtatctcggagaccatgtcagggtctaaaaaaagcttatattttgagatggatggagtactttatatcagctttgatcctgctagggaaagatacattatttccggttgacaacccattttaagcccatttgtataatcgagacgtataatctcgaactaaaaataggtatttttagtctaggttaaaataaccgggactaaaaatcatctttgagtactggtactaaagatttctttttcactgcatttttttatgaccactctttttttaaagaaaagtttatgtgtaattaaaaaaagagtaaattgtaatttgcaccaggacatataatttacgctaggttgaacatgtactttcacttttcattttgcaccaggacatattgaaataggtttcgctttataccaagttacttcataattaattaaaatcgaagggagatcttataaaatatgattagaattctataaatattcttgaaactagctacacagttattaaaaaaataaaattaaatggaggaaaattacaattggatgagaaatgtagatagcccgtaacattgaatggtgtagagttacaattgattagaaagagatcgttagtgaataagttaattatattttaaaataaattttaaaaactaaaaattgttatagaggggagaacttagatagatctgctcagctgtgacgccagggtggtcgtcatctatccgatcttgacgtaggtgccaaccgcgtcgagacggcgactggagcgcgcgtggaagccgaggatcttgccgccgccgccgccgccggccgggaggtcgaacgcgacgccgtcctcatggccgaacgggccgtacgcccgcatgttgctgacgaaggtgagcgacctgacgacgaggtcgccgtctagtcggccgtagtgccccgccacgctcgtcaagtactcgcccggctgcaagcttatctggggagaaaaatgaaaaacagagagaaagtttcatcacgaatttgagtgagatcagattgtttcgaaatacaacatcaaactcttcaaattttgagtatcagtgtcggcaactattctaattagtaattaacatagtggctcgtatagacatatattagtattgacattagtgatcaagattacatgagaaaaatgtgtcaacgtctcaaagactggagtacttgtttattgttaccaaaacactaaaccacaatttataggtgttaagtgagtatccagctagtaagaatatgaaaaatgcttatagtttcgaaactaaaataaagttttaaactattttggtagctaaagattctcggattaattagatgcagctaccaaaagaactacaaaaagagagttaattatcatccggatacaacaatgtcctccttccatattctagcactacaacggaacggtggtaattaagaatttagggctctgtttcaggttcgttttaactttggtcaaaatcaaacggtttcgatcaatttgaaaatttatagataaatatagtaatatttataatattaaaattagatttatcaaatcaataattgaatatattttcataataaatttgtcttgcattgaaaatgttactaattttttctacaaacttagacaaacttaaaacagtttgactttgacaaacgttttataacctgaaacaggggtaattaacaacgaaattatagtacaattaagattgtgtatacctcctccattctataaaaaataaacttctagctttcacattcatagtccaaagttccgcgatttttttaaggataaatgaagtagagtaatgtagtacctcggaaagtgtgccaccagggccgccccacaggtcggtccactcctcgtggccgttgcgctcgtacaggacggacatggcgtccacggcggcgccgtgccggacggccaccctcaccacgcgacccacgccgcgcatgtccatgtccctcgcaccgccaccgtcgccgccgcacggccccatcctcaccaccaccgccgacgacgacgcgccacccccacccttctgcatctgatcaatccgtcggtcaccggagctggagacgacgatgcatgcaatgtttcgcatcctgcatgatcgaacgaagatcagtatgtatacacacaggagagccagacatgcgatggagttcgtggaatcatagaagaagtcaactagggttcgtgcttggcactacttgtaccatttcgtatgcacgtttgtttgtttgtttgtttgttaattgtgtttgcattttgtatatataggtatgtgttgggaggaggaaggacaggacaggacaggcaatgccatcttgttgacaggctagctgtccaaccattttcttatccatttcttgaatttatccatctcacgtttaatcactccctttgttctatattttacatgcgttttaatcagacatttatagtgaacttttaaataatttgaatggtcaaacgcaataaaactctacaactcatatatatttccaaatgaaagtaatattattggtcctatagctctccaatgcaattaaggagtgattaaaatgttgattatgacgaatactctgctttgtgctccaatcggcccaccctggtatatgccccaagcccgcaacacaacaacaacagtccatcctttccaggcccgtgaatcgacggcccacgcatttttcagcccatttgctccaatcctagaaataaaaacaaaactgaaaatttccccccaaacaaatactgaagactcatacacaccagtttattttatctactcgtatatacggcactacacacatacaatcgcaagtacggtctttttaacatacgtaaaaaaaagttaggaataagttaatccatgaactacacaaaattcatagaaaaaactgactcaacacaagaggtgtcctgtatccaccgatttcaagtatgaacagtgaaatatagttgtgagggaagatacaaaaggctagcacacttttgcaagaaattgacaaagttggggatcatgaatttttcaggtaacagcacaaagcagtcctctcaactattcattaccagcaactattcttctctcactttgtatctcagtgtcacagtgtgtaccagagtaaccaaaccaaaaaacaatttggattacaagtttacagataataataataatattaatgaacaaaaaaccttcatatcacagtgaatccaataataataatgtactaaaacccctagcaacatccaaaccggtttgactgtttctgatcatccttcgaatcaccctcaatgcttaccctattgagggatagctccgccttgtaggagtccgaattcaagatcttcctgctcacgttgctgtagatctccttgattacgatctcgaaagctgtcctcacgtttgtcgagtccagagcagaggtctccatgaagaacagcccttcagcttcagcaagtgctttgccttcctctaccggcacttcacggatattatccagatcacacttgttgcccaccaacatcttggctacagtcgtgtccgaatgtgctgcattgaatataagaacagttattcgctactccagccaaaaaatacatttctacatatgaatgaaaagaagctatattcagatagaaaaatcttgtggaacaaatgcaacagcacacaaccataagtgcaactcatgacttcttgtgagtgggtggtgagcatgcatggaacaaagctgtaaaagcatcaaacaagagaagacaatagctgtagcactataatactatatgcgtctgtcactctgatggcaagaaaccaaagcttatgcacgacacattattatgagtgcatagtaagttgcttccagaaaacagtgagtattacttgctttggaattattaattagagctcttttgagtcctcccttgaagtctaccaaaaaaggaagagattcttcggaacagagaacagaacatatatatagtacaatattaattcctgacgaacaatattagacttcttcagtaagcaaatcgataacagataatcaaggatatccttagtagtttaaagggtgcaataaagtagcatccaaaaaaatcataagggagcatacatagacaaacatagcatcatcttgagcgctcataagataacttactaggctacaagtttatgatcaagatacatagaaccaaaatttcactacatgtaaggttgtatgtatgttcacgagccagtgaaggacactacagaaggatagatgccgactgagaaaatacaggaagaaacacacaagtaatgtgcagtttgacaaaattgtgttctggagtattctgaaatttcttacagtgaataaaaaaactagcacacaacatgaattattacaatgtatcatcctgaggttcattgcattactagctgactgttggttaggccacagtttgtaatttggataaattttgtacctgcctcataaattgcattagtactgtagttttgctttacacaaaactttacctttccagataagagtcatgcatcctacataaaggatacataaaagggaaggacctagacagtacattactgcatttattccatgttggttccaagttccagcacaaaaggctaaatttttgcctccaacaagaggaaagacggaaccaaaaggttcccaacacaagcacaaaggtcgtgtgccgaactgccgatttatcaaagtagagtactaatagtgactgagatcatgatcttatctgtaaatcctattgtgagttgtgactaagaaaatcggtatccaactatccatgattcatgctgcttcaaccatattgacaaaacttaatcggaataaccggaggacatatatcactcatagggtcaaggcatttctagcagggtcaatattgcacgaaccaagacagcaattactacgcttaacatctcaagcactgatgaaccaactgaagttaatcagcttcctaacttcataaatctgcaaacctaccttggacacccaaataatttggtaccaaaaaaattgtctacaatcactacactcccaaatcagtaaatcgcataatcacaccacaccctcatagtggtcctcgcattcattcctggaacattcccccacacaccactgctgcctaagcatcaagattcagatccagattcagaccaggtcctgcaatccgtccggtgtgtagcgacactcctatccccaaaacaacccatgcaaatcactatctagtaggaacccaaaaatggtgctccctttgttcgcaaatttgacagtgaattgttaactaacactagtacagctccctttcgaagaacaacgaaattaacaaaaaagaatcaatcagatctatccatacgcgtggttggcaaaatagcagtgagagaacaggttgagttaaaaaaaataaaaaatgttgaaggaggaggaggaggaggagtgtatactgttgagttcttggagccagcgaccgacgttgtcgaaggtggagcggcgggagatgtcgtagacgaggagggcgccgaaggcgccgcggtagtaggcggaggtgacggcgcggaagcgctcctggccggcggtgtcccagatctgggccttgacgtccttgccgttgatgtccatgctctgcgtctggaactcgacgccgatggtggccttggagtggagattgaactcgttgcgggcgtagcgggacagcaggttgctcttccccaccgcgctgtccccgatgatcaccaccttgaacaggtactcctccgtctccccctccgactcgtcccccatccctccctcccctccggaatgcgaatgagctcgagctcgccgcggcgaggcttttgaccgaacacgagcgctgctgctctcgcggcgagaggtagtgaggtggtgggagaagcagaggaggtgagtgggaggcgagtgggacgcacgcacgggtggaagacggcgaggcgggtgaggctgacaggtggggcccactgcgttgtgaggttggcggtggggccgaggtgtcggtgacgcggaggggtgggggggtgaggaggatgacgggtggggtcaccgggttgggaggaggtagtgcgcgcacgccaagcttctttctggctgctttgttgagttggcgcctcgtcgtcgttatcgtgccgaccagaccaacgcggcgaccgcgggccgcggcgaagacagctcgtctccctcgccgccggccgcgtcaaaggccacttcgttgtattaatattacataatatatttgtgttttttaaaatattacataataaataaaatatttaattgatgggttgaaacaactcatacaatataatgtattgttttgtttgtattgtttcgtaagtagtacttttaagggataaattgtaaaactcattttatctagacgaaatgttcttgtcatgttataaaaaatgctaacatagcatcttatttaataggaaaaatttgccacaggacacgcaaaaaacatgtaattggctgagagacaccgttaaaatgtgacacggctgatagacactacaaaaatgtgtaattggctataggacaccggtcgcattattttattatttctggttcaaaagaggtgagatatttttctaaatgcccagattgccccttttctttccttctttaaacaccagtgggtcccacatgtcatagacagtgtaggtttaatctaatttttaataggtttttaaccacctggcctcacgcatcatggactaatttgtacctaattaatagggtgattactatttgctaatcataagtggggcccacattgctctcctatccttcttcttcctcacacacgcagcggagcggaggaacggcgcgcgagcagcgcgacggcccgagtaggacggtcggtgtcgacgggttcctcagcggcggcggcttcagcctgatgctgtggaagcacggcctcgcctccgacctcgtcgtcgatgccaacatggtgaacgccgagggggaggctcctcaacagggccgccatgggggagggcctcttctgggccatccgaggcggcagcggcgggaacttctccgcgtcgtattgcagaaccagaacgtgcagttcgagtccctgtacctcggtagtcggcacacgccttggcctcgtcgccgccatggccgacaccttcccggagctcggggtgacggcgagcgactgcatcgagatgatgtggatccagtccatgctctacttcgcgttctactgcacggggaagccattggagatgctcctggacaggggcactagcaagccggacaagtacttgaaggccaagtccgactccgtacgtccaagaacatgcccagccaagtctgggagaccacctggagctagctcctcaaggacggtgctgggctgctcatcctcgacccctacggcggcaagatggtccacgtcgcgccagtggtgatgtcgttcccgcaccggcaggcgctctacaacatccagtactatgggttctggtcgaagagcagggcggcgacggagaagcacatgggctggatcagagggctctacggtgagatggagccgtacgtgtccaagaaccctaggggcggcgcagcagccatcgccgccgtcacaggatctctcgccgtctgccgctcctggcgcgggggaatatggctccaggggcaatcttgtcattttgaaaattttccacctcttttgtcccggaaataataaaataatgcgaccggtgtcctacggccaattgcacgttttttgtaatgtccatcagccgtgtcatgttttcacgatggctctcagccaattacacgttttttgcgtgtcatgcctatttaatactccctttgtttcataatgtaagtcaaatttttcctatttaatactccattcgtttcataatgtaagtctttctagcattgtacacattcatatagatattaatgtatctttttttataaaagggtttttttttacccggcctctacatccaactggatatatacggccattgaaataggaaacttagtcccgcaaacaacccaatctgaaattcgctcctttggatttttgaactcaggaccttggggtactactcaggtcactgcaaccactaggctacatgccctttcgtggatgttaatgtatctagtcacacatgtgttaacatctatatgaatgtgtgttaacatttatatgaatgtggacaatggtagaaagtcttacattatgaaacggaggaagtaggaaagaaactcttattgaaagtggtcataccttcatctgcaggtagctaggggtctctctctattccataaaatacttaatcctagctacgaatctatactttctatatagttgatacccactaacaattattagaagctaaatctcaacatgcaagcatgccacatcatcacccactagcaattactattctaacctattttaatccatgcaagcatgatatataatctacaatattatattatagagatcaacaagtatgtgtcaaatcatcttcctcacattattttctcaacatttcaactatcatcatttctataatatttaacatatatttatccatgaatcctacagcaaagcgcggggtatcacctagtttcaatatatgcgtatatagattcatagctaggattgattttttattaacttttttttatttgatggagcagtatttgacagggctcaaactcctaaatctacatctacgtcatttcaatacaattacttaatttccttttcagctgaagctaagatcattctgttagattctagcttaaaaaaaagggtgaagttggagttgaggggcctatttgatagagctctaacttctaaatttagtttcaagaattgggtctagaatagggttatggagtagcctaaatccaactccacctttctagtttatattgtgagaatgctccactcaactccgctttcattttaaatggagctgaaactgtttggctagagctagagccggagttgtagatgtgccaaataggtccgaagtttttaaaaaatattctgatttctgggtttattgctcgctcacatgtatgtcagtgagagataagttgggaaattctaaattttattacatggagaagatatgtaactagatgaacatattatatattgcaggaatctggatgttcaaagcgtgattaattgtcttatcgaccacaattattcaagaaccgaaccacacgacatgcacgacgtccaaactaaattaagtgccatggcattagcatgcacaaacttttattaaaaccacacccggggcggcctccatcgatcggtcgatcacaacaacaattacgcatgcatatgctagctagttaatcagaacttagaggtggcagatgcatctgtagtggtaggcgctgttcatgggatcgccggcgtcgacggggacttcctgcacgctgcaccggcggcggcagccgcggcactcgttgtaggtgcacgtcggagccctcgacccgatcgccatcctcctcgccgccgccgccgccgacgcccggctgctcccgcctccccgtgcttctccttctgatgatgatgatatctcagtttgggcctaacaagaaacatggcaagaacacaaagtcaattaaactgaagcaactcacctaaggctattcgacctttaacatcatcttcgtcacattggtatgcatcttttacttcttattatcttatatatatagatcctattttgaagcagcttaaaattcttagaaactaccagtcggtagtcagtttctaagaatctaaacaatcttggtttcttagcttctagtttttagttcttttttttctctaaccatatatttccatatattttatcagaatctaagtgagaatataaactgtttgaagacctagagacttttgaagaagatgcagtggttagaagctctccatgacatatatagccatgtatactcgatcatggagctacagctagcttgctttagattagatgcatcagagagatcgagctagcagaagttacgtacgggcagacgtacacttgttaccaccggtacttcttctgtcgtcgacggcgagagtacccgagcagcagcagctaaaacgacaccaacttctgtacaaaagcattcgaggaatcgagggatcaagaacgcgatcgagaaacattgattcatttgtcaacgatacatatataagcctgcaaattaacttcaaatactcacgaattatatatacctgcagtaatcacaagagtggcaacgatcaggagaagaaagtacagcaacatcttcagtttattcgttcctggctcagcggccattttgctattccaacctgccctttttttttctagcaatacacacacacgtaggcaaaatcaacaagaagagatcgagagatgctaagcttcctgcaatataaacgtacagatatgaatcatggactcttatatatatataggtgcatctcatatagatacagttgtctgaagatgtgatcagaggaaaaaggatatgagatgatgcatgaatgcatggaaatgtggcatcaatcggcgacagagaaggccgatgcatagtgcacgatttgtacgtagtacgattctagcggattcctgaaattacgtcgcaggcgtgcagcaacagtatcctttggatgcttttggttctctgaacctttttcaccttacctttcatttagatcgatggccgaatgagaagaacagacagctggaaagtaatttctactccctccatcccataatataacaacctaggaccagctgtccaaattcgttgtactatgaaatgtctcgtccggttctaatttgttatattatggaacggatggagtagcttttgattcacagggtagtgggatatgtatagaatagttgagtaatgtctggtactctccatcgtaaaatgtaagaacttagaatcggataagaaatattttaatactataaatattaacagtagtaatactatgatgtaaatagtagtagtattaggatgtctagacacgtagtaatatgatgtattctatcttatcctagttttttatattttaagacgaacatagtatttttttataagataaaaattggttccattgtaaaaaaaatgagaaccatacaaggtctatataaaccaaccctacgaatagactaagatcatgtccttttcttcaactttctcattttctattaacgcactttttaaaactgttaaacggtacgttctttttttaaaaaaagtctatataaaatttgtttgaaaattcaaataaaaccattttcaagttatgtctctataatctatttctttgatatgatcgtttttattctatattaacttaaaaaaaaacaactctccatctttgctagatctcaagtgttcgaaaaattgtaaaattgcaatcacctaaaaaatatatcaaattttcatgtataaatccagaaaaaatagagaaatgatcacacttaaatacaaattagtagtaattgatcaagtaaattgcatcagcgatacacgaacttatcaggtaggtgcaatttagtacataaacttgtaaaacacttattttgatatatgaatttgtctggtacgtgcaaaccaaaaccaaaatggcacgacaaggctgattcttcaaagttgaacattacaaattattacatgacatgcgtggtgcacgtatggtagaatggttatatttataaatttgttttctactttatcttactttgtttctattccttgcatcgttactcgattttttatctctttcttcatgcaatcaatataccttattatatgttttgctaaatagatctttatctacgtgatattttcgtgagacacatgtttacatagcattcaaatcaataacaaaaacagtaaaattaaccttgccgtacgattttggtcttgttcacacgcaccaaacaagttcatgcaacagattacactcacttgacaagttcgtgtaccactgatgtaatttttcccccataaatttgataaaatctaacgaattttgattaagaaaaaagttgaaggatttataatatgaaacggagggagtactaagtaattaaacgtagcgacgaaattttgcatgataaaattaacgatgtcaagtactatttgcgtataatggttagccaccttgtgtgtcaagctgccataaacaccccccaatccccatcaacgatctttggaagaatccagcgtcatgtatataataaaaaaagattggaatatatatatggtggtttggacgacaaattgaaacgctgagatacaacacaacgatatgtttcatagatcttgcagtactgtgtatacacatgcccagctcggacccaagagaatctatcaagcacgtcttccctgcacatataatgccgtgagagtgtggctccactgttttcctttttcgatcatatacatgacatacatctagctaaagtgcgccttcgttctaatttaacaaacgtttatataagacgaaccttacttaatttaaaagcagtctctcacgtgcacacatatgtaaattaatatggacatagatttaactatgatgaatgattaatacagttatttacataccaagctcgtcagttccattccagtgaacattctgggttggatcttggaattaaactttcatgtacgagctgatacggccatatgggtgtactattatgtgcttcaatatacaatattttttacattaattatatctagaagtggtcataataggagcaaaacgttaaatgattttgcttcccgatcgatcttgaggatcgacaaagtcaccacactatcggtggatatgttacctatcattgaaaaaaatatatattgtaaccataaatacgagcacatatttaaagtttagaacttaaacctggataggtaagtttgaacatagagaagataagcaattaaaagctacgctcattttgcttacaccctaaatttaatgatggccgccaaacactccagctttttatctagctagattctgagaagctatagttatgaaattcagaaaataaactagaagttaaaagccagtatttttagactctaaagcaatcagatgtttatcagaattttaagcttccctagacaaataagctatatacatgttggtgactcgtcaaacaacaaatcaacaatcgcaaggctccaagcgtgagctggctgttgtactcctatagtccattataattatacatactgcagctgcaccgtgtgttgattgttgatcatgtgggtccacgccgtcacagagaaaagctgtagaacgttgcagatgttttttggcaacactagtcatacacgtcgtcgcagtgttgttgactctagctataggccggagtactcctcatctgcaagcatatggcgcgaagatcgcgaccaaagcgcgccctcatctgcagcgtatctttgcatgccgctgttcatcaacagcaaacacacaacacacgctgttcgttttttcacttcttaaaatttccacgtactttctaccgtgcatcgatcgatccgtgtcaagtcaagtgaaacaaaaccagggctccctgctgcaacgtgatgaggccggccctagctcagcaggggcggcacagttctggcatcgacaagaagaaaccaacaatgggaaagctccaaagaccaaagctagctgctatagcttgcttgatccaatcggcagggacgacgacgaccatgactcggatgcctgtaacacaggggtggcgatctagcatgaaaattaaggacgggatttcaagcctgtattgcccacgcgagaatcatgagagtccccgtgaagttctcactaaatcttttcttttccttgctatacgcagatgaaaacacgggctatagttttatctaatttatttagatatattgttatttctggttagatctgtcattggtcgtatggtagaggtgctcaggtaaataggctatagacgcagtgacgagccgagcaacagtgtagcagcagctagccaggcaactggggccgacctaccttgcaggcgagcgagcagcggcgatggccagcgacgacatacgtgcttggccggcttctgcaacgacgacggtcgcggggagcaataattgtggggagaggcaggcataagactgtacgagcagagagagagagagagacccggagatctgagcaaatgccgggtgtggcgttcgaattactacagtaatatgcatatgtgtcattgacatgctttagtcctatacgtaagtgacacctaccaagtactatatatacagtacaatataggatttatatcaattacacacgaaacatatattttcttcgtctcgaaaataaacaaactttataagagcggtgacacatatgtacatgaaacttaaccttttttttaaaaaaaaaatatacatgcaactttgctagctttgtctcgatgcgtcgacggcccttgattccctgaccaatcgtgctgtgcagctggatgcaatgcctgccttttacggcatgtacaacaataggaataagtttactttttgatccgctagagtcatcgaaatctaatccgtagccctaaatcacaaaaccagatatctcgacccccaactcttaaaatcggtgcaatttgactccctcggcggttttgaagggcggtttcgctgacgtggcacctacgtggcagtattgactcggtattcttttcacgtggcgttgacgtggcgctcaggtagcattagaaataaaaaaatgtgtagggcctatttgtcatccaccaaaaaaacgggtgggacccactaacatgtgggacccacataaaccactcctcatccttctctttctcttcagcgagcggcgcccgagggacggggcctagcggcggcagcagccggcgggcagcggcgggcgacggcggcaggcgacagcatgggcgaggccaggctgctgctcgccatcatcggcttcttggtccttcccgtcatctggagcatcccggagacgctgatcacggcggagctgggcgccatgttcccggagaacggcgggtacatcgtgtgggtggcgtcggcgctcggcccgtactgggggttccagcaggggtggatgaagtggctgagcggcgtcatcgacaacgtcctctaccccgtcctcttcttggactacctcaagtccggcgtcccggcgctcggcagaggcgcgacgagggcgttcgctgtcgttggcctgatggccgtgctgacattgctgagttatcgggggctcaccgtcgtcggatgggtggcgatctgcctgggcgtcttctccctcctcccttttttcgtcatggggctcattgctctccccaggctccggccggcgaggtggcttgtgatcgacctccacaatgtcgattggaatctgtacctgaacaccctgttctggaacctcaactactgggattcgatcagcacgttggccggcgaggtgaagaatcccggcaagacgctgcccaaggcgctgttctaagcggtcatcttcgtggtggtcgcttacctgtaccctctcctcgccgggacaggagccgtctcgctcgacagggggcagtggacagacggctacttagcggacatcgcgaagctgctcggcgacacgtggctgatgtggtgggtgcagtcggcggcggcgctgtcgaacatgggcatgttcgtggcggagatgagcaacgattcgtaccagctgctgggcatggcggagcatggcacgctccctcgcctgcccgccctctcgccgccgccgccgcagcctgcttctcccgcccgccgccgttcccgtcgtactcccactgccacgagcctccgccgccctcgcccgcccgccctcccaccgccgccgccgtcgctcgccgaagattgagagagagagggagggaggatgaggagtggtttatgtgggcgccacatatcagtgggtcccacccatacttttggtggatgacaaatgggtcccacacatatttcttatttctaatgccacctgagcgccacgtcaacaccacgtgaaaagaagaccgagtcaatactgccacataggcgctatgtcagcgaaacctccctctaaaaccgccgagggagtcaaattacaccggtttttaagagttgggggttcgagatatccgattttgtggtttagggtaagggattagatttcgatgacttttgaaggtcacaaagtgaacttattccacaacaataaggccagatcgtccagctgttaatctgttagacaggccgatagacttatacggcccatcaaccaaactgttcgaagcccatataagcctactagcccatttaggcttctcagctaatgggcccaatcctaaccttacaccgccgccgcccacttcgatccatgccgccgcccgccgccgccgccgcgttgctgcgccgcgtcggacttggcctcggcgccggcgccggcgtcggcgtacgcggcctggccacgctgcccgatgccgcgcagccgcagcacccgacctccaaggacgcctacttcgcggcggtgcaccacctctccaccgtcgtgcgccgcgacttctacctggagcgcaccctcaaccgcctccgcctcccgtccccgttcccgccggacctcgcgctccgcgtcatccgcgccgccgcccccgcggagccgctccacgccgcgcgcttcctcgcctggctccgcgccaagccctccttcgccgcctccgccgaccacttcgacgcgctgctcctcccgctcgcccgcgcccgcctcttcacccacctctggtccctcgccgccgacatgcgcgccctcggcctcccgctctccccctccaccttctccgccgtcatctcctcctacggccaatcccgcctcaccgaccaggccgtcgaggtgttcaaccgcctcccgcgattcggctgcccgcagaccacccaggtctacaacgccctcctcgacgcgctctgcgccaacggcagcttcgccggcgcgtacaagctgctccgccgcatggcgcgcaagggcgtggcccccgaccgcgccaccttcagcaccctcgtcgacgcctggtgcgccgcggggaagctccgggaggcgcaggcgttcctcgacgacatggcggagcgcgggttccacccgccggtgcgcgggagggatctcctcgtcgacggcctcgtccgcgccggtcgcctcgaggaggccaaggccttcgcgctccggatgaccaaggagggcgtcctccccgatgtggccacattcaactcgctcgccgaggcgctttgcagctctggagatgtggaattcgccgtggcgcttctcgccgatgcatccagccgcggcctgtgcccggacatctccacctacaaggtgatgataccagctgtggccaaggctggccgaattgatgaggcatttcggttgttctatgcagctcttgaggatggccaccggccattccccagcctgtatgcagcgattatcaaggcgctctgtaaggcggggcgattcgccgatgctttcgcatttttcggtgatatgaagtcgaaggggcacccgccaaatcgtcctgtgtatgtgatgcttgttaaaatgtgtgtgagaggcggtcggttcgtggaggctgcaaactaccttgttgagatgagtgaagctggattcgctcctcgtgctccgacctttaattctgtagttgacgggttgcggcattgtgggaagcatgatctagctcagaggatggagcagcttgagatgtcgatgaatgggaattgaatggattatgaactgtatccagttctctttttccattgggccttgcaaatggcatggcagtgctcctggatttccaggtatgattggaatattgtatttcctcttcttttgattgtatgtcttgccataagaaatgctgttggagcatgtctaatatgcctgtgatgtgctgatgtgtttgctatattttgtagtaaggccacggttaacctcactaatctgttagaaattgtgtagtgaaggcaaacaggatgacagatttgtggttgcatgcacaatagattttaaatttcttatgtcctgacacctgaggatgttcagcagcatactggaacaagttcttttgctatttacttaaacaccagttcttggcttcttgaaaattcatgtgtcttgaaactgggaacaagtcaccacatattatattagagaacccagcttaatgttgtcaaaaccccatatgcatttttttatactaattgagatgcaatgtactcctatgttttgcatagtatttaaggtagacagactagataagaatggtaatatacttcagtgatgagttgcaatgccaccactaaaaataagctccatatttagaaattctttaaattctgcgtgttgccataagtgaatcctatgccgttggatcatgcctaatatgcctgtgatgtgtttgcaatatttggtactaaggccacacttggcttcagctaatctgttaaagtcgtgtagtgaaggcaaacagaatgaataatctaaggtttgtggtcatgcccacagtgggatttaaaattttcatgtccttaggatgttcagcagcgcagtggaagtgtggaactagtgcttttcctattcaagttaacaccagttctggacttgtcgaaaattattagagaacctgggaacaggtcaccttgtattattattagagaacccagtttaatccagatgcatttttatatctaattaagattcaatgtactatatagtatttaaggtagacagacttgagaaggatatggtgttgtatttcactgttgagttgcaatgcctctactaaaaataagctccatatttagaattcttggttgctttaatttcccttattgctgaatacatgatattgtagaaggtctcatgccgtaattggttcatgcatctcttgcactgcatcatcagcactctttgttggaactgagaatgaaattgcccactataaatcaacatagtccatgaaatggtgttttcttttgaaatcattacagatgttgtgttctttgtacaatattgtgcatagctcctaaattctgctaaactttctattatgttgttggcaggatctcaggttggcttgatgaggactccataattatctgcaattgatggggatgtttgaatgttgcactttgctcgtgccgtttagaatattcttacatttggatgttctagagctaaacataatcacgagaattgtgatgcttctatggaattgatcctgcatccaataggataacactgtaaatgaatcgatcagactggcagcaagtcatagaaaagggtgaattccttattgtaccaaaattttcatttggttgctgttgtcttgtgcattaatgtaattttcacaatcttgtaaggaagtgaggtgagtgtggactatgaggaattgttgatgtaaacagcgaagcataatccttgtgaactgtgattatcattggttgcactaaatagcagatttaggcatgccttcaaaactgggaagtagagtgggctaaagtaggcactaggcagtactggaatgtggatactggatgtctggatgttgaagaaggtgcaatcagaacccaatatgtaaatgatgcagtgaagagtgatgctgacgatcttgttttgttccctttttctttttctcttttcttttttactttcagttattctttatgcttggtaatcaggtcttaaaggtaccctactatttcttactaccaaatgttagagaaactgattttgcatgtatactaatcagctcaactttggagttaccactatacctcttacactgtggttcatcatattctaatcttagctgcaatctaattgccttaatgcttatcataaggcaacattacattgactcctttggaactgttccttacaaaaattcttgcaaaaaatacttcacatttactcctttcgaaattgttccttatcgaaactcttgcaaagtttagtatgaccttaactgaggcacctacaaaccgggcacccgatttttttaaaaaaaatagggcgctatttcaccaagtagatcgaatatgtttcactaaatagatcaaaaatgtttcagtctccctagtcaaaaaaaatatatttcaatctttcaaaaagttgaaacgcaaccaaatcacttcatgaaacatcttgctacaacgtatgaaatgttgtttcaccttatataaaaacaatgttttagcaaatagcgaaagaatgtttcaattcttaaaaaaagtgaaaacatacgatttgaagccattccaacacttaaattccgtgtacatcaacaaccaacgtgtccatcaagatgaaattattaaacaatatcaaaatccattacatgattcatacacagtgaaatatcataagtacactagctgaaacactattggtgaaaaaaaaatataaaacaaatccttttaatagggcattttcgttatattcggacggttgttacaatggggcgcgcgtggtgggggcagcgcgcgggagccgcggcgtgggggcaccccattttttttttttttgcgtgcatcaggcgcccgacgttgaggattttccgaccctaaccaacacatttcagctcatattttcagcggctgctcagttaatcaaaaatatttgatgcgatatttaaagaagtgattaatcggaaacaatttattaattgatgctttgcttgattacttgagtcagatccagaagcatccatccatccatcatccatccgggccgttcgctttccgtttttattttcctcctcggaacactctagaagcccaccacctgattctctcacatccatttaaaccctccccctcctcctcctcatcatcgcctcgtgctcctctcgaaccttccaaagtccaaaccctagtggtgacctcgcctcggcctcgaaaccctagccgcagatctcgcctctccttgccccgcgccatggacgacgacttcgagatgccgccgcccggcgccgacgacgacttgatgatgggggaggacgggatgggcgacttcggcggcgccgacgggccgccgctgaaggtcggagaggagaaggagatcgggaagcagggtctcaggaagaagctgctcaaggagggcgaggggtgggagacccccgaggtcggcgacgaggtcgaaggtattgcgtggttcctcgcctcctcctcctcctcaaatcgtggagttgatccaaccagtgccttgcgtgttggggtttagaactttagatgtgttcgttgtgggatgcagagttagttttggactttggcgtgccatgcgttggggtttatgggatatttggatgcggaattagtgctaaatttaggtggaatttggtgttatcttcactgcttggtcttatgatgatgtcgatttcgagttagattgggacatctgcttagtgtttataatctgatcatgtgttttggttttgctagctttgcaacagtgcgagtttatatttaggtgaaatttggtgccatcttcaccacttgtctgatcgatctcatgttcatttcgagctagattggaacattaatctagtttactgtttaatctgattacgcattttgcttttgctagttacacttacactgcgacattattgtgagtttatgttggcagagagagtataaattctgttgcaattgcttgtttgcttgtacggttgtgtgaccttacagtttcggggagatggtttctgaaggagggatgattgtggcatacctacaatgttaatgttgttgctgatgtatggttttttttagggaaaaactaaatgcctgtattatttgctgtttaacaactttattgttccatgatgatagcggattgatttatagatcagatttaccctgtcattagtgtttatcttagaatttgtgtaactgaatcggactgaacctttcttctatgtttcagtacactacactggcacactgcttgatggaaagaagtttgattcaagccgtgaccgtgggacacccttcaagtttaagttgggacaaggtacaattccttctccattctgccttcttactttttgatggcacatctcatagccaatgtgatcgcaacttgtgccaatcaccattttgtgcaaatttttgggcatggtttcagtcatctattcatatttctgtttacatgctactagttttgatgtttactaatcttttgatatgttattcttctcaaatagaaatgactgtattacagatacctctgagataagggctcttaatacctagttcgtttttcactgggaagtaaaaccgtgattgtttccagtcccggagcatgtttaatggccctgtggctgatatcacccagtgatgctcaactgtaacactgcactgatcactttagtctgtcaattgctggtgctattacaattttggggatcagctttttcattaggtagagaatgtagcagcagtggtgtttaacttgttgaccttactagaggttgaatggactgtttctgtttaaaaaattgctctaaattaagtaagagaccaatattgttttattctcagtatagacccacataccatttcacaagcttttttttctctgctatgtgcttgtgatggtgggattgcaaaatctatttttctgttaaatgctcaccagctatttcttgaacttgtatccaggtcaagtgataaaaggttgggatctaggtatcaagaccatgaagaaaggcgaaaatgctgttttcaccattcctcctgatttggcctatggtgaatctggttcacctccaactattccagccagtgccacactgcagtttgatgttgagttgctttcttggacaagtgtcaaggacatttgccaagatggtggtatattcaagaagatactgaaggagggagaaaaatgggagaacccaaaagatcttgatgaagtatttggtaatatttgctcattgaaacatattgctatcttatatattgccctgtagctgaccctttgcattgctgtagtgaaatatgaggctcggcttgaggatggcactgttatatcaaagtctgagggcgctgaatttactgttaaagatggtgattacccataatctccttgtcaacatttcctgttcattattgagcaatcagctgcttgctaacgaaataaagtttggttccaggtttcttctgccctgcgctggcgaaagctgtcaaaaccatgaaaaaagcagagaaagtgctccttacagttaagccacaatgtaagcttctttggtttcacaccttttccatggttttccatctcttccttcgagttgattgaaaagatttaaaactttgtaatggcagatggatttggtgagaatggtagaccagcagctggtgaggaaggtgctgtgccaccaaatgccactcttcttgttaatcttgagttggtttcatggaaaacagtcacagaaataggtgatgataagaaaatcttgaagaaagttctgacggagggtacagggtatgagcggcccaatgaaggtgcagttgttaaaggtatgccaaagcgtgatgcttactgatcttactattttctttcctatatgtcagatagaggtcaacagtgtctgattactacctgtaatgacaaagttgcatttactgtttgacagtcaaaataactggaaaacttcaggatggtacaatatttacaaagaaggggcatgatgaaccagagccatttgaattcaagactgatgaaggtgctttgtcaacttcctctatgctggccatacacttttaagttcaaacaaataatgttcttactctgataagtagtaacaacttgttcccttttgatttactttccttccagaggaggtcattgatggtattgaccgtgctgtgctaaacatgaagaatggcgaggttgctcttgtaacaattcctcctgaatacgcatttggttctactgagtcaaagcaggatctcgctgtagttccaccaaacagcactgtgatttatgaggttgagcttgtatcattcgtgaaggtgtgcttctctttatgctatatatttgtttgcatttcttttagttgctatgatgagtgcacaggaaaaccaattattattcatggtacacaggataaagaatcttgggacttgaacaataccgagaagattgagactgctggggcaaagaaagaagaggggaatgcattgttcaagctgggcaaatatgtcagggcttcaaagcgttatgagaaggtatggcatgcttcttttgttgaacacttgttcaaataactaatctttcgtcaagattttctttgttttcataatcccttactgactgatgatctatctattttattccaggctgcaaaattcattgagtatgacagctcatttagcgaagatgagaagaaacaatccaagcaactgaaggttacctgcaacttgaacaatgctgcctgcaagctgaagctgaaagattacaagcaagctgagaagctttgcaccaaggtacattcagttcttcctgcaaaagacccatttgttatgtgttttggtaaaccaaggtaacattctggtgtttgttgccaggttctggaacttgacagccaaaatgtcaaggctttatacaggagggcccaagcttacatgcaacttgctgacctagagttagcagaggtggatattaagaaggcacttgaaattgatcctgataacaggcaagttttgtatatgcgtctccccaagggaggcatactagttttagtagtcactccattttgaaactgatcttgtcactgcttatcttcagggatgtgaagttgacatacaagaacctcaaggaaaaggtcaaggagtacaacaagaaggatgccaaattctacagcaatatgttcgccaagatgaccaagcagccagccgaagacggcgtaagcagctcgtcccatcttaattgcgaaactctgaagctctatacttttcacaaccctcaagtctggtctaattcggttttcttctgattcgcagaaagctggatctggagctgaatcgaagcaaggatcggaacctgttactgctgcctaaggacaggacactcacgacatatcttagattttgtgtgctggctaatctttgttctagtggtgcactgatgagaaacgttacttcccaagttgtcgggcgatgatgattcttgttgagattttcaaattgcaatccatatttgaaccaatctcgtcaagtttctagtgtctttctggatgaatgttacaaccatacgccatgtcgggtccagtttgccacgaaagatcaagagagcattagctgagatgtgaactagaagtgcagatgtctaatgcgagatatcaatgcagttgcgcaacattagatcaccaaagacagcttacgtataaactgacactgctttaatacttgcatgaaatgcagaggcagaatagcatgtagcgtgcataaacaaaatgcaattcttcttagtccacgagcaaaatgggtaaaaaaaaaacgaaacaagaatgtggcacactaaagatttatattcatatataacatcatcgatcgatcagctcatggaggggcagcaaatgaagggcacccactgctgcttcttccccttaggcttcttctccaccggtaacctcgccggagagttccaatcctgctgctgccctgaaaccgccgctttgggagagcctggcttcgccggagagccgccgtctttcgacacccgccgccggaacgacagcacgcgatccttggtgctcggcttcttcgactccttggtttctgcggccttctcggagaggagggacttcagtgagacgtggttcttgtctgaattcacgatcacttccttgtcggcgatctcctccttgtcctcctccttaggatcgtcgaccaccgtgccgaccgtctccaactcctcctccttcggcttcgtttcttcagcgtcatctgtgctgggtggcgcgtcggttttgccaggaggaggatctgcagcggtttctgcgtcctgttccttgtctccagcaccgtctatgatctgcggcgagttgctttcgctcggatcatctcctttgagatcatcatccgtgctgacggtcgcctcatgcttctgttcttcagcatcatctgcgctccgtggcacatcaattttgccagcagcgagatctgcagcgaccttcgcatcctgtttcttgctttcagcaccgtctgtgatatgtagcgtgctgctctcatgagaagtagggtctgttgcgatatcttcactctgcacttcctcttcaacattgtctgcaggttctgaagtaagatctttgttcatcttcttttcgacattatcggtggtgtgtactaatattacactttcctcatgagtattcgtgcctgaagttacttcatcaccgtggttctgttcttcaacgccgccactagtgcttaccatatcagttttgttggatgtagggtctgacacagtctcctcagtcttctccttaacactgaattcgccatgcggcacagtaatctcatcggaactagggccaacagagagttcttcactctgcttctggtcatcattagtggtgctcgatatcgtgttgatatgagaagtgggcgctacagcgatttcttccttctgcttcatttcttcaacattttccatggcattcactgcattggcctcataagcagtatggtatgtgctagtttctacatcaagcttgcttaattcaaggctacttggcaagtttgccacatcaatctcaactgaagggtctgcaatggtttctctattgctctgcttttcttcaacattttctaggctgcttgccacatttatctcatctgcagtttccacattaacatcagtcagttttgtttcttcaacgcccctgctgcttatctcatggatcttgttacaggaagaattgctatcgaattcttcaatctgttccttttcttcaacattacatgtgctctgtacagcagtgatattgtgagaactagcttctgcaataatttcttcattctgcgtatcttcttcaaaatcacgagtaccacgcactgtattaggctcttgataatcattatatgcagcaatatcttcaatatgtggaatttcctcaacatctatgccatgcacctcatttacctcatcggaagtaaggtttacatttggatttctttcatcaataccatctttactacttactttatcgatctcatgagaagtagaggatgtgctaacctctgctagatcaacttgaggtggcatgggagtgatatcaattgtttgcctgacactatcctgtatgtcatcgcccactgtcaaatgaggtgaacaaacattctttgaaaggttaacagcagtaatatcttcatcagcatgtccaactgcacttgacaaagttttgatgcccacatctgaaaaatgatcatgaaatttcaggacgtaaacaaggaacatatgggacatacaataactgcgaggtacagatggacatgttcccagagatctcaaatttaaggcagaagaagttgttaattctacctaacatagacaacttttacataagaaagggggcaccatgattgcctatatataccaaggcaccatgagctggcatgccataaaattcaagaaatgattttggtaatctggataataagagtgtgacattggccatgttggtgtatttaggctaagcattttcacaactgttaccgctatgagcataacgagtaacataaagactgtctgatagccaaaatagactaaatcaactaaataaaagaatctccgcaaacatagaacaaaaggacagcagtcaaaactcaaatcctcacctgcatcagtacaatgaagtccttcatcaatatccatctccttggggattaccaactgatctggcgtcagagaggcacaatcagcttgatgccggggtttgtcaatgcctgatgcctctgaatggctaccaccactagcaagttggaataaatcattactactagtttcgtctaggcatacatgcttctcaatacaagacatcttatcctcaagtaaattgacaggttccttggttgaactagaaacatggtccactgagttagtaaacataacttcactttgctccatggatgacacagtttctttgcaggggatttgctctttagaaaccacattagaatcattgactaatcgatcttcctccactgcctttggtctctccacacaggacaaatcatcctcattgtttccaatagtaaacataacttcactttgctccatggatgacacagtttcttcgcaggggatttgctctttggaaaccacattagaatcattgactgatcgatcttcctccactgcctttggtctctccacaccggagaaatcatcctcattgtttccaataccatctttacttaatccagtaactgtttctagagacatcacacttaacttattgatttcatctgcagagaactctgagctcaatcttgcaccatctccatgctcaggcaccagacaagaagtgctacccatacactgatcagaactaacagctgactcagagtgatgcccatcttcaagatgtggtacattttcggttaaccgcgtaacgactccactctgaatctcatcattctcagttccactggccttagagtcgtttccggaaggagggatgtggtcaccaatgacgacacaatcttccgtgcatttactgaggccgacttgaacctcactaacatgaggaggagaagaagaacgctctgaaagaagacaaccaacccaatgagcacatgtatatgccgtgagagttgtactatagtgcccaatgtatacaaagaagttatacgcacttgcgaaagcaaaacgcattcaagaatgcgtaggggagtacgtatgtagcacaatgaatgtttacattgatgcaggactttatgcgagtgaagttaagctaccagcacggaatggggacaattttgcaagatggtgaaaatcctacgactagtactactaaagtatacagaactacactaagcaacaagaaacaagctgaaccagcctcactgattaaactgattaatgaagtactattccgccaagatcaatgcacagttcgggagttaaatatataaaaaaacactaagccatgccaaatcatcactaatccaacagaacattagcctaaccctgaagatgacaagaacaccccacatgctctgaacatttgcatatggtaataaaaaatttcaccacagacctcaattccagcctcagcaacaacagtacaatttcactgattgatggaagttgttgtcaataaaaacataattgggaatcaaacaacaaacccttcacaaat

SEQ ID NO: 17398 - DNA, 691 bp, Oryza sativa
cggtgcgcacgccattgattcgcgctggggtgcgcgttcgggtactggtacccgcacaggtggcacaccatgtggttccctcctcctcctcatccgctcgccccctcccctcctcctcctcctcgtgcagcgcgcacaaaccaaacacacaaccaccacgccattagagacaaacagacacatccccagagagagagagagagagagagagagagagagagagagagagagagattgaaccaaaacttcacaatgcggacagcacgggatgctcaccggcggcggcggcgcctctgctcttgtgggcgccgctctccatgggcggcgagagctcgaagcttttctcagtggtcggcaatggcgagagcgaggagagagtgaggagttcgctttggtgaagacgacacgagaggagccccggcactgcgttaactccatccacccccgtgccggagaaagtgacacgtggggcccacggggcccaccataagtgggccccattcgtcagcgggaaagttaccgaggagggggggataaggcccccacggccccaccaccacctcgcttttggtcattttcgtgatgctgcggtctgcgtggagtgagatctgggccgtcggttggttggttgatcgatcgatggacggagatgcgggcgtcaaaaaggcggtaacaaaccaaccaaccaagt

SEQ ID NO: 17399 - DNA, 1826 bp, Oryza sativa
  unsure (1)..(1826): unsure at all n locations
gaggataactatcatcatagacaaaatgcaacagtggtaatacatggttccatccatccagctagctgaaaaaaaaaaatttttttggggggccccaaggcctttcccatttaacaattanatcagaaaagaagaagaagagggtgctttgtaatatctgcaccatatctttatacacaaattaactattttaatttgttacggttatatcaaaatataatcatctcaaatagtaggtaccaaaagaatcacatcgccctacaggcagactatgattaagaaatatcctctcttaagagcctaatgatgactgttagcttcaagagttcagagagcttcactagctttgccaatgggagttttgcacttgggtctcttccctatgtacagattgtcattcttttccttgatcagtgtggcctaagcaggttagaactccattttcatgtggcctgcttgctgctgacctgtggcgattcaatgattcgcgagtcgtcagtgaaatgttattagccaaggtatgcaaaattgagcagagaattatcagttagttttaccaccatggaagtttggtgctgaaaccccattctcctggctctgtccattctcaatatggaaaacactttggagatcatcctcccagaagttcctttgctgagagaagtacaccagctatattgttaggatgctatttctaatgattcttggttaagttacttggatgataagtagtttaggcgcgaataatcacctgcaagtttgcgccggctgttccatcttgaaaagcatactgtgcagcatttgtagcctgagatagagccaggtccaactgattcagggtgcactggctttccatgctgttttgagcaaactgttggaaaacatctccttgttcggcaaaccgaaaagcagaattggagctttctaatgagaaaaccgagctcgctgaagggccgcatgcttggaacatctgaattgtatcatggaaaatgtgagtaattaacaagtcattgagcgcatcacgaaggtatgacaagcaggagatgattcaagctcacatctttctgcagcagagtaggcaggttactgaaatcaagtggattcacagttgctagcttcatggacaggaactgaagcgaaaaaagtaaatacagcaaaattggtcagaatttcgagttccgcattccatggcatgtaacaatttcagcacgcatgtttatgactattacctcaacttgccgttgaagcgattgcacgtagtttatgatctcatcaagcatgagtgccttgccaattacctgcaattcaagacaacatttaggcgcgtcaaaactacaaaacttctacaaactttgctggcaaacacttgctccttttcttctacagattctcatcctgaaatcactagttagtcgatataccttgttgcatcctggaaccaggtcctggagaaccttcatcctctggctgatcctctctcttctgacctaaccaaatgtaacaaacacacaattcagcacaaaccgcggaagaattcgatcgaaccgggtcgaaaatcgagcgaattcgacagcatcatgaacagaattgtaccctctcagcgaggctgtggctgtcagtggcttggcctcgcctcgcccggacatggacatagtccttgggtggctccaccggcttggcattcttccccttcccttgcttctgcccgccaccgccgccgtcctcgacggagctgtcgctcccggcctgctccgccttcggcttcaccgagctctccttctcgccattgcccgtcttgcacctcttgccatctgattccttctctt

SEQ ID NO: 17400 - DNA, 2670 bp, Oryza sativa
  unsure (1)..(2670): unsure at all n locations
acaccgccgccgccgttgttgaagctggacagccgcgcggcgcgctccgcgaaccccgggtcgccgcagagcttgtcgaggccgcagtcgccgccgccgccgccgcctcccggcgccacgatggcgtccagcaccggcacgccgaagtcgagccggggggaggagctgagaggctggaaatgtagtcgcccccgaccctgccgccgtccatcgccgccgccgtccaagaaacggcacggtgccccttctcttggctcctgtaggggggagagcttggggtggtcggcaatggcggaggaggaggtcaaagaggcggaggcggtgaaggtggaggttcagcctttttgggttagaggggagaagaagctgtttttccagactgcggacactgcccccggtgccttttaaggtcgggggtgggtctcttccgcttccgctgccacttccacttccacttctacccaccgtaagaacaggtacaatagcggctataagccaactataaacatattttaaagaaataaagaaaaagagagaagagcagcgggctacagatttgtagccagctgcagcatggactctaagacgtaacgtgtgtatgataggtgggaccagatattaataatatagtaagcaactattgtatgaattggctattacaatgactctagatgatttggagctagtagttagctatactattaaacttgctctaacgggtggtggtaaattccggcgcacggtgaccgagctctaacgtctggtggagatggagggatcaggctcctctaccgtcaaaggtaggtgcctttatcaccgatatgtcgcatgtaagtgacaaaggcacgatgcctttgaaggcaaaggatttcaatccgagatggaggggattaggatgggaggcaaaaagatcgtctaacttactgctctctgattttgagtagatgacatatagatgctataacttgtgggcctatatgttagtgatccatgttagagggcagtatgttagatgagtttcttctagagtgagcgtagagaaagaaatattttggcatctgacactgagtggttgatatgtggtcttcacgactagttggtgtacagtcctgtctacgttaatcagatggatctctttgtgggagtagggggacgaaaacggttagaagtgatattaatttttaagaaatgattcttgattggtcgttatttttattatatttattaaattaattgtttcagagattggactaatatggttgaaagaaatttatatgtggccaggattggaaaattccgttttaagcccaaatgatccttggtcagttgagagtttctgataccgttttcatccctagatggaagagtacgttggtaataaatcttctatctgtaggagaaaaacagagccatcgcattcgttgtgaagatacattgttctatcccaatatagattgatcatgtacaatgcaatgatgtagcgtttataagacaatgtgcagttttgcacacctttccctatattttagccctcactctcctagcttcctctttaatgctcttatggttagcgagatcgagacgaggaaatgttagctagcagtgagctcaaatagaagagaaggtgcaaccgaccgtaagctcgagtagaggaagggctaggtcaccgatgagcttgagcaacgggggttggccattgtcaagggttagcttgagcaatgaaagaagagattgtggccagcagtgtattcaaatgacaattgacttcggatgcaacgaagaaagaagagaagagagtgggagaagataataagaaagaaatatagaataagagagagaaaaagtatggcctttcgtctaacgaactagatagcacaacatcgttcctaaactacttgatggcaaaagagcaaatacacacaaacttaagttttgtttggaacaaggtatcttttaagtaatttcggaggtttgcattcctttggaattatcttttttttaatataggtttgtttggggcaaaggaaatgttgttgaattcctttgaaaatgtagcaattctgcatttttttttgggaaagaaaacatccaatgtgagccaaaggaacttttcctttgcgtcattcatggctctgcatctatctctttcctagattttttttcactcatccaaacaactcaaatttcaccattcgcttggattgaattccttagtttccactttacaccatatcctaattccgtgtttttcatttctttgttccaagtagaactttcgtgttatattatcaattttccttagaaaaccacatcatgccttcaaggttatttcaaatctctttaagaaaaaagtaaattggactaacatacacatacctcaaagtacttcaagatgtgatttgtgtattacataaaataagaaatagaattttttttagataataaaataagaaatagaatggaaatgaagaagaatggtgttgtaaaacaaccggngcagtcttaatcccccctttttccaaaaaaaagggggccccaaaaacccccaaaaccctttcagacatccaagttaattgtattatgcacaagctacatgcccctacaagtactttcataaaggatgagccaaatctatgcttttccttccgttttgnatttattagttattgc

SEQ ID NO: 17401 - DNA, 17567 bp, Oryza sativa
  unsure (1)..(17567): unsure at all n locations
attcctgcagccccgatattacaattacctttgttccagcagaaatgcagcgttttggcttcagcgaacctcagcctagtttataatgttctgaaaagaataagttagaaggaaaatcaaattgtccaagttgcaatgataagggatcacattttaccacgacattgttctctacgggcacaatcattttacttcagatatgttcttgttcccccaaatcatttcacacctgcaagatcatgactaaactattttcaagtggctttgagcatctaatttcctctctagaaaacaaatgtgaactgcgcgttcaaaccaagtttagctgtattagtttcctacgccgaaactgcaatgagtttcttgccaataatttcaaaactcacaagttgccttcatttgaatatttgtccctcaaggcaccatctatacattcttttgtcaacggaatgcagagccagagtcgaataaacaaacgaactgactatagaataaacagatctttggcccaatcaaaactgttcccaatcagagctcacattattctagttaatcactgcatctttattctaatctgcatcgggatcgctgcagcagtcacatgcatcaggacgttaaacaagtcgtcgactgtactgacaaatactaatttgcaaactgaagtagagtagtatattttgcttgtggtcacaatctcgaattcacgaactgtatatatacgactgcacgattaacaattggggaaaggaaatgtcagtcttgagcaatgtaaattcttctcttctgaagaataatgaggtgcaaaactattgcgtattccagaagaaatgtctttctgaagcaagggcagacaatggtaattcattttgtaactgtctctgcatttcgattgtaatcttggtttataaatcagtaaagcatgaatagatcctgatttcaaatgaaaatgaaactagagattggcaaatttttgtgctgatcaaaaactaaaaaagaactggattttgtcgatttcgaaaacgtgttactgatgaatatctgaacaacactatagtctacagatgatctgaagtattctgaaccgtgttctacaatatattgccaagaatctaccatcttagcttgcaaactcgcattgccagctactgctaccactgtccaaattgaagactccattttttttctcagggaaaaattaaggctatgttcgcagcaactacccgtcgaaaaactggacaagcaagtaggtgaaagtgaatttgacacggttcttgattataaattgctcaagggacaattacaaccaactgtacgatggaacatatcttctaggaatatacagtaataaatagtagtagattagggcatcttatgagctaatatagtacaagcctatgtacttgtttaatcaaggagccatagaaaaacttggcctctagttatttactcctcctgctcaatcatttgaggcaaaatggaatccatgggcgtccaagaactgcctgttcctgcagttccttccaaaaacaattttaatagttttttccaatccaatttcttggcattgcaaacaccacagatgcatggcaacacaatgtgagcatcactgacatggcaagttcatccgagatggtaagagagagtgtcggattgccacattggcgccacgtcatgcagagacggttggtttctccagtttgtgtgttgctttaacgttggtgtttgttttgtagttgttggatctgaactttgagcataaagtttggtggatctgaacatagaatagctgcagaggacttgcatttccccaatgtatattctctctcgagatgaggtcaatgattgctgccattttctacctgtctcggcttacttcttggtttccctgtcgggctcatggattaatctctgcctttctttcgctgaaaagttgacagttaaagacattaacatatcttcatatcagaaagacaattttattgataaaaacctgggtattatgtgatccaagttgcataaaactacaataattttgatacgtgacccataatctttgatattatggtcattatgatcttacagttttataaatcacacagttaaccaaattgacttaatattataaaaaaaatatagaatatttgatacaacatttatatgacgaattaaaataactaatacattttgaacacaagtttagagatcaatgaaaaattggttaacgatatgttttgtcaaatctcagggctatatgcgacactctaaagtttgggcatatttggtaggtcctaaatttaactatatgggttgggtctagagtggagttatggaactgcctaaaccacatctctagttcattttgtgagaacgctccagccaacctcgctctctttttggatggagttgaaaccatttggttggattctagctttagaagagttagagctgtaccaaacgagtccaaaactatgattttatacaacttgaaccgtttatggtgttgagagatttactctatcgaaaaaatccccgatcctatcctaatcctaatataaaatgcgagtaaatctccatcaacaaaaacaaacaaatcaaactaaagatatgctatgcatgcaccagaatacataatattcagtcatatacatccaacccttcgatctgaactatcactgtaattaatttccaaccgttctgacggacagagagctcgatcgccattgatacaccctcccgttctcgcgctcgatctcccggcgtccgtacgtaccaccgccggcagcaatggcgccaccggctcatcggccagccagctgccggacttcgccggccgcctcgccgtgctgcgagtacagtgccgcgtgcgccttcagggcaactgcgatgaacatgcagagaggtacactggtactgcgtacttcgccggcaataatctctgaaaaataaaataaaattttccattgctcgcagcttttgacttttactgttgccctgcactcgtaaagctggaaggacgataggaaaaagaattaacaaaaagtaaagcttttcctacgttctagatggtgtactagctaggaagttagtcagtcactgcaagaaatttgatggtctttttatttgaccgtaactaagatttcatgatcttggcctcggtcaatatttcctcgtttttatgagaattgaacggttttctgtgaaattcccgcgttccaaactttctgatagtctcatacagtttaatttgtggtcctccatctgtttcaaaatataaggcgtattttgtttcattagaagaatggtttgacctacaattgctctattacgatactataatttatgtgatacaaaagtataataataagtaatccgttacgaatctaataaattcaagtacttgaaaggagtgtttatggataggttgtccctgaaaagggagattttttcagacaatgccctgaaaaaaggaagaagagacagggaaagagagcattatgctgttaagctgttgcccagaaaacattatgctgctaagctgttgccaccaccactgcaggaattcagaggacactgcaatgttaggcatcagcacaggctttgcacactctcctttattccaaagggagaacaaaaaaaaagttggcctacttattacttgaaaccttatgccaaactgctgttctgcatttgctgcagtagtagttgtagtgcttcatcctgaactgtcaactgaagctttggaacaaagaacaacaacagcattggccagtgtggccttggattggattgctgaaagctaaagcgttggattattacctgcctgtgcaatccaaggaagagagaatcggaggaaagattagctttggtgtcgagctgtggaagaagatcacctttgtgacagagagagagagtgatggtactgtagctttgatgctgtagcggccgtggaactcccgtcagaaagctgtcattctactcgacctaacatgatgttttctttgcaaagagtgaacacgaaaggtgccctttattggattctctctgaactttgatttattattattattatttgttcaaaggtagtagcttctgttttttttttaacttttcctactgaatttgatcgttgacacgagctgaattgctgacaagtcctttctgtcacctgctagtgacagaaccgtaggtaagaacaatatcacgattcacacaggaagtatgccttttgagactatcgtgcgagttgtaggtatgagattattcagtttcaaagctaattatgctagtacgatgtactgaatttggaggagcaaggaagaatgatggagagatgtacagtagtaaactgaagagaggtgaagcaaaacaaacctgcacctgtttcttacacacaccacaaaaatgagaacatttgtaaagatctaccagttatgtttgccatcctgagaatgacctaaaagatggagaaaatttatagagtaactgaaatccaagataacctgcaaacagcacttctttgcaagtttcctctgatactgaatcccatggcctcttaaagctcaaatccatgtaagtagccgtcagtaagcaacagactgtctactactggtatctaaaatcctaagcagataggctggttatggatgactaatgggcttgtctttcttaataagtatcactaccgtcattagagttccaagatgttcttttgagtcatccaagcccatatatagatagttctccgaaaacccatttgggtaactgaccatttccaagttagtttcacatatgttgctgccttttgacgtggtacacaggcaaaactcaataggatactgcctgaaatttgttgtatccagttgtaagcctttatgtaaatgtcagaaaaaaggttgcatggatgtagatgccaggtaaaaaatacctttctctaaaaaaaataaatgtcagaagttatatgttactaggctattatattttcagcttattcaccggattattaaatgaatcgtttgctctaggcttcgttacggcttcttaaaaactatattttactgtattgtttagatcacttattttaagctatttgtaagttaatttctcaaaattttattaccaaataatcgacaacaataatctaaatagaataggaccaagaactcaaagtgagtcctgctggagttttctagtgatgtataatgggcaatccaatgatgaacgaacacgtctacctgaatcatttttcctggtttacttttgaaacgaaattgtttgaatccgttcgttccatgatattattggccggcctccatacattcatcaaaaactactagtacgagtagtttaataaaacctttaatggcttggccgtgttcttttttcaattctggattctgaagttctatttgcattcatgaaacaatcttttgttgctctttagtttcagatggctcattattttgcaacaatcgttcagtccactggcacccatcaaggtgccgcctgcggttcaactcgaattaccatcaaaactaaaagcttctcggtaatgggccatacccttcgcggaatgtccggggtccagatttatatgggccgatatatggggcacagcatctgtgagtcgaaccagactctaacggcccaaactttactggcccaacgggaccatttcactctgtattaggcctggcctattgggttccctgaattgggcctcgatcaattatcttgggccgcatttattcgatgaagcgccacgtcaatgcgagtcaaattagccacgtagacgccacctgagctaaaaccgggtcaaatactgccgagcgaccttatttgttttgcgttcaagggacgaaaatcagactagacgacaaatagagggacccaaagtgaacttattccgactcggattgcccaaacgctattcctcttgtatcttgctttgctgatgctatcggagggcgaaggttacttggttggctacggttttgagcaaggtttacaatctcgagcggtatcatcggatttcatgggatccgtcaaaaaaaccgatgaaattcgaataaatttttatcaaaaagttaaaattcagtttaattttttaaaacttgaccaatagatgactgcaaaatttgtatgcgaccaatcgggtgaatataacatggcagctgatggcccactagatagaattgtgggcttgtggcatctctattcttaattgccgtttaatagcctggacggaagtttgagccttcaaaattttctaggctccagaaacccaattggaactacgcaaatcacgttaaacagaatcaaacgcagctgactagataaccaatgcggccaggccactggcaggtgatcccgatcctacccgaacattatagccagaaacatgctgatcaggacgatacctcaacacaataaattcaacagatacaatacagcattcatccagagcaaaaacgcaaaatgcaggacatgtaggctaatgatgcgatagtaatttggccacattagagtagctgctggtagcaaaaaggttgacataatagttatctttcacagtaccacatcgattgaaaggagaatacttggaggcgcgacagtttcctacaatcaaaccagaccaaaacattatactgataaaacagcctactcgtcctcctggctacggagccttgcaagcttgttggtgaccacgatgtcgagctgcgcagcacgctcaacgatctccttgcgcttcttcgtagagacgttgtgggcaatctcggcacagtaggtcctgtttacaggagaattagctcattagcagaaagtttgtaactgcagctggtgctgacaacagaaaacagcaatgctgaacaccaccccgctgaaagtaagcttggtgaacaaagtgattacctgttgtgcatcatgagcaactccagctcagagacattgtgcaccacaaacttcttgaacttgttggggaggtagtgcctggtcttcttgtctgagccgtaaccaatgttgggcatcaaggtgcatcccttgaactttctcctgacacgggagtcaatacccttgggcctgcgccagcttggctggacaagtatgaacaagttgaagttagtctcagcaaatatgccaaatagccatagttacaaacgaggatgccatgcccactaatgaaagcaataacatgcaggaactcatatgaaggatgataacagtaaacctttaaacggtggcatcacattagcatccatgaaacaataacatagtttactattaccaggacaactggtgcaatagaagtgcatagaagtccataacagactttgcaaacaaacttcgatatacttaaacaaaaatatcacaatgaagtgttggtccaacaacaacattctcagctaagctgactagtagatagcaaaattgtcagtagtgctatacatagctcaatatctgcacacaggccttgcagttctgataatacgaatagaaggaggcagcactaggagcaatgttcacacttcacaacaaaacagtttcttgacgcaacaatcctaatttcaagtaatcacatgcaagaatgatgggagatatcttgcctttcattgcgtacaacatcatgcaaatgggtaaatttaggttaaccaaccacaattgaaagagcattcagctactgggaaaccaaccacatctagttactatacaagcgtctcttgttactggacactaaactacttcctcaatttcacaatgtaagtcattctagcattttccattttccacattcatattgatgttaatgaatctagatagatatatatgtctagattcacaaacatcaatatgaatgtgggaaatgctagaatgacttacattgtgaaacggagggagtagtagttagcaaaatagcacttgtgtgtatcaagactaagcaaatcaccacatacttcaagcaaatccaaaacacttccatagcctactaaaccaacccatgaatttgaaacaaactacacatatccacaaatcggtcaaacctgagcaacacgtatgacctaattcaaaatcaagcaggaaacccagctgatctcaccgcagctactactactaccactaatcgaaatggtccattccagaaagcacaaactcgtcatcaccttgaggcataggtagcggtcactatggggcctcttgaactgcttgaccctcttcttcacgatcttcttcgtcagcagcggcaccgccatctctgctccaccaaaaacaacaaaaacaaaaaaaacttaagagacgagatcgacgatgcagcaagcaacaaatccaaccagctgcgtgaagaaaaatcttgattcctgggcaagaactgacgctgtaccttcggatcggagagggaagcggagcgacgaatttgggggaagaagacgcggcggcggtggcggtggggaggatggcgaagggttcttatacggggggagaaaccctagcgggctcgtggccttggtcgaatcgacggctaggatctcgtgagatggaagcggacggccggatcaagttgtatgggtgggccgtcctggcattccaaactgggctggatttgctgggataaatgggccacgtgcgtggttaggcccatatgatctgaactgggctggttctgctcggataaagctgcttctgggctcgtttgatgggcctcatcccacccggccacttagatgggccaggaaattctggcccaaactatacggagattcgtgatgtccaagcagcttgtctgttcccgtttggatttttctgatttgcagaattcagtagaccgaggagaatttagtagggtgtggtccgtagatttggaaggattcttatcaaattttcggcaaaagcgtctggataagacaagccaaatgttaggtggaaaagtataattttgccattgttgtttcactttgaacaacatccattttaaacggcatgagtcaccaaactataaatcctaaatttggtttgtataattgaatcagactgtgccaatgttacagcccatgtgcagtgtgcacgctcctcacatcttggtaggagtagctaggagcgcactcagctgtcgatcgcccttttcctgcactccagtgaagggggtccaacacaactttagaagaagaaaacgaagaaggaattttcaccatctcggcacatgatagacggccgtgccgggcccgttcacttttgccgacccatcctcttatcacacacccttttctctgatccattgagtgctcatcttgcttgtgttcatgcatctacaactcctcatcctatattcctatcttgatttctgctgcatcagtgcatacacgattcggtcatttcagactgcatgtgcactcattgtactctcgctgtatttggattgctaccattgcatttttttttgtcagtgctaaaacttagttaaattttgacactactaatttttttagggtaagattatatttggtttgctatcatataaagccaacttatgaattctagttaagattgttctagatattgatgtcaaatctagcatgggcattaccaataaattggttttagtccaaactaaacacatgtactatttaaactaacaaaatattggtagggctaagttttggtagcaacccaaaatggctcttagacttatcctaatgctacaaatctaaggtatatttagattcatagtagttttcatccctaattactactgtctttatcttaaattatgaaaacctaaatgaaatactagtattttctagtagtacaatctgaccatgaggtagtactgcatttccttttcgagtgcatgctgctgtactgcatcctcatcgattcagagacacagtacacatggtagtacgaaagagaaataaaatgtgcgtgacattatcgccgttttttactgcaaccatgtgtccatctgaacattcatgctcctgcaggtacacggtatatgtacacactagctgctactactagtacagtattagtaggttattttgtgaaggagacgagacgcaatctggaccgtccgatccatggcttcatacaaaccggtcaaccgtgtacgtttggcaccgtagcagttggatcgtcgctatcatcggtgttcgtttcggcaagctgacaattcctgctgctactggtgcgaatcatcctgctcgtagcgtccctgattctcagttacaccgaaaatccatactactttaacaagactctaataatgataacagtgaatctgtcactccaactgcttccatcgtaaattttacaaaccattcgatgaacttctttatgttaaaaaccaatcaatctaaatggatagcgacgtatagaatcaaattgagacaaatattttccatagcagaacgacgggtagaacatttcaccaaaaatgcattttatccgtagtaaaacacgggctttagctagtctaccaaaattctctactaaagcatgtacatgtgtgtgtggaaatatatttaccactgcctttatcttaaaatatgctccaataactttgtctcggttcatagttgctatattagctattaataatttggataagtcagtatctagattaataattaaaagttaatacttccttttggaaagaaagttgaattcttggctatgaacttagacatggcacatgtctatattcctagtcaagattcatttgttttggaattgagggcgtgtatatctaataggacatactctctccgatctttccgtttcaggttataaaacgctttgactttaatcaaagtcaaattactttaagtttgaaaaatataataacattttcaacccaaacaaaatttattataaaaatatattcaattattgatttattaaaactaatttggtattaaaaatattactatatttgtctataaatttagtcaaacttagtttgactttgaccaaagtcaaaacatggagtaaatctgaacatagctatatccatatttatagctgaaaagtgagtactattttgggaaaaaaatacatagtactacctccgtttcaggttataggactttctagcattgtccatatttatatagatgttaataaatcgagtcacatatatatgtttagatttatttatatatatatatatatatatatatatatatatatatatatgaatgtataaaatgctagaaagacttgtaatatgaaacggatgaagtattattagtatatcttgttaattgctattgcacggacgtattactgcaaaggattaatcctcagtaaaagctggcatttacactccctcccaacggtctccagctagctgggctggtgaatagcgtaaacaaatgcaagctcacatgcacactctgttcagacattcatagttgcacagtccttgtacctactgcagtcactgttgccaacctcactgacaagaaatacaagacaaattcatgggtaattaccccccggcaacacataattatatcgcaaatacataatcaaatccagataacgcaactgcacagtgcacactcttccctgccaacgcacaggatgttaaaacactgtaccacactgatccggagatccgaaattaaataaccccaaattaccaccagatcaatggcatgtacaacaatagtaaaatcactgtactaatctagtgccgaattaacaacaagtgctgtgcaccaaccatttttttattgcaaatggaaaaatcaaagaaaaactaattataacaaaaaaaaagcaagagaaaatgaaaaaaaaaagaggaaaggaaacaagaacagtagggaaataattgttcaagaaatgattcatcatgcaaacatcaatgaacaccactaatcatggtactaggacgtaggaacgtagctgtcaataatctttatcatacaatcgccaagaaacccaccaacgccgccacggcgagcgccggcgccgacacggcggcggcggtggtcgccgcgttcttgccggcggtcggcgcgacggaggacgacgcgccgctgtcgctgccggaagagggggcggggccaccggcgacgggcgcgggcgccggctcggacgccggggaggtcgccgtggcggccttgctgccggcgaggacgagcttggccttggaggcgaggttggccgggccgaacgcgtgcttgtcgggcgcgccgccggtgacggaggagccgacctgccacacctggttcacggacttcatccccttgtggagctgcagcttgccgtagaggcggatcttgccgccgctgccctcgtcggcggcgaggtcggtggccgggaacgcgatgggcgtcgaggcgccgccgagcgcgacgtagccggtgatgttgtatgtcttcacggcgggcgccgacgaggacgagccgcccttgagcgccacgagcgcctgcgtcccggccatcccctcgccggtggggttcagcccccacgccacccacccgccggcgcccgccggcgccgccacgaacgccaccgacagggacgacttggacgcgtcgtacgtgtagtgcagcgccgcgccgaggctcggcaggtcctcgcacgccgcgtacgccctccccgccgggaacttctcgccggcgcacgccgcctccgccgcgcgcattgccgccggcgaggcgaggaggatcagcgcgagcaccgcgacgagccgatgcggatgcgccattgccgagggcgagtggatctggagctcagtggagggagaagctcaagtggttggctgatttgctttgcttggcctcttcttctcctcctccttgaagtgtgggagtgtgagggtttataaggagtggaagtggggttatgtgtgattatgagggttatcagggggttatttgttaatgttttttgaattttttgaagatggaaagggcaaatttggtccgtatttagaggggtgtgatatcatttggttggtgacaaacatgcatgagacatgaatcctgactcccgtgagtttgttgcgtgtgttatagtagccacgaggttgtggggtttgtactttgtacctctgggttttattatatttgcaaggtgtcatttgtcgttagattcaattttgtttaaacactactcctagtactttagaagtacattctcacgctataaatattaatgactagggtaagattcggttaaactttcaaaattccgacgattggtaatttttagaatgtttaatttggaaatagaagaaatggtatacatatatttgtcttaaaagcactatcatattgttagtattctaaatatgagatatcatatacttctcgctccacatatgtactagtattagtggagcccactatataccaaatcatatacggaatcaatactgctatggcaagtgtaataagtagataaggaagtagtcatgtataagaaaaaggaaacagagtcctatttagatctaaccaagagtccaagactacccgaattgtatacataattgattttcctagttttacttgatcaagagggtatttataataacagtataaatacaaaacctcacagaaggagaggagacacgaatccaacaaggagggttctagagccacctctcaatcttgccaagtttgttctcaaggaagccgatatcaattagccatcaagcacatgcctgagcttcacactggtgtactagcaaactagattaggttctactccctattatatttatgagagatattgatatataatggtaacaccggtttcggtcagtaggaataggaatattacttgtcaataggaggttggaacccgtatacttttagagttttgtttgcattcccatatcagttggtccctacgttctcaaacatcctgtatatatatatgaataccgtgatcgtggtataactcgtcgacgaatactgtaataattttttactagattatataaggttgttttaaaatagatgatcggaattttaaaaggcaaaccaaatcaatttgtccaaattttcaaatatttgccaacaaagcactattttatcataaaggtgcggtattgataaataaatcaataacaccctctctgaaacagatgaattttacaagcactaccaactactactacacacgtccaaatatagcaacttcctggatataggatatagatctggaaaattacttatacttatccacattcatctcaatataaactaacttttacgcatgaatttggatataacgtatatttagattcatatataaaagttagtatattttgtgacggagggaacatattttaggacggatggagtattttccaaataaacagtaaatcttcgtaaattccaaacaggacatgaatatttgtcaaaagagctttgaatcccaactcacaagtcatctaacttcacaaagctagtccaatattgacttgcctaactccaaatccttcaaaaccgtgtgcagagagttgacggtgggttggctgaaaaatgtaaccacacacgtaaatgatccatgttaggagcaccgccactacagagtgtaatacacatgcgaatttttttattaccaaccaatcaatggtcaatgcatcttggttaatttgttactagctggccaattttttttttgtggagatccaacagaacagaacaccaagtctgaaacattcagaattcagacgagcagctctgaatctggccatgtgtgacccatgtgagaacttgacgcgtgctcccaacggccgggtgattagtagactgaatgatcagtaaaagacttgcaagcttgctaatcttaatcagtctaaattaaccctgaagctagtatatcattcttgactaagggcacatgaaccgatgcatgttcaactctgcacaggctatgacaggcttagggttaatttgattctgaaggttgacccgtgaattacgagattgcatgacgaatgggatgacaactaggtgatgtaattacaggatacacatggaagcattcaggatggagtgattggattaatcaactacgataacatgaaacagaatgtgatagcatgaagcgtacatgtgatcgattgattggagattatgttgtctgaaatgaacccggagatctcaatgaacctgtgttactgtgtacctatagatttggcagatccagaaatcaatacataaacacatcccttcgccatctcacatgatacgaagtatgaaacgtatccaaccattttggattcatctcaacaagctgctcaaaaaaaccctgtaaaattcacactcaaaacaaatccttttgcctctttcacctctgaactctgaacatgtctgttgctaactacaatactgtgtatcatgccatcatgcaaatcaaatcatcgtactctgcgcaaattgccaagtttgcaacggcaggggtcagcaataataggcaagaaaacaaacacatcttccattttagtattaccaaatactacattggagtacttaaattaatctgaaactataaaccccgtgatcattgataaccctatctgcagtactcgccaaacggccagctaggccatcagatactaaagcttcacgcaacgccatccagaagctgcaaaaaggtgacaggctacacacttgattattgcaaggcgggttatgaacttaatcagcatgaaatggaaggagataaaaatatgatatactcgattagatgagctattatacgggaagaaaaagttcggaggtcactgtcaattcagtataagtaaagcactagtatcctaaacacatcttgtagaagcaactcaatgatcttgtagaagcattgcatgtgattgtatgaaaaatgatcaacttttggtcatcagagtggctagtgttttacagggtgtaagtgaccccatctcgcaattggagatagcttcaaagggaaaactgaacaggatatgtgccaattaagtgattaggtgcctgcatatatacgaatgaatcatttcttcaatgatttgtgtctggtatacatgccagtattgaaatgattttggattcatggacttttcagtaactatcttttcatgatactgtatctgccagggtctgttttggattgcttagcttatctgaataaattcatttcagttttcaagatggcatatattcatttgaggttaggaatgaaagaatggacgcacttctcgagtaccatgtgattttcgtagaaacttttgatatatgatttttaaaaaagaataatcagttttaaattttataatagttaattcattcgtttgtactctcgaatagtgatcacaaaatcattcagccgttcagctctttagggggggggggggggtcactcttagctactactacttgcataggagagattaggattggaaatttgagcttttcaacttagctgaatctgagtctacttctgcaaaacagtcggtaaaacctaataaaaagagatgggccagagtgtcctatgtaagttctgattctttctaaacctgaagaaagctgttgaaaagctcctcgatggacgatgccttttggtacaaattaatctcttttcagatccaagcgttcccatcctgttgggtggttaggtttcacattagtagcaagctctgcacgttcacaactcttttgtgctggtcacagcgtttctttagcatcctatctcctgtgttttcggcgtgattttcaggtttcaggttcgaacaattagctttttgataggaccactctgagactatctaagtgggcattagccgttgggaattttggtaatgacaggttacaagcatcagaattaagacatactccttccgtcccgttccatactataagttattttagttttatcctaaatcaaacttcactaagaactttaattgagtttataaaaaaacactaacaattacactaacaaataaatgcgctgttaggacacattttctagtgaatttaatgaaaccaattcgatgttatagccgatcaaaggtaaagaagtttgacttatgacaaaatcgaaaatgacttatataatatatatggaacagagggagtattagcttatcttaacttttttttatatatgctagcttatcttaagtttggtttagatagtgagggagaagaagaggaaaaagaaaatgaactgatgacatgcatagtaatggtaatgggccaacttccataaacgttggatttgggccaaatactttaggtcaactgaacgtggttgaccattgatgggatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17402 - DNA, 1421 bp, Oryza sativa
  unsure (1)..(1421): unsure at all n locations
tgtattattttcccttatatatatcacctcttatcttacatgggtaaaattagatgtgacaactacctgtgctataaaacttgccctgacgcggtttctgtaggtggggcccactgtcggtgagacaaagggtgggatttggtgggctccgtttgtctcggcacaggaggagaaaacaaaaaaaggataagtacatgttggctccctcaaaaagtataggttgaatataatttatatcgcttaacgagaatatttgatattctggttaagagatattgaatcatattcgacctatatttgagggtgtcgacgccaaatcagttaaagccacctacaaaaccaccgatgaagtcaaatcgtactggtattgtcaagatatctggtatactactccctccgtttctaaatatttgacatcgttaacttttttaaaacatgtttgaccgttcgtcttattaaaaaaattaagtaattattaattcttttcctatcattcgatttattgttaaatatacttttatgtatacatatagttttatatatttcacaaaagtttttgaataaggcgaacagtcaagcatatgctaaaaagtcaacggtgttaaatatttagaaacggagagagtacaattctggttgagggatatgaattaaattctacctataactctagggagcctaagtggacttattccaaaggaaaaaaggagtgggtttcggcccatctcaattctcaaaccgagacggggattaggatcagagtctggattccgatacggcctctccgtccccttccccctacaactaccagatcgatcaatcaatcaatcaattaatctcttgttcttcttctttggacgctcggttgaatctcagcgagaagcgatgggatccgtggtgtcctccgcctacgccgcgctgcgctcgttcgtggacgcccgcattgagaaggtggggtggtgggcgtggcccatgggcgagcggcggcgagagcgtcccaagactgacgccgagttcgccgcccggattgcttggattattgaacagtcgaatcgctgcaatcaccggggtcgccgccaccgcgaggaggaagaggaggaggaggaggagcggccggtggggtggtgggcgtggctcatgggcgagcggcggcaagatcgtccccagaccgacgccgagttggccgcccggattgctcagtcgcatcgctgcaattaccggcatcctcgctaccggatcgataaacaacaatcgccacgggatcgatgaatatcccccatcgcttatggatgttatgttagtctaagtttttttttttcattttctgaaagcctagacgagatttcattaaggggttatttgnnnnnnnnnnnnnnnnnnnnnnnnnnnnnnnnnnnnnnnnnnnnnnnnnnnnnnnnnnn

SEQ ID NO: 17403 - DNA, 647 bp, Oryza sativa
acagagtagaagaggaagacaattagttagttagatgcatcgcatgctgtcatcagcagggaagaagaaccgatcgaatcggttcgatggcgacggccaacctaacagccaaattcgcagtcgatcattgcaactcacaatgattataccttcgatccatccggtttttttgggttttttttcctctctttttgagttttttccccttcgttttcttctcttttccgatccttttgcgtggttggacacatcaagcatggccacgatggggattggtgctagctcagctcgatcccctaatgcatgccctgattgcagccacttcatccgggttcttccgaattatcctcagctggcctttttcctgtaatcaatttaatttcttcactggtccagtcttgtgattattaattaccgtttagacttgcagcaactggatttctggactagtctgaatctctccaagccgccattgctgaaatttctatgttggatttctgggtactgcgttcgttcagccagtttccaactctcccatctacttttccgcacgcacgtttttcaaactgctaaatgatgtgtttttttataaaaagtttatatacaaaagttgcttaaaaaatcgtgttgatctatttttttaaaaa

SEQ ID NO: 17404 - DNA, 7773 bp, Oryza sativa
tcctgcagcccctgtgtcctgctttgtgttttgtctcgtgattttgcattcttcgtatctaaaaacaaaatagggcaaccaaataattagaagaatttatgagcctgtttggggagtttaaaattctgagaagtaattggttgataaccagcttctgagaatctgaaaaacctgggttttctggcttatgacttttagtttattttatggattctacgattataatttcttagaatttagactaaaaattgggctgtttaagggagcttctgattctagaagaaattgctccagctagaagcttccctatagtcacacgtttgccacctcactttcactatcaagtgcgtctcacattgtttgtatttggaaatcatacgcatacaaaaatttgaaaaaactgatgtggtatattataactgaatcttgattttcaaccaaccattaattgaattcaatggttaaattattttttaccaagattttaataaagattcttttaaaagtgcattatgacattactctttcgcaaccattaatgaccaaaaagggttaacttcggataaaatttgtcaaccttttagtttaaatttgaccggttcgagtggtttctaaatttgcaagtgcaataattgagcggttatcgtcgcatttgtgaaccctgctcgccatccgggccgttggatatcaaacagccaacgatcgagggccgtcggatcggggccctacaaagcgtgcatcagatcactctccatgtgattggggaggaaacatggggacagccattggagccggcaaggacagcttgagtcttgtcacgttgcaacagctcacgacaaagtttcttcagagattgtttggccatgtttgtaaagtacaaaaaaattgttcgattgatttgcctactcttccaaccaacgaacggtcacccacaattttgtttttgatgctacgcttttgtagttttgtttatgttattttggttgtgtcaaagttgcgtatcaactaggtttcccttacatacggttattgtccggttactttgctaagcaaagcagacttaagctgtgttcttttgggttgttctcaactaatctacatcgttttctgcgagcacacttttcaaactactaaacggtatgttttttgcaaaaataaattataggaaagttgcttaaataattatattaatccattttttaagttagttttagctaatatttaattaattatgcgataataagctatttcgtttttcgtgccggagggataggctcccaacaggcacaaactagcacaaccttactcctcttttcttattataagaggattgaggagaattgtttaatcccatcaataagaggattgagcaaaatttagagaggaataattttacattaatttccatcagtcacactaatctttttctcttggggattaaccgaacaatgtctaagggtaatcctggtatctaccaaacaagtagaacttgaatttaagtgaatgatatataattaaagttatttattttgggttttgaattaacattttttttacttttttgaggagaaagatgaggaaataaaatttaatctggttaaaaaaagttataaaaaaacttggttaaaaactgagatcaatttgaagctgatcaatcacaggtgattctttgcttgcttcagaggcatgtagaacaattaatctgaggtcatataggcaatgaccttcattcctcctaatccagtcatcgtgctctgtcaatcttcttttgcatataactaatccaaagaactaatgaacttgcaagatccatggcctgcaaaacacacccttgttactacattagcaaccaatcattaaccagtaaggatgtaaacggaagataaatatcttgtcgggatattatattctattatcttaaaaaatatatcttgccggtcttttttcccttttctctagaggacaaaaaattgttcatggaaatagcagatctagtcgtaccatagttgacaatgacataagagcatacgagtgaaagactgaagataaaatttctatacattttgcttctgagcacagtttagagctgaaactctgaattccaccaagctaggaactgcgcgatcacattgcaggttaacaaatggttttgcatgtttacttctgagtgcaaaggctgacatgcatataaattgtaagttgttgggtagacacagaaaagttcaggagttttccagctagcttcataagatggtggtctagacgatatcacttcttctaattatttgatattaggtcctttcctaacgttcgcgttttttttttcacttttatctaacaagctaatgcactaatgcatgagcgccagcaattagattgatctcattgaaggcggaaagacgttgaaatcattaattagcagagctttgcagcagatactttccactgacaggaaattaggaataggcagggtttcaagaataatgtgcaaggcaaattggatcacactaaaactaaactaaaatgctaaaatcaattgatagactgttggccgtttcgatcaattggaaatccatcatagttagtttttgggcatgccctttgcaaaattaaaaatacaagcatacatttgcaggttgcaagttggccacattccaacaagaatttatgaaatgaagcagtggatggcacggcattaatatacagtacatgataataaacatgtagctatctatatattagttgaaagcaacagccactaattatatgattctgttagattgatgcagctgtgctcattccagcttccaacatcccagtgaagagtgatgggcaccggaggctcaactatatttgtttcttagcctcaagatccataatttttattttatgatactgcaattggtccttacgttttgcagaaggcattaacacattaaaaccttctcctcactaataaacaccgaatttaacctacttcatcgactaaccataatgagcacaaatctaaaacagtaatgccaatctaactagcaaatcaccaacttgaagattagcttaaacagcaaacaatatcaatatagcaatcaccaatttctatagattagtttgcttgttttgaataacacaaatggataattaataactttgacttttttcatagtcaaacttctttatgtttgaggaattttatagaaaattttaacaacatttaaaacaccgaattagcatcattaaatgtaacattgaatatataatgataatatattttctttatgtttgaaatgctgctatatttttttatacaaatctaacttaaaaaaagtttagctaaaaaaattcaaaacgatttataacaagaaacggagggagcagtaacttacttggatctatggtggtcttctctgcaaggccgttgaagtagcaggtgccaccagctttcctgaacagctgccaatacgcattgaacgcgtagctcgcgtgcgcggcgagcgtgtccggctggttgcactcgccgccggcctcgatggcggcgcacgtcccgctccgctgccggcacgcgtactccacggcggccgccaccgccgtctcgttcgccgcctcgccgccgccgccggcaagaacgcaccacacgggagtcccgtcctggtccggcgccggcggcgtgggcgccagcggcgggtacgacgccgccggccgccgcccggcgaggtccacctcgtagacccacgtcgcgttcgggtagtagagaccccagtgccgctcggtgcccggccccggcttgcggttctcgttgtagagggagaagaggaacaccggtatctcggctcccggccgcgccggcgtgccggggttcttggccatccgcgcggcgaggttgcggttgtaggtggcggcgttgtggacgttcgcgccgagctcgtccgcgtcgccggcggtcggccacccggtctccgagaccgccagcttcacgttcccgtacccgagcctcgccatggcggcgacgaccgcgtcgagcatttggtcgaacaggttggtgtatgtgaggcccgtgcccgggtcgacgtagtgggtgctcgcctcgccctggaacagggcgtagtccagcgagatggagcggtggttcgccgcccaggcgaagtacgggtaggcgtcgacgaagtagtacgagcccgtggcgttcaggaactcgagcagcggccgcacgacggcgccggcgatgtcgtcgcggaacgcgccggcggacggcgggtaggaggtaccgagcgcgtccatggcgagcgtcgtcccgaccttgacgcggccgagaccgcgcgcggagagcgcgcggcggaggttggccatcgccggcacgaggctgggccacgcggtccccgcggtggcgcggtcggagagcacctcgttcccgacgagcaggcacagcacccgcgccgccgggatgtgcggcgcgaggttgcgcgccacccactcgtccacggcggcgggcgacgccgccgcggcgagcgacgggatggcgtcgttcggcaccgtgacggacaccggcacgcccgtcccggcgagcgcgcgcaggatgtccgcgttcgcgtcgtagatcctcaccgcccccgcgcccgccgcgcggaggagctcgacggagcgcgccgccgtggggaggtcgtcggcgaccgtgccgtagttgacgccgagtccgccccaccctcgcgccactgcaatgcaaagcaacagaagccattaggcattagctcaacgccatgaaatcgtcgaggcgcgaggtgaggtgatcatcaccatggcaatggcacgacatggcgacggcgaggaggaaggcggcggcggcggcggcggcgagggaggaagaagacatctctgctttttttttttaatttattttttttcttttcttttccgtgttttgttaagttgttatgattttattggtaggttgttgatcacttcggtctgaggatttttaggaagagatagttttagataagctttgaattcaaaacgaaacaaaatttagcaaaaaaatatgggagagattcaattacaggcacgtaaccttgcaggctaatttgaatttgggcttgcagagaccggcccaatagagtgtgtgctggattttaatgcttgttcgaagctttccgattttattggagtttcacatgaatcaattcatatatcacagaatcagaaatcacatcgataaacatctccagaagtccagacactccatcgtggaatcttgttcagataatcacagtatttatgtagaaaggatagtaagatacagaaatgcaaaaataagcgtttgttactcctgcaaattgcaagtgaacagaacaatctcaagctaagctgttctttaatcagaagaacaggatatgaacaagcagagtttcaagatattttgcggcgccggtttcgctttcttacctcgctatagattctgtgaaagatcaaattacatgacccaaaaattgtagagcaatgcaggagtaacactcccagctgagaagttgtttgatgtataacactctgatcttcgatcttcgttaggcgatgcgatgggaatttagaattattttgaatgacctcatgtgtacagccagcaggaagcaaaccgaacaggcgagttccagatcacatcacaaaatctggaagtttttcgccatgtgcatcatgatgggagtaccacattattataggggaacaacgtaaggcaaggcaactacgtctgcggaatcgatcagtcgcgcttcagcccagactcggggtgattctgcagcctccaatatctctgatttccagtcaacactacccctggacaatagccagctttgatcaatgcacttagaccagtcatccattgctggtatagagtacacttggcccagatacttggcatcaggatgaggcggtttcggagagacttggctacttccatggttggatgaagaaaccgaagttttcagttccttgagatgatgagaaccagtgacgccgttattgtagcattccttgctatcttgaaatctatctgccttataagtattcgtcccaacaggtgaactaggtccactcccttgagaatagtccaatatttcaccatttgtacgaggatcagtaggagatatccttggcaacttattcattcgcatactatgctctgccactgccaacatattgtgagagtaaatggaattaaaataatatctagtggactattcaaacatactattatgtgtcaaacatcaaatgattcagttatcgataacaagaaaagaaatgctctttgggcactcataaggaagaggatcttaccaagtagagaactgttagcctcggcatctttccttttcttgacatcatcagaagtgaactcctcattaagttgacccaactgccgctgcaaaccatctatcttattcttgcttgcgccaagagaatcaagttctttgcattcctgcttacttacaacaacttttcccaccttttctttctcttcaattctgtctttagtctttctttcatttgcaagccgatccctatctttgtcttcaacatacttgtgatcattacttttcagctctttagtctttcccttccttttaactgctccagctttactgcgtactgattgccgatccattctgatctggaaatcgctattatttccattcctgatctccatcagccctctggggctcatgctgtcactatttctagaaggaaaatgggaagaaaccactggatcttggcccacttgttctgttctcagcaaggaatttggacttggtgtaactacgccatttggagccctctctgcacctgatacaaccgtggtaatagtacttgtaccttcagtatttctttgtggtcggtccattctgttatgactgtgctttctatttgtattcgagtgcttttcggcagatccaacttgaaggctcctcccattctgtaatcgaggtttagacccaaggctagcacagtcataagcaacactatatttcttctctatcatctcatgattgagatgtgtgggttgtctggatttctcaatcacactgctcaaagatcttttcttccctttagaacctgcagaaccaaagcttttggtactagggagcaacttgccagtactactgcttgtgtggtttgcatgaccttcttgatctaggatttgggtaaccaactcatttgcaggtttaatatctttgacagcttcgtgttgtattttttctttaagccttccattgtcgagatctgcattcctcagagttgctttttccaaagtttgatttgtgtatctatcatcatccttgttctttctcttatctttgtgcttctctcttttgtgcttcttgctgtgcttatctttcctacgatcgctattcttttcttttctttctcgtcctctcctttccttactttcctttttgtgcttcttctccttgtgttttccctggaaaaaacgtggtgcatattcaacattgattgacatatagcagaagaaataaacatgaaattcacatgtttaccgcaaaccattttcctagtaaccagttaatcataatttttatattaatgaaggaacctaaatcggaatgcacatagtataccaggtttggtggtggatgatatggcaatacataaatataaaacagaatttaatatttaaaccaagatccacagagggaacttactccaagtagaatgcatttcagagaaaatatacacactttagtaaaagcctaccgggctgcagga

SEQ ID NO: 17405 - DNA, 4573 bp, Oryza sativa
aaggtttatcatagtatatactagccaacatatcgacagaaagctgtgaaaacaaatgatatataaggaaacatccatgagagaatcatcactggaaacaaaggtggcacaggtattttgctcctgttggtttgtgatattaaaagaagcatagctgtgagtacacttcaactattattttagcctctggtgaaactggggagatgctacttttctgctgaatttaaattgcaatattacgttttctttttgaaaaacagttctaatgcttagtaacaagttaataatgggtcgttttggattgaagccaaaacgtgaccctaccaaaattttggtaactttaacagtaaacatgctagtttggattgaagccaaacaattggtagcgcccacgctcaatttggctacattctagaatcttcttcactctcatactaaattttggctttatattggtattaaaccaaacatagattagctaactttgccctaccaaaaaattggtagtgccaaaatttgcctagattttggtaccaattaattggtagggtagagaaccaaataggccctaagtacccagtaagtggctttacagtggaaccttttcatatgagcaaagaataaaaattgactaaatctagaaatgctaactactcatagatgcaaacatttgtcaaagcaatgttcataaaaatggcaaatctatttaacaggtaatctatggctccaacagatggagaatatgggtcgttttggattgaagccaaaacgtgaccctaccaaaattttggtaactttaatagtaaacatgctagtttagattgaagccaaacaattggtagtgcccacgctcaatttggctacattttagaatcttcttcactctcatactaaattttggctttatattggtattaagggcttgtttggtttagtaccctaccaatatattggtagtgccaaactctaggcaagctttggcactaccaatattttggtagggtagaattgtaaatgagtgtctttggattgatgccaattgagagccaaatttcaaattatggtgaagaacattctagaattgtgccaaattgagtataggcattaccaaatatttggctttaaaccaaatcatcacatttactatttaaactaccaaaacattggtatggcaacattttggtatcaaaccaaaacggccctaaaccaaacatagattagctaactttgccctacaaaaaattggtagtgccaaaatttgcctagattttggtactaccaattaattggtagggtagagaaccaaataggccctatattccctattttcttgtttaaagggaactcatacactgcctagttactctaccatgtactagcagcatttagtttgggcaagaacagggccatttctgcaagtgatttgaaaggcacaaaatcatatgcaccttctttagcagatcattatgctcactcctaggcttcgcctcatacccaggcggcgggaatgggaaacacctggacattgtgcccctcctggaagatcaatcacaaaactgaatccccagcaaagcagctcaacagattctcccaacaaatgcttgaattctttctcatgcaacatatcccctctctagcatatcatccccagcgccggcaactgcgcgaggccggtgcgccgtaaccccgatttccaaacactcagatgcacaaatcaatcctcaaaacacaaaatactacatctagacctaaacaaaaaaatctcccgattctgtgactgcttggagcgatccagctctcagaaacaccagattgctcttgattactctctaatttgaggagaatccaagtggtggcatgaacagtacgtgcaatcctcttccatctgctcactccccaccaccgatccccaaccacagccacagcagatgaaactgaaaccccggcacggcaccgccgcgatctgagtcgctgcaatctccaccggcgccgccgaccgcagcagtggcgccggagacgcagcgcatcaacaccaccgccgccgccgccgaagcttccggaaaaaaaaaagtatcgggcaccggaaaccctcacaaactgcttcctctcgatcttgaaccaaaacctactaggaagaggccccccgatctagcgaatctttggcactccacgcctccaatccgtcgtcgtggtcagtggcggattcttcgaagaactcccagaaaaatttcccaagaacgcgaactcgatcagcgggatttcgcctatctctctcggtcctgagactttcctcttcgcttcttctctcgctctctttggggattggttggttgcttcgccgcagcgaaaacctgcgagtgcgaggcggcgacgcaggaggaggaggaggaggaggtgaggtgtactacttgctacagctgctgctgctggaggaggagacgtggaggaagcggacgaacaccatgtttgggttacaggtgtcgagctaccactgcagtgattcatcatccttccgtcattcggtttgttgcatggtagactgtagactggatgttttatggagttgtattatacagtagccctctataaaaagttattttataaataaatttttagaaaaaaaaatattttacaaatagactcttttcttaggctgtgttctttccttcgagttctcaacccctctccctcgttttccgcgcgcacgcttttcaaactgctaaatggtgtgctttttgtaaaaagtttctatatgaaggttgcttaaaaaaataaatttatctatttttttaaaaaaattagctaatacttaattaattatgcaataacgtgtgtttcgttttgcgcgccgggaggaggaacgcagccttagcctctcgcagtgcaaactatgggacccatacccctaacacaaaaaattggtccaaagacagtcaccccacagtgcaagcacccatatgtatgtggcttaattgaatggagacacggatgaaggaaataaagcccacagtggggcgtgaccctagggcgagcagccggtgaagcgcaaggaaatttatttcctcacctacccctccagagcttctctcttcctcgcccttctttctcaacctcttctcctcctccgctccatctcgtcgcctacctctcctcccggggcggcgggaggcgtcccctgcggtggcggctggcgcggcggcgggaggcgtccccggctcgtgctgatgccgctcgctcgccgaaggaggttggtcaccagctacatcgggctcaccggcatgcgggcgagggagtagggcgtcggtgtccgtggcgacagcgtgaggtgtccccggcggcggctgctgctggtgcggtgtggcggcgagcagccagagcgtggggcggcttagcgttggatctggccagggtcggcgggaatggacggcgcgacgccgacgggcggccggcggcgggagcggacggcttctccacctcactgatttcccccttccttttctctaccaaatgactcagagaaattttgttgctttgcttttctctaccaaatctgtggtgggcgtttggggggattttcctacgcgtttggggggatttctgttcgtcaatgatttctttggagggcgatttggggttttctacaggtggattcggcgcgagggcatggggcagcgaagaaatgcccacagcgcgcgtgcctcccttttccccggccgctcgcgccctcgctgcaacgaagtattgcgccgcttaggtaggggacgggaaacctagcaaaggcgcggtccctccctccacgtcgaccaaaaactgagctggcgtaacgaggttccgcgccagctcagtgcaccgtgagaggccttagtgtaatgttattgacgccgagatttaatgtctcgttgatatcctcgttctcctgagatatgttattggtgtgaaaagggattgataccagtgacagatttgtttgtaaatggatctgagaatgattagaatgtaaatatttttttcttacatgaacgcagagcaatattttttttgagggattatttgtaagttttaggaaggactaaagtataaaagaacccagtcggtgtagacttgtcgctgctacggacgaatgaccgtacgatttaggacgacgacgaaggcggcgccacgcggaataagttcactttgggtctctctatttgtcgcctagtccgattttcgtctcttaaccgtaaaaccgggtacgactcatccctcaatttactaaaaccaggcaaatgagatccctcggcggttttgaatgcggttttggctgacgtggcgcttacatggcttgtctgactaggtcttcgtcccacgtagcattgacgtggcgcttacgtttcaattatatctcgaaaaaataataaaaagcgtggtcccacatgtcagctgtacacaaaaatattttataagtggtggggcccacatcaacctcacacctctcttcttccctctcccttctctctcttcttcctttcccctctctctctccttcccgggctgccgacggcgtgggtgggccgaggagcaggcgagctcc

SEQ ID NO: 17406 - DNA, 5813 bp, Oryza sativa
aaagatatgtagtttgcaactaggcttctcggatacagagaggatgcgatcaaagatgtacgagtcattttcagttaacatatgagattcatcctgcccagcaaatggttaagaaaagaaaaggtgagctttgaatgctgtttggaaggcacaggtagtggtactgtagtagcagcagtacagacagagttaaatccattaaccaattctttgatgatcaatgggtcagggagctggccacaatttcacaatctggctccatatgtacagtgccgaggtacagacaaccaatttatcacatgagatttaggatgaacagcacatgagggaaatcaatttagactggatgcagttaaaggaaaagacaagcaacaatctcagcagtacataagttgtctcctacctgtgaaaaagggtcagaaatttgcaagtggtgaggcacaaaggggaccaaagtctggatgaggtcaatatttgcctaaccttatgcttatactagtcaatgactggctaatttctccagctcaccttgtccatggggaccaagcttatgatacagtaacagccaggctagatcggtagtaccaatccggtgagcaatgcagttcaagaggtgatactagatatttattggccttattgagtagtttagttgaaatgtgataggttatagaagtaatgctgtaataaaaacaggaccctttttgacatgaagcaggtgaataacatgttcagttacttcaactaataaagtgattgtcctggagcacaatgccaaacctgaactttttttattagtatttttaaggatggcaagcatcaggtccaaattgtctccctggccagctgctgatagatattccatttttcatatgctgaaaaagatgtgcaggcaggcagattttgttcttcatcatcaccacagctcatcagactttcagagggctccatgtagtttttttgtgcataatgtattattctctgtggtcctatcttgctagccatgcccaatgcatttctcttcacacttcacaggattgcctcagcatgacatgaacacattagctaagcttatctaagatcaatggtgtgaactgtgaaggcaggagtggacaagagcaaattgggttaagcaggaatccaatgtgtacacacgttgcagcaatcttccactcacacttcccccttatgaattcagaattcacactaatgcatcagtcagaatgttaaatatagatagtgaagtcacaccaaaattggaagtttggttgaaattggaacgatgtgacgaaaaagttggaagtttatgtgtgtagaaaagttttgatgtgatggaaaagttggaagtttgaagaaaaactttggaactaaacacggccgaaatgaacatacaaaacagcttgaagctcaagaattactgtatttggtaggagatttttgatgatggacacatcatcgggagaggctttctgaacagcatgaactgggggctgcatcactgtagtcagtcactgtaccaaaatgctcaatgctcccttcaacctttcatggatgctatctaaaaagcagcagcatcgattcccaaacgattgtattccattccatcaccaactatccaattccactaccaatctctcacagatagtgccagagaaatcagaagcaagtcacacacacacagaattcacaaacactccacatgcagtaagatgctctggttcagagaacagtgcccaaaactggacaggttttataaatgcagaaagaaatcgcagcaaagtccaccgccaaaatttaaagtatatatataaatttttttatggcagcctgaagctgcttggatttacacccactacagcatcttgtgttcttgttgctggcatgatcattcaggaatcacaccaaatgagaccaaatgaacaagaacaagatggtaattaactgaaaagaataagttcagaggaaaatattctaaaccagaaggattccagtgacatcatctttcttcttctgccctggctccttcctttttttgctctgtcatcttatctatactccagtccatttctttttctctctactagccatggattttgcttaagcagcataagcaaaattcagcatggttgattgcatccatcatggagaaacaaagcagcaatcttttaaacaaattagcactgaaaaaagttgcaggacgagtgctagcctccaaggacaattgggtggacacgtcacgacgcggcggacatggccatggatttcctcttgcccttggcgatcttggccgtgtcgagcttgtagtagtggacgaaccagtcgacgaagcggcggaggccggcgtcgaggggggtcgccgggcggtagccgaagtcgcgcgcggcgtggctgacgttggcgtgggtgaacggcacgtcgccattgctgggcatggtgacgacgcgcttgttcgccttcctgccgaggagcttctcgaggatggcgaccatgcgggtgaccggcaccggcgaggtgttgccgaggttgtagacgcggagcggcgccgggccgcgcttcttgccggacttggtgccggtgctctcgccggccgtgtcgagcgcgccgaggcagcccttgacgacgtcgtcgatgtaggtgaagtcgcggcgcgcgtcggcgccgtcggcggtgcggaacagcgtgatgggctcgccagcgacgatgctgcgggcgaaggagaagtaggccatgtcggggcggccccacggcccgtacacggtgaagaagcggaggccggtgatggagaggccgtagatgtggttgtacgcgtgggcgatggcctcgccggccttcttggtcgccgcgtacagcgacgccggccggtcggtgcggtgctcctcggagaagggcgcgtcggtgttgagcccgtacaccgacgacgaggacgcccacacgatcgccggctgcgggtcggcgtgcttggcggcgacctcgaagacgctgacgaggccggcgacgttggacgcgacgtacgtctgcggcgcgcgcatcgcgtagcgcaccccggcctgcgcggcgaggtggagcacgtgcgtgaagcgcgccgcgtcgaacagccgctccagcagcgcggcgtcgttgatgtcggcgtcgagcacggcgacgccgcgcgacgccagcagtcgctgccgcgcccgcttcagggacgggtcgtagtaggagttgaagttgtcgagccccaccacgccgtccccgcgcgcccggagcgccagcgagcagtgcgcgccgacgaacccggcggcgcccgtcaccagcaccgacaagcccccgtccctcctcggcgccgcgctcctcctcacctccttctcccacgccgcgcccccatacgccaccgccgccgacgacccaagcaagctccggtgcgacgaccgcgacgccgccctgtgcttcccgttcgcggcggcggcggcggaggagaggtggaaggagtgggacagcagcgacgggtagtgcacggtgaagaggcagacgaggcagagcgtcgccaggatggttgcccggaacagcaggtgcgacgacgccgacaggagcttgccgctcgccacccggcgcaccatcagcgccccgccaccaccgccccccagcttcacccccttcgccgccgcgtccaccacgccggagtgcggcatcatctgctgctgctgctgtttgctgccaaggtgttcgaccgcgtgcgcgagagtgtgagagtgagagtggagtgaggtgagtgagaggtggtggctataataacacgcggcgtggtgggcagcgggcggaggaggcgcgggagggaccgcggatttgggtcgttttaccggcaaaacaagctgagtttgggtgcagcggcgacgcaaccgtgtgtgcgtgtgggttgggggagacgcgcagctgcggcgtgcgggcgtgtcagaaatcaccgcgtcgaggtgagagtggatttatctgggttgctttgccaggtagtggccggccaatcaactcaaagcacttgcccacacggtacgtaggagtactgtacatatacaccctctcaaaaagagggggaaaaaagcaggttggacatgagccttgtagttttgtagtccaacgcggtttcatttctgagttgatgaaaatgtagttatatctttttttttcccgtgttgggtagagttggagtgagcaagaaatggtgagaaaatttcttgttttctctgcgcatgtttccaaactcttgaaaggctgcggttttttaaaaaataatctatagtaaagttacttaaaaattgttttaatttatttttaaatttgaaacaattaactcttaattaataatatgctaatggctcatatcaatttacgtatcaacttttcgctcctctcaaactcagccttaggatggattataagtgaggtcgataacagttgtaccattttgaggaatagaaagaaaatatttatcaaaataggacaaagagactccgggtgtgtttaggcctggtttagttcccaactttttcttcaaacttccaactttttcatcacatcgaaactttcctacacacacaaacttccaacttttctgtcacatcgttccaatttcaatcaaacttctaattttgacgtgaactaaacacacccttagttcacaacaaaattggaagttttgttgaaattggaacgacacgatggaaaagttggaaacttgtgtgtagaaaaattttgatacgatggaaaagttgaaagtttgaagaaaaaaattagaactaaactcggcctccatatctcagaatgctacaagagatactatcgccgtgtttagtttcaaagtttttcttcaaacttacaacttttccatcatatcattccaattttaatcaaacttccaattttggtatgaactaaacacaacctataagagacattaacctacttgatctagcacctgaaaaaagttttttgaagaaaaaccaaataaataaacgctgaccaccgtctttattctttcgacagaataacaaaccgaggtcattgaacaagttggaaacctgaacccaaagttagcaccaccgatttgatcatcgacgacccgatagacaaacctccacaggtcttcattgatgacctcgtctacgggatagttacaaacaaagagataaaaaaaaaagcaaaatgactattggcagaccaaactccatgaacatcatggaaggcaaacatcatgtagttataacagtatcatttactcattaaacaagttgaaatataagtatttatgtgcatatatgaatatttaggtgccaaattgccagtgcaactatgagcattatgaacagcgtctagaatggagagatcaatcgagtacctgagaagcgatctcttgatctagacctaattggcttaatgaataatgacatctaggtgaataaaatagatcaaagtggaaaggtccaaactaatatgaaattttccatttggtatatagcccacgataacatggtgagcattgatggggtctaccttataattagctagcttatcctcgtctttgtgattaatcgtgctctccctccttccgattttcaatgtttgttgttatctacttttagacatatgtttaattattcgtcttattttaaaagatcatgttattattatttattatatttaatttattttactattagaaaaataaacacaacttatattttaaagagaataagatgaatggtcaaacataaattcaaaactgaacggcgtcaaacattaaaacccaaattaaagggaatatatactcagtactactccctccg

SEQ ID NO: 17407 - DNA, 1002 bp, Oryza sativa
ccaataggccaatctgacaaagttagataatcctaatgacaagccatacaggagtcaggacaagtagtagagtatcagtatatagcctaagcccctatgcaaagctttgagttcatgaagtgattataataaatcacagcgcttaattaatcacatcatggcaatgggctagcaaattagggcaagttgagccgatggactcacttgtaaatcactcctgtttagtataatcaatgcgactctgaagaaactttctgcatttctgtatcatttctttatgtcaaactgatgtgtgatttaattagtagttgctcttccaagactccaaaaattggtattctagtcctgaattcatgatcgatttgatgacaaaggtcagcaactcacatgcacgcatgtactacagcattcttcatccatccaacggttggtacgtggtatatacgtggtaatagctagctagcttcgtactaagctagcgccattactgtcgtcgccgtatgatcgatatcgatcgcaatgtgcagccacgtgcgaccccacgcgcgcggcggccgcacgccggaaacgggagacggtggttggccgccgggatatcagaccggcggcggccggccgccgccggctgaagtagtccgtgtgcatccaacacacagctagctgcacgcaactatagtcagtgtatggtctagttgagttgtgtggcaacgatgacatcagtctaagggcctgttagttccccgaaaatttttcccaaaaacatcgcatcgaatttttggccacatgtatgaagcattaaatatagataaaaaaaattaattgcacagttatgggagaaatcgcgagacgaaccttttaagcataattagtccgtgattagccataagtgctatagtaacccatatatgctaatgatggcttaattagtctcaaaagattcgtctcgcggtttccaggtgagttctgaaattagtttttttattcgtgtccgaaaactccttc

SEQ ID NO: 17408 - DNA, 2083 bp, Oryza sativa
cccaactaaacacaccctaattgagttgcgcttcagtatggactaggttgttgtcctaaccctggtattttctgataaagtcggagtcgcccaagtattggtgtgatgacgataacattgcgtctttgccagtgtatgggagccctgttttcttttagcttgttgtacatgaatggcttttgttgagtacgtagagctcggttgtcctgctctcgtttttttggtagcttagtttagttggtggaatgtcgtaatagttgtggtttttacctagttttctctaattaatggtgcattgtacggtttggtcccgttctctccttaaaatgggacacttcttctatatataaaatgtcggtaacggtttgactgttagaaaaaaaagaaatccgtgtatagtcacgaaattcctaagttggtgggatcgagaaaagtgatatgctacttatgagatgtttttacatgatgggatgaaaatgtcccccgtgttttgggacggtattccggactcgaggaacactacattcgaccatgtttcttgtgactacaaaatacttagtagtattgtcgttgcgtcctcactgccaactattttctcgaatatcgttgatatttgaaaaaaaatggctgatcatcgaaaaacactatttgtagttcaggttcaacggtgttggcgtgtcgctggctctatcaccgtgcgtccatagtgcaaaggtgaatagtagtagtgcttccagtggtaactgattgtctgaattaactacagagagatattagtgtggttgatgagaccttggtataataaggcagtgatagtgaccttagtttctgagaatttatagtttagtttataatggcacggtcatgcatgcatgctgatgaagtgatgatcattgctgatcgatcgaccatggcactgaccaaattaaaaagaaggcgagaccacaacaggtagcgatatatatgatggtccataagagtcgtatcatgcaacaaattgcaatgtctgaattagttaggcagggccattattaaccaattgcatcttccttcttttgctacagcaagctgtcaagctgagcatacgtcctcctctccgcctggccaataaatccttcataatgtcaggatcagtaatcacttcaatgaccatcttgaacactgcctccagtgctcacacaaaaacttgtcacttttctgaatcattttgctgttcttgatccagggaaagtctgtagctagggacaaaatcgatattatgctatcatagatttcatcggaatgtcaactttttagcgtgtcatttacaaaataccttcataactaatattctaacatattatttttattttagagtgatattttagcgaaccagaatacattctactgaaccctctttctactatggtggtgggcttctgagaagtgatggacctacagattacagctcattccaaagtctgaagattcagagacagacatcactcgggtatcgtagagatcactcatgcacatcgcaaacgacaaggcgagatgcgcgtcgaaatcgattcaatgcactcggaggactcacctagcagcagacagcagctcaagaaataaaaaaagaaagattcagattttcagaaactgacgcgcttttcagaggcaacaaagcaaaactacacgggatgtttgtcgctgacctctgagattaccactaaactctaatactccctccgtcccataataatattaagggattttaagtttttcttataatgtttaaccgctcgtcttatttaaaattttttaaaattattatttattttatttgtgacttactttattatctacagtattttaagcacaacttttcgttttttatatttgcaaaaaaaaaattgaataaaacgagtggtcaaacgttacaataaaaaactcaaaatcctttatattgtaggactgagggagtagtaggttttttcggtacgttgatcgagctaaactaagtttgtgtttagttaattctaaagttgaaagtttgggttaaaactgatatgatgtgactaaaaagttacgtgtatgataggttgatgtgatg

SEQ ID NO: 17409 - DNA, 9933 bp, Oryza sativa
cctgcagccctgaccggatatcggaaggggttttcgaacatgaatgaaaaaactaatttcagaactcgcctggaaaccgcgagatgaatcttttgagactaattaagccgtcattagcacatgtgggttattgtagcacttatgtgctaatcacagactaattaggcttaaaagattcgtctcgcggtttcaggtaagctatgaaattagttttttcattcgtgtccaaaaacatcttccgacattcagtcaaacatccgatgtgacacataaaaattttcatttcgcgaactaagtaggaaaaatagaaaagggaaaccgtaccgttttctccccctatcctgtcgatgtatccgcgtgcgtggataaagggcgagaaaagcgaccggtcaacctccctatcgcttacactcacccggatctttcccaaaccaaccttgccaaccccagatcgagcatctgagcagccgccggcacactctgcctcctcctcctcctcccatccttcacctctcaagtttctcacaagcaaagtggaggcccacgacggagggcggccagcaatgcaaagctggcgatgggcagaggctggcgaccacccgatcttctcttgatatgggcagcggtggaggaggagggcgcatgcggctagtgaccgcggcatcaagcgatccctagccaccatcgatccagcagcaagcttgaagaaggaggtcaaggtggagttggaaattctcatatccgattttagttggattagagtccgattcatttagtcatttagtttcttttttccagatggaaatttggatatggtcttctcctatgtatccttgtgctgattttttattgggtggattagagtttgattcctttcagtttcgtgtttaactcgggaaatttagaatttggaaactacctagatacgggctacatgcgcgaggctgagatgacgcaccgtgatggatggagttgggaagcgcgttttgtgcaaccggttgcaaacccaactcatatctacaccgttcaatgttcattgagattcgtgcggagaatcttaatcttaactaattaaaagattattagtaattttaccagatagttaaatgcccgtgcttcggtacggtgtattaaaactaaaaatatttaagttcaaaaaaaaactaaaaatatttgtttttaaccaaagttatttttaaccgaagtctccaatgacagagagtaatatagtagctcataataaattattatttaatagtgcgttgcaatgggaaaaaaatactgttatgataatgattacagttattttatagttccatgggagttataagatatagttctagacataaacaataccccttctctcccaacgtaagcgacagtagctgcgccttttcccaccgcaggtcgtaaaataatatgatatggttggatttaatttttattaaattaaccatgattaataacgctctttgaaacttttttggaattttcggagcttcattgctaattttgacaatacaaacatcatttcagcatttatttaaataaaaatgtaaataaaaaccccaatttctctatgggccatttttagtctttttactgtctcatcccgtaaataaagtctaatttacctcctttaactccttctctgattgcgcaaacttgcaggtctatttggaggcccaatagtccgacggcccgagcgggagaacccggaaccatccgatcgaatggacggttcagattgatccaaacctacataaatatctgtagccaaaccctaaccctagattttatttccctccccacctccccactcgccccgatcccctctctccctcgaatcgaaaagcgatggcggccttacccccgtagtagcggcgacctcccccaccgagcagcgttggcggcgccctccccccacgagcggctactgtggcgcccttccccctctccccgcgagcggcggcggcggccgctccctccacgctgtctcgcctccctcgccggcagccgctccctctacactgtctcgccactctcgcccccttctcctctccctcggtggatacggcggcggttgcggcgggttgatggtggccgcgggcggatcggcggcggcttcctccacccccgtttgccttcctcccacggcaaaggcggcggcggccgcggtcggatccggcaacggcgactccctccgacggctgtggtggcgtcggcggcggttgcgacggccgaggacggctatggcaacggcggagggtggctgtggcgatggctggtggcggatccggcggcttcttcttttttatgtatatttttgtgaagttttgtgacgtattttgtgatttggtgattattgtggttgttttttttgggcaaagagtggttgagttttggttgtgtcgattttgggatgtgtttcctgtatccgactcagagctattgatttggaggctgcgaagacgccccgccaacggacgaaagcgccttcgtgatgaacagaaaatacgataagataagatttgcttccttttttctgtgcagtagttttttactttgtgggagcctacataataaaataatagaaaaagaacaggaatataatgggtcggtttccatgttctgaaaagaaccggtctgttgtaaaaaaagaactggtcggttttaattttcccggtgaagaaaaaccactccttggttcgattagatcagatcgatcccctttctactttacagtccttttccccgccttgcttccgcttcacacgattgccaccgccgcctgctttctcgacgtcttcgcatgtgggagccgccgctcctaatgcgccatcctccaggaatcattgcctggctccctcgacaccccaacatccaggagctcgccgttgagggccgccacgtcctcatggcctccgccccatcggaggcggagccctgccgccgcctcctcgccggaggcccaccgaaccccctccacctcctcacgaaccaaccgccgcctacgacctgtcccatctatggggagatgaattaaacccgcctccgtgaaatcaggtcagatatcaccaattgctccgtgacttgttcgattgcttgtagtaactctttcgtgtatttatggggttaattttattcgattttgagttcaaatcgaatccgcatccaacttcctttcctgttgaatctggtatcctccctgcctgtctttgttcaattttgtttttgtttgcctctattaaaaatcgatttgttcaattttgttttttttttggattatttgtatttgatgcggactcctacaagtcgtgcagaaagcatgcgcactgaatcggtcaaaattttggaggacggacgaaaatttctgtgtgacgaacgggaaaatttgttatttacgcgaaggattttgaatctgtctctgttttttttttgtttggcgacgcaatgaacacatgtgtgcgggacggaggatgccactcggatttacggacgataatttttgggtgacgattggaaaaatatcaatcttttaataattattattaattattattattattagttaagattaagatttctcgtccgtcaatccgtttcgtccgtgcgattcttccaatcgtcaatgtctgattttgtcgttggcgtgtaattttccgatcatcacagtataaaggaggggagcgccagaccaccacacatcgctcccccgttcaccaagaccaccaccaccttatccctttcgcacgaccgcatctcccgcacacgcgcagtgatccggccgcttcccccgttgccgctctcttgtactaccagtacctgttgcctcgcctagctagctgctggcctggccggcgtcgcgtgccttcatggcctcgctcctacccagtccggtgttccccaccgccgccgccgccgcggcgtccacatcctcgtcctcgaggtgccggtgccggtgccgcatcacaacgtcatcttcggcgcacggttggtccaactgtcagggctggagactccatcaccgggtttgggccgcccaggctgctgatcagcaaggaggggtgcagcagcagcaacaacaagaagaaaatgaagacggtgtagtcgacagcaacgtgctcccctactgtagcatcaaccggaaggagaagaagactattggggagatggagcaggagtttctccaggcgctgcaggcccgtgccctgccctgcccttccctcttgttgaatccggctacctcctaccttacatacactatacttacaagtcaattgagtcacaatttaattcgattagattcctctttttccttctctttaggccttttattacgacaagaaggccgtaatgtcgaatgaggagttcgataacctcaaggaggagcttatgtgggaaggaagcagcgttgtgatgctaagtaagtggtataaaatattccttttcttctagcttgtacgagatcccggcccttactgtacactataagtgtgcatgccgctgaaaagaaaaagattattgttggaaattcagagataatcctatctatatccctgtagctagtttatttagctgctatcattttctggctgtctggttgcgcatgtcgtgtcatgcgccgtgatcggggcgtgtgggatggcacacactgagaaccgatcatggtgcactaaggtgtggatcgtggcgatttgcccatccgcatatatcgcaatggaagagaaacataaaatggccatcttatcgcagcacaaataccttgtgttctggatatactagttcatatcgtcttgtgttcgatatacgacagtgagtttgtgatagcgttcgctggattggtgccgttatattatgtccacccaatgcaagtaacattggaagctcaattcttaagacaacatatatccatcattaagtgaatgcgagacatccctgctaattttcaggaaaaagagaaaatgattgtaagcattcttatcaacactgcacactttatattttgagtttctccaataacattaaaacgataggagagacaggaaaatggatgaactgcaaacagaggaatgtttgtgtccaatttatataaaaaaaatactaggagaggtttttttttaattcagtcatgctaatgttgtcatgttaatgcttaatcgttgctttttatttaatattttttttcgtcaggccctgatgagcaaagacttttggaagcatccatggcttatgtggctggcaaccccattatgacagatgctgaatttgatgaactaaagctgagattaagggttggtctttcttgtccctagtaaccttatacttgctaaaatgtgtaatattaagtgctgtaaaaaatgaatgctattctaccttattatttaatatcagcgatagatttggggctccgctaattgtacttctcagtgctgtagcatggtaatgatgctaaagttgccttataaaaaacatgagttataaggctcagcattttgagttaaacggtaaattttagtaatttctatcatgatatttggttgtcagttagcttcagtgtaaaaatgagatttaaagatgaaaccatacatataaaagacatacattgtagcagtaatgtaaatccgagactgaacttacctgtcaatctgttattatttttttctcttggccagaaagagggaagtgaaatcgtacaagaaggtccaagatgcagtcttcgaagtcgaaaggttgggattgacttatttgttttattatactaattcatttttttttgtaaactgcagtttagttattacactaatctattgaacataacagatatggggaatttacaatagtaaagcttcagtttagcagccctaaaaagtagttagccaaatagcagtccattgttgtggaataaaaactgttgaacatgaaaagtacggtaagcaatttccattttgataagcatgctgcaatcatctggttaacaaaaagtattgtgtttaaattatgcctcttcgaagaactcggccccaaagggaaatacctccccagggtagtataattaagaagtatatgaaaccggggccaagaaaggtcacgaaagccaatcctcccgatgataaatcctaagctccattcgagacactcatggctatgattgacccgatctttcggtgagttgaatataactacgatttgggagaaacgttgacgaccccctacaaccgtacgagacattgttgtgttgcgccttagcgatcgatacatctctccgtgggttgttgatctagctggtgtagatcaaccttaatcctgcaagtagatcgaagaaacaagcaagaacaagctaaaagcaatctaaattgcaaataagaattgaatacaaatgataagttggggtttcgtaatgagcaaatcagcgatttaaccgatcacgggattacacagcaaagtagcgaaactaaactttaatataaacaaaaccctataaaccctgaaggggtacctagctatttaaggcggtgggttgacgacctaggggcccctagggtcgtgttccacctggttggggtccaccccacatgggcctcacttgggccagggtcccaaacaaagttacaagcccaaaggcccatgacaagtggcgcaataccttatttctctatttgccgatgacttgctaggaatttggagatgaggttggatctgttggaaagaggattccaaatgctttccatcaagtactcatggacccaaaacagagcttgtatgcacatttggcggtagtttgaagtcagcactgtagcaggtggccgaattagattccagaacttggtcaacttgatcttgatgtgagcgacggttgtattaatagtaaccatggtcacatctccctacatggggagcttcccctgtgtagatatctataagaatatttccagcaacatgctatgatctagtgtcaaaaaccatgtcatgtcaaaattaaaacaagaatagtttagcttagagaactattttgtagagacatgaccttattcacatcatcactattttgggtgctaatgtgatgctgtttagttaatctatcctggagtaacaaatttgttattttcgcaggtctacagtgacttgactgtcgattacttcaagatgttcctgctaaatgttccagcagcagttttagctctgacactgtgagaatcatatgacatgatgtcagagatacattttttttttgcattacgccatgtttaatatattttttcttgactagatttatggtcatttttcacttcgatgaagaatcattattgtttttggcagttttgtttatgtgtactaaatactgtgtttatatctaatctagatttcgtcttcacagattcttcttcctggatgatttgacaggttttgagatcacatatcttcttgaggttagttctaacaaattcaagataatataccaattgagatccatacagtactgctcactgacatgtgggcccgagggtttgtggggccctttttcataataaaacttcttccttcccataataagttcatttttgcctcccatttgtcctaaaataagttcacttttaagcaatcattgtatcgtaatttgtgaaagtagggtataattgcactgggatttggtaaagtgagagtattataatcttttttggttttgtatttgtatgtgtgggatgggtaaaaaatgaacttattttaggatggagggagtagctaagtcaccaatatataatgtttctttagttctttacatgtataaaattctgaggatgttatatatatgacatcctcaggattttatacatgtaaagaattaaacatacattatagtcctataatttgttcactcacttgaatagattttgaaaagtcagaattaggtgcgacctttatacctctattttaccgtaatcaatgggccaggtggcagttaaagacgacgatttggctgcccggcttggtttgctgcatggacctaagtgcgcactaagacatgtgcatgatggggggggggggggtaattccagctaggaagtgagagttaggagtgatatgatggagggagtgaggggtcagaatttgtaatttgcataggagacaggaggggagggctgagggcaggcttgtttgggcccatctttccatagaagtaatgggtggtggatacatggttttcaatttcatcgtctcactcaagcacctgaattttgggaaagattgagcaccctctaaccactaccacatgcaccgcatgctttgctgcctctgcccctctgcatattgcatgcatactccatcctctctcccacttacccctcctctaaccacttcattagcaaattttaaatgtttttttctcctaaattacttatgcaatctacggtccaatttacatagttatatttgttgtaattaaatttttacaacaagatctcacatatgatttaatttttgatgaaaaaatagaaaatattatattccttattgaaatatttttatataatatatgaaacatcgagttgtaattgttgaaacatcacaaaatatttactgaaacatccaaaaaacaccatgtgcaacatttacaaatgaactagtgaaacattagaaaatactcattgaaacatccaaataacatcatgtgcaacataaaacagattcgttgcaacataaagacttaaaatgtgcaatacagttgaattcaaattgaaacattcacttgtacatgaaacatcaaattacaatggttgaaacatacatatatttttttcatcataatacaatcatgtacggtcttgttgtcgtgatttaattgcgatgaatacaacggtctaattggattgtagattagattattagtaatttaggagaaaaaaatatttgaaggttgcaaagggagcttcatgcatgtacagagagaggtcggtgcaggctgtgcacactgcacagggagagagagagtccatcagggtgaccaagcacaagcatttttgacatcaaagttatggtcggtggcctcatctaactttatttcaacagtacacaatttcataaatgagtagaagtagagcagaaatcacaaattattgtcacttacatcagaggtttgaggagatgattgccccttagggatgatagttgatagaatatatgaagtgttcatagattatatggtcctacaatacatgggccttgatataacatattagtccaacaacacaaggtcacggttcacaaccagttgggacatagatgtaggcatgctgcatcgaacattatgttcgctacctcttattagtgacaagaataattgatggcgtatccgcatccgatgtaatattcatatctgatgctaattagagtacactgtattcatatccgatgtagtatctgacagtggtatggcactgtttgaaagcatccatgcaatgtgggccctcatacagtagaacgtgcatcatcaccagtaagggtaatatggaaagtatgggaatatagtgaggcacctatgggaggtagaaaagtaaaaataaaaaataaatggtttataatatagcagaaattgtgttggtctttttttcatgaacatcatttaccctctacataagcagagtaaatatctttaactgttctttgccaacctgctaatgtcattatgcttcttccatattttccaacaagctataagaaatatgttcacgaaacatcttccttgtaattggagtttggcttgttcaaataacgccattgttttaactgttgggcttcaattgatgatgccatacctgatatatgctttccatgccatgtatggatttttccagaaaataaatattatagcagtgccacgataaccatctaatagtaacctacaatgttgtttttgaatagggctgcaggaat

SEQ ID NO: 17410 - DNA, 416 bp, Oryza sativa
tcctgcagcccaattaaattaaaaggaaaatgcattagaaaatccggccagcaaattaaaccatgttcaaaagtctccaaagcaccatcagttcatccgttcacaccctttccaaactggtcattcccaactcatcagaagttgaatactgggccaaagtacaacgtacatagtatgcattgcatgttaagaagacaagtacttttctgaaagataagaaaacggcaattatttagtactagatactcccgccgtttctaagggtgtgttagttcacgccaaaattgaaagtttggttgaaattgaaacgatttgacgaaaaagttgaaagtttatgtgtgtaggaaaattttgatgtgatggaaaagttggaagtttaaaactaaacacagtgaaaatatttgacgccgttgact

SEQ ID NO: 17411 - DNA, 1180 bp, Oryza sativa
aactgttttcgactggggcggacggaggacttgggtggtatccggaaaaggctagtaccgtccccggtcaattaaggaccgagccatgaagttaagcatgaaacgacccccgtacaaccgcacttctcatataggtatagacctagcggaatagatagctgagcggaggcagtatccatgcatagtggtttcttgatgtgtgaggcaggggctctacggtggggcagccattggtagaaccgcgaggcgggtgtctacagtggtgtcgccatcggtaggactgccatgagaaaaattaaacataattataacttaatgcatgtgtgagtctttccttcccgggtgcgccagaactcttctcactgctagaaaccgtgtacgcctagagtgcatgaggatgtaaagttcatggagcgggtactgccaatgcgaggttatcggaaagctttgccgtgacacgtctcatgtgttgagacgaggctcatgtgttgggcagtcgcggagtgcgggtaaagtatacatccactgcagagtgagtaaaccaaatctattcgaatagccgtgctcgcggttattgagcaccgggacatgtattacacttggctagactctaaattcttaacttgtgtgggatgggatattgcatgataatttctatactgatggagccacttcctgagaggcgggaatgtggacgtcctcagaaaaccatgacgactcaatggcaggaagctatccttaggatcacaatggatggtggacagaaccgtcattgtttaatatgaacactggtactaaaatttgatcagtctgtgctaggtcttagggttgtgaaaagaattataaaacttgctttgcgcaaaagaaccatagccatcctttaaatacccctgtcatgtgcattgttgctgtggtggcttgctgagtacggttggtactcacccttgcaaatataaacttaatcagaggccggagatgaaacttccgaggatccctatgcctattaccaggagggtgatgaagacgatggcgctcagtaggtcttagttacggtcgctgcctgtggcaatggcgtgccgctgccttaactccgctgccttacctacttctgtttttggaatgtattccggacagctcggtccgatgatttaagactatgcctgcgggcttatgatgtaat

SEQ ID NO: 17412 - DNA, 1932 bp, Oryza sativa
tgggttggtcatatacaggttgaaccattggcccactccacccaatttatttgcagtgacccattaagtaagttacccatctggtgtgctaattcttgctttaagctttgctcgatctagttttgatcagtttgaattgtaaatggacacccccttttaggagagacctagcggtgggagaagacaatagggctaccaccttaaaattgtttaaccaagttaggggacccataggagaaaagtgtacacataatcaagggttaatgatattaccaagacttggtatggttagccagctgtggtgaaggttgcagtagtacccgctagagacgaggaagagattgtaatagttgggacaagctcaaggttgtgatctagttgttgtagaggaggaataaggaaggcaccacgagacaaaaggagataatggtgacataggaaaaccagtagcgctgataaaattacgagaagggtgattacagtagattttgggggaaagaagaaattgtggttactttaaaaagggttttatgaatcttgatgcgatcctaatatatattcaaagtacatgttaagaaaggacttgagaagttgcacggcaaaatgtttaaacgatcaacttaaactgtttctacaatcaattaacagtagaggatttgaaattaccaccaaagttttacagtttggtgaagagagcttgggttctagttttctactactactagttcaattcggatcaaaagtccttcccgagttaaattgtttggcagggatggctggttggtcgttcttggtgaaaacgatcctcttctaaagaaaatgttggatacgatacttccgccaaattaaaagaaatgaacctgcttgttcttgggagtggtagaaacaaaccaatctccacgaccacgacatgaacggtaaatatttaagaagtgaaaacgatcctctcctaaagaaaacgttgtatacacgacttcttccgagaagaaacgaaaccgtgttcttggcagagggtggtagaaactaaccagcctccgtccgcgaccatgacaggaacggtaaaaactggacagacgacgtcacgagaaatgacggctcgccccggggctattggtgtcgtttcttctcgtagccaaattacccccgtacctgcttgcggcaacatattgctctctgtgatcactctcagtccctcgtcttcggaagagattctccggaaaatcactcgccgccacaccgatcgatctcacccctatttacgtgtctatctagctatggttgtgtacaccacgtcaacttcacttcctacatgcaaagatcaaaggcgctactagcctacaagaagcttattgaattggagacaactcttgattctctctgtgtatgaggagtacttaatctaaatgaatttggataaaagtagtttagattcgttgtattagtaaagatcacattcctttatagattgagtgttttttttttggacggaggaagtatcacgcattgcgtgcgtgcatagcttctgcatggaaatttggagaaaacagaggtggtggcacggacaaagcgcgcagacaaggatgaacacagtgtccctttcagctggcgagggaccggccgatcgatcaattggatatgcgctcagatatgttacggcttttgacacattcagctcatcttttcgtaatctcacttacatatgcatgctatctaatactagttggctggctccatctttatcctaaactgatgatacggtatataattcctgacatcatctgcttacctccaagaaaacaacgggggcacttggttattgcgtagatatatttctgttgcgtcccgtgtttgcaagcaaggttgcagctatccgtacaccagtacattgccacagcttgcgagaacgtacgtaagcatgcatataccctgcgg

SEQ ID NO: 17413 - DNA, 3995 bp, Oryza sativa
aaaatgtttgacactgttgactttttagcacacgtttgaccgttcgttttattaaaaaaatatatgaaatatataaaactatatgtgtacatgaaagtatatttaacaatgaatcatgatatgaaaagaataaataattaattaaattttttgaataagacgaatggtcaaacacgtactaaaaagttaacggtgtcaaacattttgaaacggaagaagtactagttttttccccttgatttggaaattaaaggtcagcgatcgcttgctacccagtacccacagtcgtctcctgttctaattgggcatgcggtttggttagcgtacgtgtgcgtgttcacagtggacctgaagagttctcatctccgtcgctcccattttcaacttcgccggagagcgacacactgtacgtgtcacggttactacttaatagcggacgatacatattttccatgataattaatctacgaggggcatgcatgggctaatacaatatggtgtgtggtacaggatcggttgcgtggtacagttatagatgcatcacatgaattaattcagctcgaataggggtatgtagccgcgtacctttgtacagacaaggcggttgctatgcgcatcggagtaaatacttactcccctccgtttcagccggtacgtactgtatttgtcattgactatcatgtgtgcacacattgactacagaagaccacaaaagttgatataaaatgactacatgaacctgccttcttaatatctttcaaaatgacacaccgaatagtaatactatagaactatttattttgttccaaaatatatgagattttagatggacgtgatatatcctagtaatcaatcttgacagagagtttatccgtattcattgtgctgggatgtatcatatccatccaaaatctcttatattctagacggaaggagtactaaaccattctacagtgttaaatcggcgcaagcatccagtcgctagctgagctaatgagcaccgaggggcgaaagagagagggagccagagctcgcacgggccagccccaaatccccaatagtatatctgggatctcactggcgatggatatactgctgcagctcgccgacccagaaattttcattatactgtagcacgaaatctccatttgccccatgcactcggtcgcctcagacccaccacatcccctttccctgtttccccgtcaaactaatgtccgcagtcactgctccgtgctcactcgcatgtgcccgtgtatgcacgcacgccaccacgctgcatggcggcaggcgcgcgggcacacagttgtaatgtgtggcacacctagccatggactactagaacacgcagcttgctgcatcgtcgacagtgagagagaggccatgggatgacgtcgacgtcggcacacacgctgttgcgatgtgcgagccggcatggcgcgcggcatccgcatgaagcctacttacgtaccgcatgtcgtgtctcccgctgcacaatctccgtggatatacgtggtggtgtgcgtgcgacgctggtgttgacgtacgatcgcgtgcactattgccccgggatcaggttgtgtagtgtagtgtacagggtgcgtgtgcgggactgatcgggacgaactattgttaaatatgtgatctgaattttaggcccacaatatatttagattagttatctaataggactctactttataggattagtttcctattaggacttctagttttctcctatatatatcccttgtaagctgcacgggagggtgcaacagcccaatgtatcccctgcgtttgtatccaattcgatcattgccggttggcgcctatagttttttcccacaaggattttccatgtaaaattcgtgtctccgttatgcatctattttcataacaggtggtatcagaactatgaaaatccgttccacaattcccccgttgtcgtgttcgtcatctatgttgagttcatcgtttcgcctgttcggcgatatcgatctaccccacggtgtcgtggtgactggtgagttttcgtccagttgaattgatctgttgctgagatcgatcttttctgctgccgcatagatctgttggctcatcaagtccgacgcggagtcggtgtttttgtgcgaggagaaaaaggcgatgcagcagccgtcgtccacgtctacgcagccgcacgcgtcgaggaagcagcagccggtgtcatcctcgagcacacacaggtggagaaaaatcagaagccaccgagagccactgcttctgttctgttcacgtgaattaattttcacgtacggttggaaatttgtgacacacggagtttaccaggaattcaagttctgtgcattgcttggttctgtcgaggtgaacccaaattcactttcaattgctacgttcacaagccagatttaccaggagtttagatacagagatcaaaatacttcattttatgcacctagagtgtttcgcgtttctgctagggtttcacaaattataccagcagattcagaattttattcccaaggcgagtttgaagtttaatctaccgctcctggattgagatgcaatattctcgttatggcaagtgaagatgcaagttggcgtagccatcgaggaggagaagcaagtattgctgtgcaccggagagaaaaaaaaaggcaacacattcaagtcgtcgagagggagccttgttcctgtctagatcacaaggtgatcaaattgtccggcgaattttgctaccattgtacccaatgtaccagaaggtttatcaggggatctaagtacttcgttttgagcacaacagtttcgcgtttctgctaggattccagaaattaatgccagcagattcaggattttattcccatggcgagtttgaagtttctgcatcagtttcgcgtctctgttgggttccacaatgtcataccagtagattcaggatttgacgcacattgattttatcatcatgaggttgtttagaggttgaagatttttatgctacaaggaaaattcgtctcaaggtggagattgttaaatatgtgatctgaattttaggcccacaatatatttggattagttatctaataggactttactttataggattagtttcctattaggactcctagttttctcctatatatatcccttgtaagccgcacggggagggtgcgacaacccaatgtatcccctgcgtttgtatccaattcctctatagtgatcattgccagtcggcgcctatggttttttcccgcaaggattttccacgtaaaattcgtgtctccgttgtgcatctattttcataacacgtgccgtcgtgccctaggcattcgcttggccaggctgccgcatcgtgctaggagcctcgccatatctatgtccttatgtatgccctactatagatggactaatatgttttatcatgatttttgagaaggcctgagcaactgcttacaactgaagggaacttaacattacgagaaacaacttattggtagctaacttttgagaatctgaaaatgtttggttttcaatttcgtagctatagtttattttctagattatataattatacatactattagaaactggttgagaatatgtattgattgtgaagatggatattataagagagcgtgcgactactataaattccttcaaatagggtctacataaactcaagagctagattcaatgatgatcagtttgccgagttgacgcttgcggtgtaatgagatattacgctagcatggcaaaacgaggaaagctttgttcgtccgatcttaactctcttcttctcctaagctatgagtttgttctcgtgggcattatcatttagagaaaatttcttatgtaacttatgtaacatcgaatttgagttttgccttatcccttatatactcttgagttttcaatttgattccctatgtatttatcccatatcttcattttccattttaaaaaaactttagttataaatgttcgagaaggaaaaaatt

SEQ ID NO: 17414 - DNA, 2786 bp, Oryza sativa
tttttttaagaaaaactcaaaggtatgtaagaaataaggtaaaactcaagagtacgaaaggaattgaataatgtctgagcgacacattcttttttctttttagttgtactcttcctagtgacaccttagaaaaaaataatttactgacacgaactagtttgttgaacaaataaatttttcgagtggctacgtaaaccattatatcggtccaacaaggttaggcaagtttaggatggctatgtaaaccatttaggatgcaaaacaaccacaagtagtgggttaccatggacagacccgaccttaatagctaaattgacaacataaatgctaatgcaaaccgcacagatactattaacatagagctttagtttttgctatgtggagttttatgtttttactgagcaaaataacggtttcctaactatgtagcattacactaaaaaaaaacatgcgcccgtcccttataagtgtcaatgtgtttccatattttgtagatataatagaaatgatctccacaattttagacaattatacttgcatgaaatggaaaaaacgtgccttttgaaaagctaaaggctgcatgcactttattacaagattaattcttggtcttgcgtcttctctgctacatatactctccccggacagctgtctgagggtgaagttaggtataagtcaggattcggcatttctacatttgcgaattcatgccgtttaatttgatacgcgtgccattttattgtgagatggagggagcatgtattagcgcaaagaactagtcaaatctcaaatgaaccagcgtggacttgccacaagtcatccgtacacaaatgtaggccaggcggggcagcatcggatcctttgctcagctagccccctctcaccaggcagcgcgggcaagggcgccgtaaaaagatgaaccctacaggtagaaaagatgtgtcagctaaggcagatactactatagcagattagcagctgttgcatcagtagcgcatctcgattcctgaggcaaaatctctggccctctgaaacggaaaagcatgcaaagacctgcatgctggcaagtgtggcaagtggcgactcacccatccagggaaatctcctcctgctgatccatgattcatcaataccgcagtgacagggagcacacacaggcacagtaggggagaggttggcaactggccagtgagcgagagctgagttgaatgcacagcggaaaggtggtcctgggctgccggtttccaaggataataaaaactacctcccccgctcgctgctacgcccacccggcgctctgtgccctcctccccgtgtttatttatacgctcccagctaccactcttcacaaagcgatagccggaggaagaagaagaagcaacagcagcagtcaagccaacccgtccggcgagcaagaagcaaccgaggcagcaaaaggaggaggagggaggactccactgttcgcttgtatcgtcttatgggggaagaggatatcagcaacgacagcaagagcagctgcggctgcgaggacggcacggtggaggctccggcggctgcggcgccgaaggagaacggccgagccgcggacccgcgcctccaggccatctccgacgccatccgcgtcgtcccgcacttccccaagccaggtccgccgcccgtactcactagctagctaagctcgatcgatcgatgtcgaaaccgttttaagaccacgccaaatcagttgaccacgtgaaaccaagtcacgcgcggctctacgttaatttgcagggatcatgttcaacgacatcacggcgctgctgctccggcccgccgcgttcaaggacgccgtggacatgttcgtcgagcgctaccgcggcatgcgcatcgcggccgtcgcaggtaaacactataaacagccgtacgtccaagcactctcccaaccaaaccggtcaaaccatgatcctttgcgcggcgcctttgccctcgcgtcgccatgtgccggcggcgcggcgcggcgccgagcctgacaccaacgccgacggcgacggccgagccgagctgtgggactgaggcggcggtgttgtgagattccgtaatatctttgggggagatctttcctgctccttttgtccccctacgctttgtcgtttgatcaggtcatcatcccagtcaccacctgcagcaattttttcccctctcacctcctcctactatttctcaatataaacaatttttgcgataattaaactccggcagcatcagcagcggccgtgcgggcgcaacagtggtggtggtagaccggtaggtgcatgcgctgctgaactgtgacaactgtcgatacacgcacgtatgtcgaacataggagtactatactagtgtatcataggagtatgtctttctcgccgtctggtccagaggggcaataaatgcaggggccaatgcctccccgggccacggctgtggatggagcagccgcaggaaaggcgccgcgccaaggcggaaaggagaatgccgatgcctccctgcaccgcacgctacgtactacgtgcgccccgggcccgggcgcatgtggggaatgtgcgtgtgcatccgtccgtccgtccgtgcgcgcgtggcgcgtagtagcccggtggtactgtatggtccacggctgcgcgctcgaggcgccgatccgcgtgcgtgcgtgcggccagaatgtacgtacgcctcgtcgcgtcgcgtcgagcgagcgctcgctggttggctggcgcggctgcggctggctggctccgccgctcgcggggctccgctggggccagcggaat

SEQ ID NO: 17415 - DNA, 22220 bp, Oryza sativa
  unsure (1)..(22220): unsure at all n locations
ctttcgctcagtgcatgtactgcacgacctcacgtttttcgttctagatgcaaaccgcccgcgagtacaatgatctgatttttttagattgggagttggagtacagagtctgattagcttttcccggccgtgtgtgtttgctcgaagcactttactttcacggcattatggcgtttgttgtgacataaacctccaataattgaatagccatcgcaacgtcatcgtatttatactggctagttgaaagtttttactcctacaaggctacaatgaacatcgaacactgtgttgcaaaagtacatatggaagttctatcagggacgtttgctagtgatggatactttaaaattgtagatttctagtagtaaatttggtgggaaaaactgtagttctacgaaaaatttgatgttaaacatataactttgggatcttacatcttaaatttatagttttgtcaaatatgtgtgttttgtgaattttactgttataaatctaatttccatgtgtatatatatatggtgaaattctccaacttatgctaggtattgaagccagaggattcatatttggcccagcgatcgcactagcaattggagcaaaattcataccgttgcgcaaacctaagaaactcccaggtgaactacggactatgtcatttcgctcatacaaggagcatacctacatcctaaaacataaggaattttacccatatagtttacatgagtaaaatcccttatattttaggatgaatgtattaatttgtttactcgcacacagtacatttgcttccactgaaaatgctgtagcaacattatatatgtactactgctactactcatagaacctgttagcacatgaaccactcatcatgtcagctactgaaatagttatagcttgagtacactcaataaatgttgtttgaggatcattgaaatggtctgatgaatagaactgtagattttattccgctttggtactggtatacagctatatactacaaactcaatatagagttgctagtagaatgtgctaacagtggcttttacaaatcttaaaggtgaggtaatttctgagacctatatacttgagtatgggacggattgtttggagatgcatgttggagctactgaacctggtgagcgcgtagtggtcgttgatgatttagttgcaaccggtggaacactttgtgctgcaataaaacttcttggtgagtaactaaccgtttgtctcctcagcatgtatgcaaatgtaattcattgactgtggacaacactaaacaagtacgtacgtaagtgttaaaaaaatactattgttattttcagtttgctatgctctataatgctacttctaggtgacttatcatatgttttaacttctcaagtctgtcgaataataaaacacacattttaagctgaaaatttggttttcctgaacagataagcaatagaggaccttgagttatttaggatatttgctgactgttgtggaaaggatattctgatattttcttgtgataataacaaacattatattctgacttaaaatgattcatattaaacgaaaatatcttaaatacatagtgccggacaaagaaagtgagagaaagtggaagaaaatggagtactgaatgtgtatatcatgtactactaatttagtaaaacatacaggacgtgaagctgaatatcatggatcatagtggagaagatcatgtaacattgtcaagcatcaaacagctcagtgataatatgtagagtagaggggcatcatgttctgttgaccttaagaaaagtatgctccccagtgagtcaacgggacaaactgtttattcatgggacaaaatcctgtccggaagatatgtcctattgggtggctaatcacctacatgcatgataagactggaggcataattttgatcttatcttacaaccgaaaagttcgtggataagaatcgagcattcaagaccctcccttttctctttttatgacactaaaacaactaactattctagtgtttacatctgtttatgcttattgctcaaactatttgcattccagaacgagctggagctgacgtagttgagtgtgcatgcctcattggccttcctaagtataaggtacactcatattttggttaagaaaattgagaatcgcatctcacttttaataccttgatcaattatttgcttactggacttgcatgttttatacagaatttctacaagctcaatggaaaaccagtttatatactggtggagtctcgcaaatagaaagtaacaaagcaatgatcaggcaagcatcacttttatgcttgaaattttctccaatatctccttttattttgataataatgtttgtaccatgttgtgcaatacagctaggctgcattattgtttgttcatggtcttttatcaatgcactgcttccatacacagtcgacatgagggtttaaaatgatgtgtactgttcttgacaagagtacacatgttgttaggtcctgacaattggtttataaaactttaaaatttctggatttttttatccgggtcagtgaaatattaatattgaaacgaggggcaaattgtgaatattgagcttctaattcatgtttccccctcctatcctttttcagaaagattcacagcttcattcctttgcaagagcacgttggaggaattggatcggtattggtgagcagtgactctgcacgcagcacaactgttaatgtaatctcggtggagagatgatgagatagatgaaatgtaatctttgtagcacgactagttttccaggtagtgtcgacgacgagagcttgtagttatttctgtcgggaactgttgattacccggaagagaaagggattaagggaattgccatcccgcttgttcagttcctcttttcttttctagtgacaattgtccttttcgccgcacttgatgatttatacttctttggtaaaactaccactcctaccgtagtattattggcattagattagctccttgtcggtgaagattattcagaactaaaagcttaagccaatcataaggccagcatgaaaaaaaagggcatgggaatttgtttaagcgtcctagtgcacggttggagtgccaggctgccagaggcaggtagagagaatgctggcgttactagattgaagcttcaaagtatgctagcgatccagcagccacttggctagaccaccgtgagttcagagttttaggtatcctcttggacactaaactaagatgccggcatgcattagacattagactattgaatcatctacaccgatagtccgatactatacattagtaagcatataaaaacggcttggatgcaacaggttggcaggaatatctgtctcctgttctacgatccccagacaagggcgttgtgagatatgggagaggagacagtcgcagggagacttgcctgcatgtttggcgatcgctgctttctcgcgccccctcgattccgcctggttccaagggacggccgcttctgcggttctgcctgcccctgcagttttattactgctgcccgtacagggtcagattggcatcggtttacctgaagcaatcacacatcaacagtgcacaccattcgttaagataaattttgtgtaaatttcagaaaactatgactattttatcaacattttcactctactacaactttaactgggcatgttagagaagtgcaataatggtgtatgattttattagaaagctacaactttatttatctcataagtttaaatccattttgttggttgatttatagggtaagtccaataagttagaaaaggataagcccacagcctaattctaacaagaaaataaaagaaagagataagttggttttgtgatcggttaaaaccaattttgaatcctaattgaagataagctcccgaaccccaccaatattatataacgtagaggagagagaggatgcttaatcctatgcgcgaaaacccaaaaccctaaacaccgccgatcggttttaagcactggcagagattcgtgtagccatatcagggcagtgccagtggagacccgaacgtcatcgagacttgcaagaagccagtgacaagaagttgatcaagccagtgtccatgttcatatattggcgcaagaaccaaaagaagaagaagagaaggaaaaaggaagaagagaaggaaaaaaaggagaaccagagaaatcgacatcgatggcttcacaagcaagtcagtagattaagttattttgcatttagagaatgactaaagtaataagatcttataacttagaactccaacacattgtcatacacacatgtaatactcatgtgttatagttcagttcacatgtaatgacatgcaggagatanatttgtagttatttgataaattcatttgttaaagttgtccttatatatatatatatatatatatatatatatatatatatatatatatatatatatatatatatatattctacaccctccctcccaagagtcacacccaccttccacctctgtaaaaggccagtcaaagccctctcctgccggtcaaacccgcctactaactccccccaccgcccacctcttnttagctctcatcccacagaacgtgcaataacacgacgaccaatgtgcagtaacactgtgtcttatgtgtaataacaacgttcaaatatagttgaaatatagtcatgacggatctacttttgataagcactttttttctagcatcatcgtgcaaacggttttgaaaaaccttacatcacttgggagatattgttcttcaaagcttgactttttgtaatttgtctctctacaagtagtaatgctatactattatttgttactacatgtctgttgtacgttactacaatcgcatagcgatgttactgtaagagtgctggaaacactataagttcagtaacaatgcatcttactgtattttttggatagtgttactacataaacatgtggtaacgtgtaactgtcatgtagtaacacttccacttttgtgcagtaattcagttctcgttttgcaggaacgacgtagtaacatgatggtcaacgtgtagtaatacgactgctttccgcagtaatgacgtcaaaaaatagtcatgatggatctagtttcattaggcacttttttacgagcactatagtgcaaacggattagaaaaaaaagatatgatctgtgagagattgctctctaaagatagagagttacctcttttcagttttcgtctcgtaggaacagtgtagtaacacgatagtcaatgtgcagtaacatgactaatttccacagtaacagcgtcaaaaaatagtcatgccagaagtgcagtaacagactataagttttacagtaacgtatcatgttactgcacttctacagtcatgccagaagtgcagtaacagactataaattttgcagtaacgtatcatgttactgtacttcttctataacgttactaccgaattatagtaacataatgatatctaatcatacagtgtcatatgttgaatgggttaggagagcttctcatgaaccatgagctcatgtgttcaaatcttgaattcaccaaattatttttaatttttctagaaaaaagaagaaaaaaaggtttatttccaaaaaaaatgagagaaaagaaggagaaaaaaaaagccaaaaaacgagagaagggagatcgagcagggaggggaggcgctagaagaaaaaggggaggggagggagaaaaaaaaaggggagaagagagatcgagcagggtggggagggcgccagaaaaaaaaaggaggagcgcgcataggagacgtagggtgcaggactggagggagaggggtacagaatagttattctataaggggtgtagaatagtctatatatatatatatatatatatatatatatatatatatatatatatatatatatatatatatatatatatatatatatatagagagagagagagagagagagagagagagagagagtgtgggttaaggttgtaagttaattaagtgataatagaccaaatgattgtagttttatgaaatttacttttcgttttttgacgaaaataagaactgagattttttttcaggaaaaaaaagactgtgcaaaccatgaaccctatgtattgaagctagggtgtttcacccacaattctgccaattcgaagattcagaaagaatttcacaatgcttattacataggctgaacctgactaataagtaatagcgcggccttgaaacatgaactagtcccgacctaaatacagaagccgacacggcaatcgggcaatgcattattaagaaaatgaattgagatctttctgtgctatagaactttgtgatcttcgaatgctacaaaaccaattttgccaaaatgaattattcagagttgcacatgctaactgaaagagaagaaggaaccagactggttcaggcttcagggggttcgtggaatcccccttgttgatcagtgatcctccttttgagcaaaatcttgccacgacgccgatcttggcacgccggcgcagggcgggagctccttctccgacgccgacctcgacatcccggggtccaaagggtgctggttcgcgaactgcagctgcgacgcggacctccgcatggcggccgcggagcagagcagcggcgagctctcggcgccaagctgaagctgctggcacgaggccgacctcggcatgccgccgcgccggtggagccggcaccggaaggagccctcgtgcgtcgtgggcgagcagatgcactgtctcgcctcccccgccgccgccaccttcgccggctggccactgtgtccgccgccgcagccgttggaagccatgtacgtacctcgacgcagacagacctaaccttaaccgccggaatcttgcacgatatccacggggtattttataaagacggggtttcgatctggaggagaatccgggctcgttacggcttcggatttcctattgaaaatcgcaacagatctttcgcctaaaaagtcgattgaatttatatattcaaatttgaatctgtagcgagagcgtcgttacaaagcacaacttacaaattacatgtggtatacggataaattcagtaacttctaaattatactacacgaagaaggggcgtgtcgcgggcggccggcgattcaaatccgactgaaagaacgcgtggtgattgattcatgcaacatcgaactgaacgagcgaaccacgagatcgattgctcggtcgatcgatcgatcatagcgttggcagcatcatctggagcaggggagccggccgggatcggcgctgccgcgatttgaacttcctgatcgccgccttgagcacccgcctccacccttcctcctgaagaatccaaccagcagaagcctcgtcgtaatggcggagatgattcatgaagcgtaaggatggggggatctgtatgcagaaagctaccttggccgggagaggcgacgatggtggcggcggcgagaagtccagcctcgcgcagcccgtctcgtggaggttcaggaatgagccgtcctcccgccgcagcctcagccgccgccgccgcgacctcgacgacctgcccccgatggcggccctcgccctgcgcttcgggttggcgatgagaaagtccctcgagccctcggccccgcctccgccggagcgcggcggcggcggcggcgacgacgacgcgcggggcaccttgttcagcggggaccagatgccgctctgggagtagtcgaagtcgaaggcggaggagtccgggaacatgccgagcaggccccgcgacatggacggctccaggtactccaccgtcaccacgcgctccaccaccaccacctgcggctccacggccgcggcgccgccgcctccctcggtctctgtctccgccgcactattcatctcggcctcgaagcttactagtggtggtctccggcgatcgtcggagctaggagaggaagtgatgggagcggaggaagaggtgggaaatgttaagggagttcgcggctaaagtagccgttgggtgtggcctgtccggacacttgaccgttgggatctgggggttgctcggtcactgacgagtggggcccgatggtccatgtgcctgaaccgagtcatcagtagctttgtgttcagggagtacttcttcacatgaatgccagatttattggcccaacaattcaacaaaatcacatggaaggtttgaacacaaatttttgcagaactataccagatccatccgaggagcaattaaactgtactccctccattttttaataaatgacgccgttgactttttctcacatatttgaccattcgtcttattcaaaatttttatgtaaatatacaagatataaatcacacttaaagtactatgagtgataaaacaacttataacaaaataaattataattacataaattttttaaataagacgaatggtcaaatatgtgagaaaaaaatcaacggcgtcatctattaaaaaacggaggtattactctacattaaatcttctgggcacttccctgggaaaaaaaacaaagataaaacacttctcagcacttacagtggggaaaaggaccacccactttgcttcaaactttgcagaatctcgctatagtatgtttttaagggcattcagtgggaatatagagtgggtaataaaaaataaattacttatagttatatatatgtgggagtagcaaacaacagtatgatgtaaggaataaacaaatgttttttttcatcgctctctcctgactgtggttgtgggacctagcttactaccatttttattctttcgtccttttagctacgacaactaatacctactgaagtatgatctactctctagacatcactaagatttactctatctactttatgaataaagataggcctacatcagtgggtattagttgttgttgtagccacaatgatgaaaaaataaaagtgggtagtaagctgaaccccacagtcactagccatgagacaaggatgagagaaattatttctttattccttatgactaggtagtaagcatattacctagtaatccctccgtttcaagttataagacgttttgactttagttaaagttaaattgtttcaagtttgactaagtttatagataaatatagtaatatttataatactaaattagtttcatcaaatcaatagttgaatatattttcatattaaatttatcttgggttgaaaatgtcactacttttttctataaacttggtcaaacttaaagcagtttgattttaatcaaagtcaaaacttcttataacctgaaacggagggagtattagttacttaccacttccacaatgttataacctagtagtagtagtattttgttccttattatccactttagatacacattatggatgcgttaagggcattctcaatgtatgtttactaggtatgtagtaagggtgggacctacaaaaccagggcgtatagttgttttagttcacacaacatatttaagagaatggataagtaaaaaagagagggaatgagagaagggagaatcttaatatttgtttattccttattgtctcgtagtagcactactaccggatgaaactattacccatcttactgcctactccaataatgatgaaccaggtaatacgactccttactacccacttttttacacattgtgaatgccctaactagtattatatgttaggtggaaaggtgtgttctctaacaagaacttctccccgagttcatcattgatatatggacatgtggatggtgggtcctatatatcaataaccacgtccctctagcttcgtgtcaaagatccgtgtcaaagatcatccatgtattttatatggttacttgataggacttgttaaaaagagagaagagcttgtaagtttcagggttagggcctattgatagtctgatgggattctagtcctagaagaacaagtaatcctatatttttcctattggcaactgaaaagaactctctgtttttgcaatattcagcattagcgatgaaccctgaaagttactgtttgccagtttattttttaaaccttttcttgagacggatattttgaaaaataaaaacagggttgtaaaaaaaaccccaactttattgtgataaattttctaagttgcatatctcaatattttattttccaggatataacgtgttcctacatcctgggtttggaaagaggctctgaaaaactaaaattaaaatagatgcctataatatggcatccttctcttgggcagtcgagcgtaggtcaatttggtgcacttgcgcagtgtataagtcgccgtatgtaataaaaaaaatgtacgttgtattgtagaataaaaattaaaaaaaatataaaacaaactcagtacagctttatgtaaactcgatatgccacattgaacacacttcgcagcaacccagattaacacacataagacggaaggacactgtcgtaaaaaaaaagtacctactgtattagcgactacagaatctactaaacacgactcgacttcatgatcgaacagagatcagctctttacttcttttttgagttcttccccagggtcgggaagtgtgccgcgtcatcgaagctcggtggcggagtagccggcctaggcggcggcggtggcggagacggcggcgccgccgccgcctcctgctccttcttcttgtccgcctccgggtccggcttcttcgtcctgatcggcgccctgtactggtagcctatgtacttggccgtgtcctccttcttgaccgcactgggcttcttgttgcctgctgcggcattggcggcacccttaccggcctcctgcggcttcttcttgttcttgctgttgttattgtttttcttcttcttgtcgtcgttcttcttcttcggcgccggcgccgacttggacggccaggccgccggcggcacgggcggcttcctgtaggcgacgggctccttctccttgctcagcggattgtcgccgggattgttgcgctcgagcagcgtgaaggggtttaagcttgggtggagccccatttttttaaaggacgatcggttgaattggccaagaaacccccggtaaatacaccgagcgatcgtacgtgatctgttgcttgttgctgtgttgcgctttgtgtttcgttggtgggctacggcgtgcgacggccgagaatataaagggggggcgggcaggcgccgccgggtacagctcgggttcggcttcgagtttggaagcggcacaccaccgcacacggtacgtgtcgggatcggttttgcggtgttgggtcggcgtcggaagccagtcgcgtggcggcggcccgtacgcggacacggattgcgcttgtgggctcttgcttgccttgttgggccgtgaagggaagttctcgccgggtcggaccttgtgcacatcggactccgggctcatgtagttagtactcggagacggacccaaaaggtgcgtaagatagaaaaggtccaatttaactccctcaaacataaatcggatcagatttgtatccctcactcataaaaaccggatataaaaactcctccaactattaaaacaggtgcataataactcatagtgaagtattcctccaactatagtggatctcaattttatgcggaatcgtagtcaagtaaaaaaaaacgagacccatatgtagtctgtccctctccttccttcccaattaggggtgggcgttcagtctgaccgaaaaattcggtctcagtcttcggtctttcggttatttcggtctttgaaaagtgaggaccgaatttcttccaaaaaaactcaggatcgacaaattcggtctcgatttttttgtctcggtctaaccgaattttgacagagggggaccggctcaaacgcgaacgcatcgaatcccccaccgcagtctggctggagacgaaggcgacgcagtggcggcgttgaggcagaggcgggctcgcggaggacggaccggtggaggcggcgtcgacgcgatggaggtcgaggatggaccggcggaggcagcgccggcgcgatagaggtggaggacgggctggcgcccggcggaggcggcgcgatggaggcggacgggcggagcgtggagggcggggaccggagagcggaggcggcgccgcggaggtggaggcggcgccgccgcggtggaggcgtaggcggcacggtggaggcggaaaggcagagtcggcatggtggaggcggaaggcggaggcgggggaggcgccgtggaagcggaggcggtgcggtggaggcggaaggtggatgcggcgtgaccgagccgagtgtgacgcgatggggagaggcggcgctgcgtgaggctggtgggaggagggattggatgtgtggttgcctctagggtttagtagtttattgagtttattgggcctcctaagcttattggaccaaaattcggttttctcggttaattcggttaaccgagggcaatgaccgaattactcgaataaatttcggtctttcaatggccaagaccaaactactaaccgaatttctcggtctcggttttttcggtctcagtcttttcggttcggttcttcggttcggtcttattttgcccacccctattcccaatcatcttctaaaagtaaagatggcggtggtggcaagatggaacccggaagagggcactagtggctccttccctcttctcccaagttgtagtaaatacaacaaattaaattaaacctagtatacgcacattcacaattatatttatttattttgttacatcttgtagaaagtcaaattaaatgtagaacaatatatgtcatattttaaaggtaaattgtgttgacgatacaagaagttggtaagtgggtgtggttgggtgcaagaactagaaaaccgtgcatagcgatacaataacttggttaagtgggtggtgcgctcgtagtgtagaaggttgccacatagaaaatttttgttacgtgttccatctcagcgagattgtcacatactcacatcagcagtgacatgagagagatgctctcctatctcattttacataaaatcctttgtagctgttgaaggagaagtaactggaatacaaaagtataaggggttcactctataaaatcagatatataggagagcacctcttccgtgtcactgctaatatcacaatctcgctaaggtggaacaacgacgacgtggcaaaatttcctaagttgtaatcttctcctaaagttattgtatcgtcatgctcgattttcaagttcttgtacctaattgcacccacctgccaactttttttaccgccaatgtaatttacttattttaaaaaaataaaaaaaaataaaattatagatgacacgtataaaaggatgaacatcttaccaaataaaacactttaaatataacaaggtcgcccgtatattagcatatcggacaaaaatgctctacaataatgtacttgtagtagcaaagactgacaggtggatccgatccacatatcaacggcagctactaaagatacaatattgtgcggcttgtcaggttgggtgaatccctttgcacttaggttcctcctttcatcctttgctacaaccaaatacaaatttcctttagctaaactagcttataaatgcatcttgcaagcgcacttgttttatagccctttagtgccattttgcagtagtggataggcttgccttagaaattttacgagagaaacaaaagttctaaacttcaaatcgctctgaaccgcgttgagcccatttgtaccaaaaggcaaatgcacttttcagcgaccggtcccacactacaagatgttcaggtttggagtatctaatttacccttaattatgtggtcctagagtcactgttcacaaaaaccaaagattactttgtacttaatcatgattgaaatcttgaggaagtccacgcccccctgcacggtggtccaatttatacacatcggagagaacattacaaaagcctgtaacagctagggagattgtgcgtgcatatgcacggggtctcgctctgtcaggttttaacctgagttagtcgtttgaccaaattaagggctcacgtttcgttattttgttctttgggagaggaatctttcgggggagaattttgtctcgagaggctcccgtatccacgagaggggcaagggaaaaaaatttaaaacatggagcttctctaaacacgaagacgtttttgcagtgtagctgtgtaggtagcgtcactggaactgttgactggccgagcgagcatgcaccggccgaccagtcggcttggatttttcatccttctctcgttgatttttgtttaggatgcatactggtactagcctatactgtgtagccactcaatataaaattgctggatcaatgggaactaggggtgcaaatgggtgttacgacctgcgcttactgtttgtataagtacacaactatagagatcacctgctgctttagccttcaggcctcagctagcgagcacttagccacttactcttctttcccccattctcacagtactgaccttgctagctacacctgaagatcagctggttgccgacttgccattgccgatgcaagattccggtagctgcactgatcgatcaaagaacaatctggctagcaatcttggttcttgtttgcaaattaatcagtgaaaagatacacgaagaaagctaattaagctagtgattttggtgtctagtagctaatggcttctgcagataactggctaggcttctcgctctccggccaaggcaacccacagcatcaccagaacggctcgccgtctgccgccggcgacgccgccatcgacatctccggctcaggcgacttctatggtctgccaacgccggacgcacaccacatcggcatggcgggcgaagacgcgccctatggcgtcatggatgctttcaacagaagcacccatgaaacccaatgtgaggaagccaggttgctgatctgatgagcatgcagctagctagctacagcgcagtgatgagggatttgatatgtgtggcgtgtgcttgcagatgggccgatgaggggttggactacggcgccggctcctccgacctctcgatgctcgtcggctcaaccggcggcggaaggaggacggtggcccgcgacggcgtcggcaaggcgccaaagctggagaccttcctcgacggcaactcattctccgacgtgcacggccaacccgccggcgggtacctctactccggaagcgctgtcggcggcgccggtggttacagtaacggcggatgcggcggcggaaccatagagctgtccatgatcaagacgtggctccggagcaaccagtcgcagcagcagccatcgccgccgcagcacgctgatcagggcatgagcaccgacgccagcgcgagcagctacgcgtgctccgacgtgctggtggggagctgcggcggcggcggcgccgggggcacggcgagctcgcatgggcagggcctggcgctgtcgatgagcacggggtcggtggccgccgccggagggggcggcgccgtcgtcgcggccgagagctcgtcgtcggagaacaagcgggtggattcgccgggcggcgccgtggacggcgccgtcccgaggaaatccatcgacaccttcgggcaaaggacgtctatataccgaggtgtaacaaggttagcgatttccatcaacttttgctagtgttattgttgctgatcttgttctgcatcttccagctcaagtattatattgcttatcgattttctctcatgttttagtgtattgctcattgatctcaaagcaaatgtttggatcgaagtatattaggatgtgtttcatctaaatatctaattagttgctgagagcatatataatgcgattctcctagtagtcgcttctttgctgttgctctgctacacagtgctacttgctcttctcacttagcctagaggtaacactagcttgtaatacaaggtgatttagaagtatacaattcataaaatgtactagatttgaccaacacagaagtggagcacatgtaatttccatgatttcttggtgatccgctttgccaatgcaagtgcttcttttgacgcttcgagtactgaaccgttagcgtttgaagtgcagtgatgatcatctgcaatgaacagatgctctctaattagttttcttgttgtccacaactttaattatttttacaattttcttctagtcgataaaaaataatatatatgcatgtttatataaaaatttttaagttcttcatacgtataatcacgttgttaatctgtctttcaggcatagatggacaggaagatatgaagctcatctgtgggataatagctgtaggagagaaggccaaagtcgcaaggggagacagggtatgtatatatagtgagagatatgtaatggtagttaattactcccttattctataatcttaaagataaattaactgatcaatgattaatcattcttccatctgttctgtgactgaatactgaatttttgtcgcctctccatccgggatatgacacttcacactcatgaaaatgcagtttatttgggtaagagctaatcttgtgcaatatattcacctatcatgtatagcatatatatccatttcgtaaaaaaaaatgtaaatcttatgctaatacttcgaagttctcacttatcttcttcacgaacatttgtgtaggcggttatgacaaagaagataaggcggctcgggcttatgatttggcagctctaaaatactggggcacgaccacaacaacaaatttcccagtacagatattcttctttttaaaaaaagacttaaagagatgatacaattctgttaattgctttttagatttgtctatttccatgtgcatggtttgtttgaatatcaaaattctgtgcagatgagtaattatgaaaaggagctagaggaaatgaaacacatgaccaggcaggagtacattgcacatcttagaaggtattgcttgatgcatgctgattatactatagcatcacatgtttggaagattgcacagcacgaaagcacgcttctgttgcatagcaactaattaattacgtgcatggtcattcaaccacaggaatagcagtggattttctcgtggtgcatccaaatatcgtggtgttactaggtaattaaatctaccatcaaattacatgttgggtaaaagttatattatatatgtatgatactcctattgttcgagctgaatatatatgatttactatgtttatgttgagatgttggaatttatctagaatgacggtttgacaggcatcatcagcatgggagatggcaggcaaggatagggcgagttgcaggcaacaaggatatctacctaggcaccttcagtaagccaattataccaactagcacacagaagctaatctatttgttaattaagctagttaagatcctctgttaattgaaatatatccataaaagtacttactggaactggaggtactaggacggcactgtgctttcaagaaccccgagtcatcatcaagccctaattatttagtaatccattttctcgaaatctctgcctcgtagagcggagagagggtgcattattctatcctgcccaatgggtattaataatagtggagtagcacattaattatgtcccaaatgttcctttccaagtttgtgtctcggagctgtctgaggaaaccggggcatgtggtcaagagctcattttagaaaaaccctagctactgcatcgagacgtcacagcttgcatgcagtgcgcgcggcgagtacacacacatgcacgcgcgcgtcggtgggctaaccctaatcatggcgtacgtgccgtgctgtgctgtgcaggcaccgaggaggaggccgccgaggcgtacgacatcgccgccatcaagttccgcgggctcaacgccgtcaccaacttcgacatgagccggtacgacgtcaagagcatcctggacagcagcacgctgccggtcggcggcgcggcgcggcggctcaaggaggcggaggtcgccgccgccgccgcgggcggcggcgtgatcgtctcccacctggccgacggcggtgtgggtgggtactactacgggtgcggcccgaccatcgcgttcggcggcggcggccagcagccggcgccgctcgccgtgcactacccgtcgtacggccaggccagcgggtggtgcaagccggagcaggacgcggtgatcgcggccgggcactgcgcgacggacctccagcacctgcacctcgggagcggcggcgccgccgccacccacaacttcttccagcagccggcgtcaagctcggccgtctacggcaacggcggcggcggcggcggcaacgcgttcatgatgccgatgggcgccgtggtggccgccgccgatcacggcgggcagagcagcgcctacggcggtggcgacgagagcgggaggctcgtcgtggggtacgacggcgtcgtcgacccgtacgcggccatgagaagcgcgtacgagctctcgcagggctcgtcgtcgtcgtcggtgagcgtcgcgaaggcggcgaacgggtacccggacaactggagctcgccgttcaacggcatgggatgatctagctacgcagcggccgcgatgttgcaagaagtaaattcttgagcttaattagcggcaagtttaggattagttcatcatcagagtctacaccacttgaccagtacatgcatgagacacgtatacgtgcgttggtagtataacatgtgccttctgaaggctggtaatggcaggtattagggggtaattaagatttgttgtaaattgccgcctctccttgctgttagttttgggaaagtttcagaaggagcagatctgatcgatctgggacatgtacactgatcgatacaataatttcacggttctatgcatgataggctaattatccaatcaagttgtctttttcaaaggcccttttaatttgactccttgacatgcatgagatgttttatgatgcttggaggagatcaattgcatgaatcataattagtaaatcagacaaaggattgtgatgcgtcctttgccattttcttgcctccatttgctcgattcaacatgaactgtgttgaatggcactaatctgattggatggttggaagtctaggtgataatccattcaaatagccgaagcaatgtcattggcgactccacaactccacgagtagaaaaacagtaatccagcacagcaaacaaactaaagaaatgctccaaatgtcatacgtacataattaatcaccaaatttaaattcctccaaaaaaatcagattcaagtggattactgtttgtttagtttgtttatcagcaaaaaaatcagcaagcaaacaaacagtaatctatgctatctgaccttcagacgatcgagtggcttcatcccagagatccagactagcacatagcaccggcataggccccatacaacgtcaacacacctaacatgtaatcgttagggttgaaattggccgtgccccttctcatgggaggcgcaccatcgtcggctcgtcgctctccctcttttgctcgccgtgtgtcgttctttctcctcgtttgccgccgccgccggcaccggggattgcttcttggccttaaccttgacacgcttcccggtcttgtcgtcgccggcgagaccaaaacaggccagcgaattgtgcatcttcattgtgtcgtctcgtcgtctttgtgtggagagagatccctgcctctctttgatcgatcaggtcggcagtgcaggggtgacgctgtctcgagcttcgttggttttcgctccgtttcgtgttgggatatggcacgcagatggagagaaccggtgaaaatatgtagcggccgggtaatggacagtggagtagcttttcgcaatttgtgtcctggactccacgagtcggagtnaatcagactccgattaaaatcgaacaggaacccaccgtgggccttatttcagcccgccgcagacggcccaacatgctactcattaatgggccgcccgggtctgggcccatgaaaacggcagtgaggctctactactactcacgctcacgctgtcacgcaggggagcaaagcgactgaggagagcgagagagatggcgtgccacgccgccgctctcctgcagcatccgccgccgccgccgccgcccgcgtcgctcccctccaccgcgtgcacgtcctcctcgcgccgccgcgcctctccgtggggcggcgctgggcggttgatacggttacgcctgcgggggcactgcccctcgcccgcctcggcgcgcgccgcgagggtggtctccccgcgctgctcctcctacggcgccgccgccgacgccggggagtcgcccgcggaggcgctccggagggtcctggagtcccccggcgcccaccaggcgcccgcgtgctacgacgcgctcagcgcccgcctcgtggggcgcgcggggttcaaggtctgcttcacgagcggtacgtgctcgctgttttgcctctgggcgtggggcttccctctggcgctcattgtaattctagttcatgggcataggggatggggcgatgggcatggttgtgggactgtgtattgtgcggtttgtgatccttagctgatataacgtctgactgcttaggctcccaaatctattgttatactagctgctagtaatgccttgaatgtcgcaaagatgagaactttgattgatgtgaggatttactctgtgttgatctgtattggataattgctcgtgtctctgctgagggaactttaatcaaagatttaaagtggcattacacttgtcaaaaccactaaaattatgcgctttggctatatattcagaacctaaaaaatgcaaccacactatattttgcttctggagctttcacatgactatgtataaagaggtttaacagtgttcaagcttcaactatattatgtcttttcaggtttctcaatatctgctgcgcgacttggattgcctgatgtgggtctcatctcctatggggaaatgatagatcaagggtgtctgatcaccgaagcggcctcaatcccagtgattggtgatgctgataatggttatggaaactgtatgaatgtcaagagaacagtaaaaggatttattaaagctggttttgctggaattattcttgaagaccaggtatgcttttcaagtgatattgagttgttcatggcggatgtccttccatacactgtgtttgttctagttatcttgaaactccacgattagggaagtctgttgtgttcattgtacaaagatggtacttccagtggcaccttcatatacatacttgactgtgggatccctgtgacttctgaaatgaatagtgaccttttatttttgtgatcaatctttcccttttgtttagttttgttttagtgatatgatctgtagtattctgaaggtatctccaaaagcatgcggacatacacagggaaggaaagttgtctcaagggaggaagcaattatgcatataaaagctgctgtagatgccaggaaggagagtggctctgacattgttattgtggcaaggacagactctcgtcaagctttgtctcttgatgaagcattatggagagtacgcgcttttgcagatgctggagcagatgttctatttattgatgcccttgcttcaagagaagagatgaaggcattttgtgcagtatcacctggagttccaaaaatggttagatctgttacatgctatcttgcttatccaagttgtctgtgatggccatgaaacaattgtctcatcatattctgtgctatcttctgcaggctaacatgttagaaggtggtggtaaaactcctattttgagccctgctgaacttgaagaaactggttataaactcatagcatacccattatctctgattggggtatcaatgcgtgcaatggaggttagttgatttgtatatgttaaatgcatgtttttttttccttctcacagattttgtaagctacaactgaaaactggttcagattgcttaccatttgtcctgtgagtaatagttatggattctgaaatactagtataacatgccgggtgccccataatcagtatggaaactccaacctatgatgttagtacgagtttaggatactattgcaacctaaaattttgtccagaccttccataatatgaccctgctttagaattgcaactaagggcgtaaatttcaataacaggtcttttgactgaaatcaatgggccttc

SEQ ID NO: 17416 - DNA, 10702 bp, Oryza sativa
catactatttttcacttcttctaagttacatggatttgataaagtacctttaggggaaaaaggtgcacatgtgcatgtaaatagatagtcatgtgaacctgtctgtatgtaaatttatgtagtactcatcaactataactgtacatgaaaccccgatatgcaggatgctcttattgctataaaaggtggtcgcatacctcctcccagcagtctgccatcatttgaggagattaaagatactctggggtttaacagctactatgaagaagaaaaacgatacgttgtgacaccagcccaatcatcatcgtacaggagcggtgaggacgattacttttagattacttttattctatgtcggatctatgttgaatgttttttttcctaaccttgaactcctaaattataggttactatgataatacaagtgaagcaagcagtccaggagatgccaaatcaagaactgaaacaccgcaagagcctgttattgacatattgcctcagctatatgatcttggttctactggaggcagaggcccttcagcagggatgtggtctcggacacttcggttaaggattacaggaagagatggagttcagaaaatcgatgctagaatacctgtaagaaccccctccacatctacttggtagttgcattgaagcatttaatttacatcgaactgacctatatcattgatgttggttatacgcattttgttattattactgcaatagcctcttggtccttgtgttcccgtatattttctataatctagtttttgccaaactgattgaaaggttgcttttgtttatccccattatctacaacaggctggattcttagaaggcatgacaaaagttattccaggtctgtacttcttttcttaagagcagcatgcaccataagtaccacctccatcttcatgtgatcattccctgggttttgcaggtttggctggagctaatatcatggaaaggcttcgaaatgcacctattgattcagaaaacccccagaacggtcagatactgcttgattttgaggatgctatgggagataggatccaggtgtttattgagtgagcatgcctgttttccatttgctggcgcactgcaaaatccaaatgcatggaccttcaaagcggcaccagacttcttgttgttgtgaaaaccagtgaactagtaaaatccaacattgatcatatgacctgaagtcatgaactaatggtttcctagtccctcgatgctacacccaaataatcaatctagatgtgtgcgtagctgcacattgcaataccatgcagagtatttgcccgggattagtctggtagcctttgcttgcccccaaaatcctgaagtcaaatttcgaataaaaagcattctcaggaggtttgaaatgtttgcatgcttctatctgctgatatttacatttttgaagcagtgaacagctcatgcgttgtgatgtacccaggttttattctctacaatccggtatgcgacagttcacaatatgacactagcagtgcaaggattactacaagtctacaacttcacaacactatactatacagtgtccaatggttacacctttgccctttggttaccctacgctagcttctgctgccatgctatatcgaagagacccagcaatgcttcctccctgctctccgccgtgcgggccatggcgaaggtctcctcttcttccctctcgctgcctcctctctcctggtcctcatccttcacgatctccgtgctgtccttcatggcatctgtgatctctgcagctggcgtctccacccgctgtacatcctccacgccgcattcttggccacctgatgcgtcgccgcgtttcgccggagtcgccgcctctccttcgccgtcgacgggagccttgtcgccatgcacggtgttgccaccgccgccgccgtcgtccgccgtgacgacctccaagctctcgagttccttccgagccacgtcgtcggaatgcctccgcgcctcttcctccattgctgatcggtgcaacgacgcggcttccttctcgtcgcaccagatgtccctaaagacggcgccgccgacgccgtcgtcatcgtcctcgtgggctcggtagcggcggcaacgcttggggagaacgaacagccccgcggcgccggcgaggagggcctcgagggcgtcgatcgcgccgtcgagcctggcgggcagggactcgacgaggaggacgaggtcgtcggcgcccctgccgaggacgcgctcggcggccgggaagagcaccgcggcgacgtcctggacgacgaggagctgcctgtccgcgaaggcgagcgccgagaggcacctcagccgcagcgggctcagcaccggggccgccgcgcgggaggcgcccctggccacgcaccccaccgggcaccgcatcgcctccacgcgccggtacgccccgcgcgccatggccaggatggactcgccgcagctgcgcagcagccgcgccctcggcgtctgcatcggcggtatcctcttggtcgtgccttccaaatcctgcaaatcataggcatagcacgcggtattagcagcaatcttaaagtttggagtagattaaccggacgagagaaaccaaagcgtaaaaatcggtgcttatttatctcaccataacgacatgcatctccgacacggcctgattttccatctcacagacgacgacgtcgacgacctgaaaccagcagaaatcagttcagagatgcatactggtcgtcaggatttggagcagggcgcgagaaattacggagctgagggaggcgagagaccgtggcggtgacctcgccgtggtcacccatggtgggttgtctgcagggtggggagtgggactactagcagtggctaggcttcatatttgtggttgtcgtcgtggctatatcctccttctgcaaggcctcgtgctgcagtccagctaagttagcagccgcaccaccgctcgggcttgtgacgagggcgccgcgccgtgtggcggaaggcacgcgcgcggcagtgacaaactgacaacgacgagggcggcgcggcctggcgggaatcgcgaccggtcagtcggtcgcggtttcatggcctcctctcactgacaggggggagccaaggcctccgccgctgagctaggttgtgttcttcctcttattttctcaacccacatctctcgttttccgtgcgcatgctttgatttataaaaactttctatataaaagttattttaaaaaatcaaattaattcattttttttaaaaaaagttaatacttaattaatcatgcaataatatgaacctcttctcctgaacacagcattaatatattaagaaataaaccaaaacagtatattaagaaataaaaaataatttataagcaaaagttttatatatttgtttgtaacgacttaaaagctaacgctaaaatgaaattatattaaaaaaaatttaaaaacaagttcaaaaatttaaattttatcttttgctttagtttattgggccaaccgacggggcttttacagtcctactcaaatctgaacagctcgagacagatgcaatgcaatgccagaatagattaaagtggactagttaagttatgctctcttcttcgtttttcttttagaactagttatgtcattttcgaatacttgttagtaatactaggtactcgtcttcaagctttaaccgttcggttatttgcagaaatataaatcaatacttaaaagtatgtcaagtgtgtttgcttaattaaatatagccatgaaaatcttacattatgatttaattgttaaaaactatcgatagttaaagttaaaattatttttgtctgaagctagagtgaccatttttactactacctgcgttcccaagcacactacagaaatttcaattccacgagaggacgggcctgttcactttgatgcgaaaaaaaaaacattaccaaaatttggcattatcaaaagcaggatttcttatatagttaccaaaatttggcagcaaactaaatgtagccacttttttagtaactttatcaaaatttggtaagattgaaaatagcatcaaagtgaacaggcccgacgacggtggtggtagtgacgacgagaggtgcagcggaagaaattgttggtatggccagtgatctcccaccatcgtcctggatgagatgctttgtaattgactgcaccgtgcttttgtcattgacatatgggtctagagattatcgagctcacatgttagtgataaagacatggtacagttaccgcagatcttaatcccatcgcccttatacgacacccttagacgacaggtcgacagcgacgagtttcccagccaccagatgacgacgatgagcgtgtccgacgataccgtctctccccggcaccacaacctcccctgctctccggggcgtcaactccaacgtactcaggaacccctccatcaccctcatgaacgtcgtcacgttcacggccaccgattgccctcactgcctccactctctccaggaagagcctaggcaaccatggccatgcccctcccctgcgcgccgccgtcgcccaagaggcagagcatcagctgcaacagattaaacgaaatttgctcacggtcgatactgtgatgatggttaacttttgaaacggggacaaggaagcaggcccttcccggtcacaacgtgacaacaggtgaaccaagcaaaaaatatagcattgacagggcgaaattaacagcaatcgttaacatccaaccatttctctcaccaatcattaacagcaaaaattgtgatcaagcataagaggtatgtgacggatggtccggataatactcaaacttggaaacaagtacctggccttaatggcaaggataccaggccgagaagtataacgcctaacatccaacccgggaactcgaaccactcaagtcaaaccatacgagggaaaaagtgccatgttgccgataacctcatgcaagatcacacacaactgcaagctaaaaagatagctacgactgtaaattaggagataatggcgtcgcccagtgacagcgcagcaagttgactggtcggggtgttcgcattgtgctgctgggccacattgcggaggacatccatcgcctcagcaaccttggacttcagagcctctggagactcgagcagatgcaggacctccgtctgatccatctccagaagcattccggtgaccttggccgcatggttctgttccagaagctcaaccagtggatacaggctttcaccaagtatctagagagacaaacaaatatcagaaaagctgaggtgtacatgtttagcaagcagaatcaacaatgcatttcgatgaacgatacatgtttaaccaagccaaaacacaggatttctaatgctgattgggagctgggacttcgcagactcagactgtgaaacagtaaccggtaaccagtgggttggttggtacagacaattcacatttgaatcaagttttcaattttcctactagctctcttcgatcttttattttgttctcaacttcacatgagatatactggtaaatttactggtatggagacttgagcagatgcagatgcagaacatagattatggtaacaaaacgaataataaattaagcacacaactagtagagggatataatttggacataccgttctttgctgttctggattagcatttgcaagggcagaagtcagcgttccaattggagcaggtgacaaaccagcatctcgtactgggaagcctcccatatcatacgattgaatcataccaccagcaacccccggcattggtggaacatcaggcatgttatgcgcaggtgggtaacggtacacacgtcctcttggaagcatctgttaaaagaaccatggtaagacgtgtgtcgtcactgttcattcaattggtccacatgacaaggataagtggacaacccatccaatgatccaaaattcgagaggaaaggataaatggtagaattcatacatgaaaaagtggatatgggggttttctaagtactacaaaacgaatagctcgctgtttgaataaatatatccaccgacaaacttcccctcccctaccactgcttgggagctcagcacggtttcatgttctatttcactacccactgggggttctttttacctttccctcatggcactacttcgctatcagtcaccgtaaatcataaaaaacttggcacaacagtagaaggtacaatgttataaggatgtatattagcaaacctgttgctgaaatggctgagcagattgctgtccctgggcagaaccagcaccagaacgccggatacctggacgtggaccctgttgaccttgttggacaactggaacaaagtaatttggcatatgggcacccccaggcctcatgcctggaacaagctgttgctggaaaccaaatccaggctacatggaagaaaattggtaagaaattgatctactaaattgtccagaaaatacaacacattagatggaaaatttgaatcatttctatgagataatgatcagacagtagaatttcaaagtagatgccaaatgaacaagatatatgcaaaatgagtgcttgcagcagagacataacgcctagtacaatggtgttgatgaatgactaacctattgtgtcccaaaaacttgcatggcattgattaccatactcaaactcctgatatatgcccagcatcaacaaaaccaatattgaaaactaaatgcataaaagtattgtaggaattgatcaatgatatcacttcactcatgaagttgatgtaccaattgcaatgaccaaccaaccattagatatataataatgcagaatttcaacaacttgactgcagagggcagtgctagtctgttttataaacaaacaaaaacacattgattctctcttacagttaaagctagacggggaaaatgaatgcattgatatcgagcagtacctgtgggggcatgatagcaggtggagcttgtccgtagaagagttgctgcccaagaggagccataggagggtacatgggaagacgtggagccatggaaggtgtcatcggtacagggcgcacctgagaaaattgtgcctaaataacatggaacatgctaccgtcagcatttctttttcattatgaaatgatcagaaacaactcaacaagaagaatgagttattataaagcatttattaagaaactttgtcaaaacacagcagtaagaactatggtacagccgtacaacttaaatatatgttgtggactgcaggcaattgaagatacatttctgaggattcaactacagatctatggagcatgcattgtgagtcatccctgcatatcagtatttccctcaactattatacagaataatgagttctgaactgatgcttaaaagttcttcgccaaacccaatgacctacttcctccgtttcacaatgtaagtcattctaatatttcccacattcatattgatgttaatgaatgtagacatatatatctatctagattcattaacatcaatatgaatgtgggaaatgctagaatgacttacattgtgaaacggagggagtaaatatcaataatcataacttaattgcctagattatcaataaccataaacaattactgttgctcttgtaaacattgagttcatgatggtgcaaaacagaacagtaattcatgtggcatatcttattttcatatccataaatagtactaggaatagcagtttgggcatgcatgttgtcatgaattgaattattcaattacaaacactcagctgcttaaaggactacactatacctgcaacatcgccttcctgtcttctttacgttgtgcaaatgcgacatacaatggctttccagatatcattttgccattcatttcagttaactgtataaaaggaactatgtaagccacagtgatatacaatagctaatccaatattcaggaagtaaacttacagcttgagatgcttcctcacgagttgaaaatgcaacaaatccagaccctttgctaacaccatttgcatcacgcattatctgtcaaacaaatccagttagttataatcatatatcagtaagaaacaaaagtgaaggaaaaaaggtggatgacatgaatcaccttgcatgaagtaattttgccatagttagagaacaattcacaaagctggtcatccccaatgctatcatccaaattcttcatgtataagttcagtccttgatatttgtcagcagcatctttcatgctttgctcaaatcttctcttcaattcaatctctctttctgacttcttctgagctcttccaacataccattctttgtcattaattttctttccattaagttcctcaacagcacgagcagcatcatctgggctcttaaaattgatgaaaccaaagcaccttgatttaccatccatgccaaccatgataacagcacttgtgatgttcccataggcaccaaaaattttgactagatcctcctttgtggtggactcagacaaatttttcacaaaaacattgttaaactttgtcttgtcaacagaattctctctctcttgcttgcggagaaaaggtccaacataaacaggcttatcattgatcagcatcccatttagactttttattgcagattgggcagcctctcccttgtcatactgaacaaaaccaaagcctttggattggcccatttcatctgtggcaaccttacaggagagaatgttaccaaatgcagaaaaggtatcatggagagttttgtggtctattgctttgtcaaggttctgaaaaaggcagttgaattgtttgcattagagataaccaataaaagatgattgttttagcgtgacaatacacactaacaaatgagtaaatgacctagtaccttgatgaaaatgttagcagatccacttctgcgactgcttgggtcacggtttgagtacattacccgaatgggtttgccattcagaggagcaaagttgagcagctccagtgctcttgcagctgtcaaatggaacagcttatcagttcagaagcccaatttacattaaaatcattaagggaattagaccagtagcataactgcaaaagacaatgataacaacatggtggaggacatatttaagccagaacaattgcattattgaaaagcattccaaatttgtccattaaatgccatgtgcaacattcacataaaggatgcagagcacctagtgcaactctctaagatggatattctgattgcccaaatttaagtctctattgaggacagttctacattcctatggaaaccatccaacagataatgactaattaacaatagttcaataacagccagcagccatctatataggacatcacaacagatatatgctataaattcccagaaatcagcatgccataaattatttcagtgttcggcacactcatgctcctatagcctaaaaaaaatccacaaatcagaccatcaattcaatgtaagacattatgtcttatctacagacaggtccaatgcatacacaagtacgtcatggtgtataaggtagccacatagtgtggtgggtgtccaaggttggctagacgtaatgttggtgggatttttttggactgatgcgtgattgcatgctacttatttaccaacaaaagtggtagagcaattacagttgagatagatacagccaagtgaaaatcacttaaatgatcagtatcaatctacccagaaaatttcctcctcctcgatcatggagaaagagtagttcgttgaccacaacctcatttctgatccatacatgttatagtggatattgtaatttaaaaggtggcaacccaatgagttgcattaccttttacttcttatgttcaaaaggataatcaactacaatcatgttgataaacttgaagagccacaagtagggaaaggatcaatccaagcaacaacacgaggacaccaacttgaattaaccccacaaaaccacaccatgccgatgatttttccccgattaaccagtgttcacctactagtgaggcggtcaactagactgggacatgttgcgggcgacgagattattcgctggctaggcagccatcccagcgaacgcagctaatatcccactttcattaaggacaaactacagagttcaaccatcgcatcgatgatttagcgggctattaagctaccattatggagaatcaataaaatttcctttctaggaatagctagcgcgcgccataatccgcaatattcagacacattaaatgcaaacagcaatgcaccatagtaaaggcctcatgtgagtcaactacgtaaacatcgaccgattgcttcactatatacctagaatcctagatatcacacacaaaactcaacacccacccatgttcaccagttaacagatagcaccggatcaaagattgggtccctgacacatggttccacaattcaacaatatagaatccccaatcaatccgtgcagccgaaatgtgaaaatagcgatcaatccgtgcagtccgcgcagcagaaatggaatagggccatagggggggcgatgaggagaggagatcgcgatataccatccacggggttgttgaagttgacgtaggcgtagccgagcgagcggcgcgagctgatgtccctgcagacgcgcaccgacatcacctgccccgcctggctgaagagctcgtacagctgcgagtccgtgaccgacgcctccaggtcgcccacgtaca

SEQ ID NO: 17417 - DNA, 1464 bp, Oryza sativa
tcctgcagcccttaatttcattgtgttcttttttttatgagtcttaaactttaatgacaaaagagcatgtctttggaccaaagtagggatggcaatttgcccaaggatttgggtatccgtgaatacctggcctaatgaggatgggcgtaggtgtaacttttgtccaagacccgaagacgtggtaggcaacaactgggtttcattgctagtatttggacattttgtggacttttggatgaccaacagcagaattgatgcttttgattataatgtggtggtgatggtaagtgttattcatcctgaataactaatttactttaaaatctctcgcactccatctgaaaaaaaatggaagtactgtttcacctatcctatcctgttttacatgccttccagctgaaatacttaaatacttttaaatatagaagtgaaatatggggaacctatatatttcttagacccaaatgcaagaaaaatataaatttcagtagtgaatgcttaaattatgcatcctattacctcacagaaatcaaattgtcacctaaaattgtatgaagctaaaattcctaatttcaaaaggtcagcatggatggctcttaaccatgtaaacagtcaaggttgtggaagcaagcaatgtgatctgttcagcagcagttgttttacgcttagcataaatattttcactgttttacatagttgggaacttcgaacttgggataagccagtaaatatgcattagaagattcacagccgtctcatttcaagttctgggacacatgaagactatccttgtgctaagacatgaattttcaagttgcgcttgggatggtcatagctgtagtaggaatgatctggtatgggcacgcatcttcaagacttggacgcaaagagcgccaatcttctttttttttttgaaataacaccgggggaaagagattccccacctgaattatattgagtaaaaaggaaggttatatcacatagagattacataattagagagaacgaatagaggaagagagaagatttttccaatcggtaactaccgatctgtcttccctgcgaagacgctcagcccacagagtagcatcttcaatacatttgacaactaacctagtctgagaattgggaagaccccggaacacaacatcatgtctatgattccaaagcccctaaaaacaaagcaggaagaaaattctgaagtgtttggcaggcaaatgacaggggacggcaaggtcagcaagatcatgtacatccgaaacgacagatatgcgtaaggctcgccaaaagtcttgggcaaattgacaatgaaggaagagatgactcgccgtctcaatacctcggttgcagacaatacacccagctgtctgaataatgttcttcttaagtaagttagctttggtaggaagacgatccttagcaataagccaagcgaagaattgaatgcggggggggggggggggg

SEQ ID NO: 17418 - DNA, 1921 bp, Oryza sativa
tcgtcactcgtttagttttacgcaattatgcgggtctttcagatgacaatgctactagtacttcctcattaattcagtatcacactctttagtcccttactttgcacttaagattttttttaataaaagaaaccctgatcatgttcggagtggacgaatggtgtttgttgtttggtctgatgacctcatgtgtcaagctaataatttgttcatatccagcaatagtttttttctatcatgcccccaagtagaccagtacatttcatactccttggttctgtttggtgaagcttgtagcagtttatttcaaaatctttagtcacccaaaatttttacctacattgtgaggaaaactcagcttttccagatactgctatgttaagctctttctggatcaggcctttgcatgtatctctctctcttgacacaaaggctgagctgctgaggctatgttgtctcctgtgctctccaaacccgaagccagactagtccagcaccattgcgctaacacacaaatacccaaccgcaaaaccagatatccagcatcttataactaatcaaaaccggttacaattggtgctttggtggttttgacccaggttttgtcctacgtggcagctgagtcagcgtgggacccatgcgagcctcacatgtcaggatgccacgccatctctctcccctcctttctctctccctctctctctcactctcactctcactctcactcttctcttctcttctcttctaattcaccggtcatgccggtcggccgaagcagaagcaagagccactggtggaggggctaggggggtttcgtcgccagcgatggcctagatggagttgagcgttggtggtggcggtgttccgtgacccgccgcagtgttttcgcatcggggtgcagcagattgtgagcaccacctctcgtcatcgccttctccttcttccccgccaccggcgtcgaactcgcgttggaggagcgcggcctcatcggagacatggctgccgccatgaggattacaaacgcgaggcagccgccgtcgccgccgctgcctttgcagtcgacgtcatcacccgtgcagttgctcccccgccgcctgcgcccaccggttgccgcccgtacagctgctccctcgtcggtgcccgtgaaaaagagaggagagaggaagagaagtggagaggggaggagaagaagaggctgacgcgtggggctcacgtgggtccctcactgagtcagctaccacatcagataaaaccggaatcaaaaccgtcgagaaacctaatttgcactggttttataagttggggatacgtcatatctggtttcgcggtttatggacgattttatatcttgatgacaagtgtatggtctgagcgtccaaaactggacccatcttaatttgctttgagaaaactaggcccagcttaatttgttcttggcccaggccccttattctggtctcttccccgaaactgggaaaaggatcgagcccgaacggcgaacacggccgagaaagatccggtcttccatataccacaatcgtgaagcagagagcgaactttgcgcaggccacggcgtcgacggcgatgggctccgaggcgccgcctcccgcgcgacgcggttatgccgacgccccccgccgctatgagtctcgttggcggagggaggaggatgcggtcctcctggctgcggcgcccgcgcgggcgcgtacaggcacctggccggtgcacgtccccctctcgccggggcgtccggcctgtagtagattggcggcaggatgcttctggatgggtcgacggtgaggctcgcgtcgtcgcgtctacgccgagtcacttccatgtgagcagccaattgggtacccatatgctacagtgttttcactagaccgcttctgccgctagtatagggatctggacttgctca

SEQ ID NO: 17419 - DNA, 4089 bp, Oryza sativa
actttccatcacatcacatcacatccaaacttttctacacacataaactctaaacttttttttccaaaccaccactttccccaaacttctccccaatttcaggaataatttatttatgactgttactgtgtttcaactttcaacgaaccacttactatagtagtactacctaacatcagagtctaataagatttggttttcatggtgtttcagaaggtgcatgataacgcgccacacgtgaaactatattcatgagggatgactgaaatggaggattccttaagatcctgcacagagcagctactccgtgttagagaagagaaagaacgccttatcatcgaagcagctgataagatctctttggagcagaagaaagtgtggagtctgcagcagaagttagaagatgcaaataagcggtttgcaaaggtcaccactgaaaactacaatcttcgcaatattgtcaactccaaggataaggtgatcactgagctgagtgagtctgcagcactcctgaaccaaaagttaattgatgccacagccagacttgaattcacacacaaacagtgtggctctcttcagtatgaggtgcgcatccttcagaaggaactcgagattcggaacaaagagcgggagtttgacctcaaatcaattgatgctgcccagaagcatcagcaggaaagcaccaagaagattactgcattggaaactgaatgccagaggctgcggaccatggtccagaagcgtcttcctgggcctgcggctttggcgaaaatgaaagatgaggttgagcgacggggcagtaattgtgttgagaacagaaggagaaagccacgttcatctgcacagtcatcaccgcaggtggtgactccaaggcatcctgtttctgaaggttaccttgtcaagatgcaggaattggatgatgaaaacagacacctcaggcaattgttggccaagaaggagaatgacctccagtttgtgcagttgcagtatgcagatgaagcatcgaagctgtcagtagtgcaagggcagctcaaggagttggttggtagccatgaactggatgacgacaaccgtcctgaaccatgggcaaatagttctttagtttccaaaggagagcattttagagttgggaagcaacatgcatctcacagtaggggaagaagaatagcaggatctgacatgcagttgcttgtagatatatcggagatagagaagcttgaaatgatttcaaggccttcaagtgcgccacatcaatgcgtgccagatgcttctgatacagagtccaaaactgccctgacagaaacagtttgccaagatcgaatccttgaagatggtctatctgacaagtatcccgagtggattcaagatgttttggaacttatcataaagaagcatcaagtccttaaaataagcgtcgatatcattattgatgaaataagatctgcattgaggactgagatttcagacaaaggaaatgatgctgcaaatgtgacatatgaccaggcagtaatagacagcatggtggctactcttgttgaaagagtgagttgcatgatcgaaagatcttctggaaacaatgttctgagttctcaatcatttttgcatgagaaatctgaactcacttgtcatcttgagcaccttatctgtgtatgtagtgatgtactggatggaaaggccaatcttcgaaagttcatcgaagaagtttgcttaaccctcgagtggacagtgaaccaatatatttattgtgtcgatgctctcgaaactgtggattgcatcacaaatgatttcgatggaaatgtatctcttagatcattaaacatgcaggaaaaacaacaaatgcaaagcacaaatccgaaagtggctgtaggagttcaacaagaggtacagaaagaaccgtttctgatccctggtgaccccgtagaaaatcattctcaggttcagtttgtcacttgtaagcttgataaggaactgctggctgttaggcaagatcatggtgataattgtcaagaaaagcagtcagtacattataaagaagaaaggtaactatttctgagaaccatcaatcatgtaactattttcagcactgtacactattattgagaatcatccaacataaatatgtaacatctattttatgatacagtgctacggctgatgggagcatgcaattgttaccagaagaagaggggaaacaactaacagtaatatcttatgtccttctaaacgttcttatgtttttttgtttgtaaattaatacacatctgaaatctgatgtttcaattcacaagttgaacttcacaacattccttgtttagctgagcaccacaatgcccatagctatcactcaatcactatcgcatgattccttagacattttatttttctattttatacatattccatcaaatgttcaaggtgcagtttatgtagcaagtgttgattaaaggcctactactgaataaatatagttgtacacttgcatgacactgggctatccattagtgagctttgaataagcgcaataattgtgaagtatattttctagtcattttcatgttggtatgatgagaaccataatggttgcaactcttgcagaattcggcaatatccgcagcagctgataaacttgcagagtgccaagaaacaattacaagcctaagcaagaaactgcaggcgctaaaatgtccagcaaatgcggatgctgtagacaaaagaaagtctgataacttgcacctgttagttgcaaatcagaattttagttctcccccatccatagaagcagcatgcaagaaagagaacgatgaacgtgttacaactgaaaagaaccttctacaggagcaagatgttggcactggccataaagttgataacaatggttcaacacaaatcgctcctcgtcccgtgatccccaagtcgccactaaccactgtttctgttgatatgaagaagaggaagaaaaagaagcagggtgggagcttgctgagtagactcatctttgggaagaaggcataaaacagctccttggctgctagcctgctacgctcctctgattaagttgttagtgcatccagcagtgctggagcttgttcttctaagttattccgatcccatgtccaataagagggggcaatgctacgtagctaaaatataatttatcggttatgtcatatgtgttgcgacgtgatcaacactatatgtttgtaaaatcctgttccagacatatgcatatggtcttatgattggtggatttattatggtacggggtactaaaattgtgctgtgctgtactgatgttggatggctttccgagaggcacgggcattgcgggtcgaatacggaatacatataggtagagccctggttcggccccatgctgtgcattcaagtgtgctgtacttccttcccatgacctaagcaaaaagcttgtagcaacatgtgatcgatcggtaccatggtttatggttaggctagcttagctggtgcaacttcatctcactcaccttggtcgttgcatgcacataaagaacaaagaaaaatatagaacaaaatagcgaggagggtggctctcaggctctgtgccgaagttctatgagcaagctactactaagggtgtgtttagttcacgtcaaaattagaagtttggttgaagttggaacaatgtaacgaaaaagttagaagtttgtgtgtgtataaaagttttgatgtaatgaaaaagttgaaagtttgaagaaaaaattagaaactaaaccaggccacaccctaaaaagcggatagcggggcggcaaattcctatgcgtagcagatagcgggtgatattatggatgcttatatttcaatagaaaaatcataaaaaaaactaaaatatgtaaattgtgtatattcactttttgtcagactattttactcgttaaaattataaattgtagattagtgtttaatttatattttgttataacatagccaagtaaaaaaatatttattttataacatataccaaataatggatgatatttttgcacatagcccccgtaatattctcttcgctattttaatagcgcaacaccatcgcgctatcactattacggccag

SEQ ID NO: 17420 - DNA, 7015 bp, Oryza sativa
ccccttgcgcgaggacggtgcacatgcttcgctgctgtttgggcgcggtacgggcaccgcgcgtatgtacgtgtacgtgcacggcggcacggcgcggtgcatatatacaacccccaatcccgagcaagaggcaaccccaccagcgactgcggccgtggctgcggttagttgtggcagagcccgtgaccgatcgatcgctcggtcgctgctccacccgcgcgctcgattcgagcacgagcgcctttttttcctttttgttcttttgcgcggcccgccggaagcgtcggtttggccggacgcggagactcactcgatcaaccgatcggtttggttcgcagctaacgccgatcgagaggacgacgacgactacggattgctatacgcggacggaatatggatgcgctaactgtagtcgaagaaaaaaaaatagtacgagtataccgtatacgtactacgtagtagtgtcttccgagcaggggaagaaagaaaccaaagggcgcgacaactaggccgcggaggtaaagcgcgaaagggcctcctcaaccaccgtacgtcgtaaccaccgctctaggtctctaacctccgcgcttatgcacgtagctagctgagccgacttcaccggtgggagtttcgctaacaacgtttcacgtgtgcccgattgaagttaatgtgaaacgttgatgatgcatagccttgtttagcagaacagagttaattaaatcattggaccccctgaaacctgaactaattaagtggtagtactaagtacattaggtgattaggaggaatggcgcggcaagcatagctgctagtagaacggatgtcgttttctcttcctatcctcatgcatacgtattttcaatggtgccggccataggataacgcattcggcacccgaattgcctaatcgcgacgacattgtctgtcccctttgcttacgacattcccggtaagatagccagggagcttgtatttttctggcacgacattggcgcatacgtacaattatggatgtaacatcttgcgcgccatcacgtggtccatcatcgtagttaggccactgcatgcataataatgcaatccgataccattgcatagtaacaatatttttttctcttgaaataaaatattttattggcagacactcaagaagacagtgagcagacgacatggttgaactgtcaaatgctactagtaactgacttgtcagctcggctgcgaaaaggaagcgtaatcctggattaggtaggcccgtcaaatcgatcacgggctgtaagctggatggctcgctgaactaatcggtggagtgctaaaagggcccgatggttggacattgccatttgccaagcaagcacattccatttccacggcgagaaagggtaccactaccagttcacgattacgtacaggtacctttctgttgcaaagtcgagaaatcaggagaagcggtgaaacagtgcaaggaattagcggcagtgaacgctcatgtggttggtcaaaaaagttaatatcaaagcgagtaaatggtcatgtgctaaaatagcttatcgatagggcaaatttaagcctgaagcttccatcaacggatgaattcagtcgtactactacgaaccaacgagcttggaaagctatatattcaggtgcgccgatcgagcgccacgaaattaaaaattgtacttgttatcatattcgatcgtactactacgaattaagagctctcatgttctgttcgctgttaattaatcgtctaatcataagttcagtgctcgtatttattaatcaaggacagaattctggcagttcccttcggtcagttcggacttccgacgtagatgcatggccaaaccacatgcgataaaaatgaaagtaaaatcacatccgttccgtgcagaaacgtataggggtctaacggctagctttataaggtggtgggctagacgacctggattcaaagcccaccccttctaattacttgatattaggtcattctctaatattcatattttttttaccctttgtgatgagcacctgcatctctgcacgtacatgttactttccccatccaaaaaaataaaagattttatctatatgactatatgaatataatcccttgtatttagagataaagatgttgctagtacgtatgatgtaaatactcacacgtgagctctgcaattatttggtggagtccacgactaggtaccgatatgctcacgtagtatgatccaacgagcaacgagacaaggccccatcttctgaaacaatagccatattcatcactcattcactctgtcacagtgtgagtgaatggaataatggagtgtccctggggagtaaatgctcaaagtgaatctgtgaaggagacttgcacagcgacctgatggatgatgatcgatcgaaccttcctgggtaaagtggaacacgcaaattgacggctagctaataacccaacagcctcccatgcacgccgatattgccgccttcgcgccccccgtgtttatatactacaggcgcctgcgcgccctcaggaccaaaggccgaagccgctcgcgcgcgctcactcgatcgaccagtcgcgcgcgcgacgagagggagagcgacgcggcgccgaaccggctagctctcgtaggcacaaaagcccaaacacgttgcttctgcagtagctagtgtgccgtgcccgtgatcggagatggcaggctcgttgtctgccgcgctgtgcctcactctcttctgcttgctgggggcatgcattgcgcccggggcgcgtgctaacggccggcacagccggcgggacctcgacatcaacctcggcaacggcaacggcgggggcatcagcatcggcataggaggaaatggtggtggtggtggtggtggctccagtggtggctccagcggcggcggcggcgatctgcggccgtgcgacttcgagaacgagcggctgtacaaggcgtacaaggtgatccagaagttcaggaggacggtgacgtgcgacccgcagaacatcatctcctcctggagcggcgccgacctgtgcagcacctacaaggggttcttctgcgagcggccgcccaacatcaccgaccggaccatcgcctccgtcgacttcaacggctacaacctgcaggcgtcgtcgctgaaggagttcgtggacgccctcccggacctggcgctgttccacgccaacagcaacaacttcggcggcgccgtgccggacctcagccggctgcagtacttctacgagctcgacctgagcaacaacaagctgtcgcccgccacgttcccgacggacgtgctcaagctgaagaacgccaccttcgtcgacatccgcttcaacagcttctacggcgagctccccggcggcgtcttctgctcgttcccgcaggtgcaggccatcttcgtcaacaacaaccagttctccggcagcctgcccgacaacatcggcgactcgccggtgaactacctctccctcgccaacaacaacttcacgggggagatccccaagtcgatcgcgcgcatggccaacacgctcttcgaggtgctgttcctcaacaacaagctcagcggctgcctcccctacgagctcggcctgctcgccaaggccaccgtcatcgacgccggcaccaaccagctcaccggcccgatcccggcgtcgttcgcgtgcctgcgcaaggtggagcagctcaacctggcggacaacctcctctacggcgaggtgcccaacgcgctgtgcgagctcgccttctcgtggtcgggccgcctcaggaacctcacgctctccaacaactacttcacgtcgctcggctcctgctgctgggacctgatcaaggaggggaagctcaacgtcgaccgcaactgcatcccgtacgcgcccaaccagcggtcgcacgacgagtgcgccgccttcttccaccggaccaagacctccgcgtgcccctgcaacacctacgtgccgtgtggccacaacaagcactccgccgccgcgccggcagcgagcaggacacggcggcggcggaggaggacaagtacaggacttactcggcgctgcatccatgagcgcgagaaggaagcggcaaaagcactgtgcttctcgtgaacgtgacacgattattgattgattcggttgctcttggctggttgtgttaattgatgtgttgtgtctacttttttgttacttttgtttcctttctcatccactgttacgtacggccaacttagtttcacatatatctgcatgtttaggtaaggtaatggagattttattttgatgaaccacagaagcttgtaataattcagatcaccatgaaagatcagctttaaatttccctgcattcgtcaacatcactgcgcatgcaactgccaatatataatcttgaaaacataatacctcaattttttaatgtgtgacacagtttactttattttatctcaaacttttactaacaatataatatttattgaataacgagtatccatagatctattatgaaaagcgctttagacatctagctatcttaagatggcagaaattttgtcagctgataggtggagttggctttcaatagtttgttgacacgtgttgtttcacctctctcttaactatctgtctaactagtatgtttacctcttcgcattaatattactagaaggacagatagttaagtgaatttaaaagtcgattgtgttatatattaaaaaaaagtaaattacacattagatcacatttgtttaccaatgtttcatggaccaggggtaagcaacacttttcactttggactagttcttcctctctagaccagctcttcctcaggctctctttaattaccctctctctcttctctagttctctctcagctcactgtaccactgaaaaagccatgccaatgatcttgatctttcgaaccattagcgctacgaggaatggcatattgcaggaggtaaataatcttactgctgcactccataggtgctgatcgttgctgctttcaatgaggcaaaggtaagggcctgctcagtgctcaatggagagttgagcgctcagagagagagagagagagagagagagagagagagagagagagagagagagagagagagagagagagagagagagagagagagagagagagaggaggaatgcatgggtccaaggtgaaacactttgcaaaaatttatagtcaaaagtgaaaaatagtgtcatgcccctagtccaagctacaataatggtggtaatcaaatgtggcccattgggcaattaattctactaaataaaacaaatgtagtagtacgctatgaccctctttgtttaggcttataaaccaacttataagctgaaaagtctaaacgtaaacaaacaagtagcgtttttgtttggctttttttaatgccataagtcactcttacattattaagccaaaaactaggttggagaaacttttttttttttgcttatgtgagatatatgtattactctactattaaacttagacttttaaatctattggcttataaatcatataaaccaaaatactgacttaaaagcctaaaacaacacaaagaggacttacattcagaactagttaccatattcactctaaagggtttaaaattatcatctattaagagagaaaaatatggaccacaaattagcaaggactagctagaaaaagactccatgtcaagaataccacttaaaagccatctaattcacctaaatattagtaaccaagggtgcatgtagaaaataatacatgaataactgaagttatggtaaataaaaaagaattattcttgtaaagcatatggcatatgattagctaactaaaacagtgtgtaaataaaaaagtccccctccccccaacccaaccaatatcctggcaatggcctttgatgtactaaatatcatccaacataattgctatcagccaatatcaaatttgaatccaaccatatagctagcacatgcagattaacggtacagtactcgagttacaagcaacatccacgaaaaaacaactgataactgagaagcatcatcaccggtttgatgcagagtgcacttatttttaagggtaccatggaaaatagtttagctagccaagtaatagggttattcgttgttccctctcccagcttttggcatatgcagtttgaatcgaaattacacaaaaccatgaggcagagtcagcttcttcggcatcacagggtaatctccattactcaaggccttcttgctttcttagaactggtattttcttttctcccttgttggatttacttcctcctgatttcaaaataatgggtgaaaggaaaacactagcttcagtaccttgcacgttgaacagaatcaattcaaatacaactatgcaactaataaagagtaaggtaaaatattctaaatcacattatacaaaaccaaatcacagcctagatcatgttatttattttgtaacaagcttctaaaattgtatgtttaaaattcataccactacgttcgccataggaatccattgtcctctgcaaataaaattataagatatatcaagattttgtttctgcaaaaaaattttagtacagcacgtatacaatcatataaaaaatgacctagattgattttttttcatataccttactgtattataaaaaagtgacaatttgagattacaacttacttttagttttcacacttttgttccagcaaatcccaaacatcaaatattgtgctaaattagactacatatataataggtattagcacaaaatagttggccacctaccttcttctgtagcttttgtcctttgaacatatctgtcccgttgactagggttgttttcaaaaatagtttaacgtctgacctggaccgtaactgttttttgtatttctgatgatagtagaactgcaacaaaaggtattacgaaatcacaattcatatattgtaaggaagacttcatggtttagaccatcgacttaaaaaaccaaaaaaaaacacgagatgatcttgtccatgcccaacactaa

SEQ ID NO: 17421 - DNA, 10837 bp, Oryza sativa
ctaccattgccactgtatattttttttatagctatgacaagaggatgaattgaacatgcaagtttgcttaatccgtaactccatctaatgcggcattatactttctcggggcttaggtcaattcctcaaccacttgattcccagtacggaacccatgtataatggtgtgataaacccacatgacccacttccaggtcatacatgggatcggttcctgaaatggtaagtcatgaggcaacttccgttaccagcttctaaaaagggttgggaatcaatacactaattaagcttgatccatatgcatgtaaaggtcgtttaggcttgtagatttaatggttgacaaccaacaaacatatgattagaccagacaatgttgaatgcaaatacattacaattacaaggattcaactcatgataaaactcgtgtaaaggaattaggcatgccatcgattatgtatgaaaactcatgcatgcccattttcccatgaaaaaactcataactaatgagaaaccaacaatacctatagtagtaagaaactagagattaatcaaccgtgatctcattatcatcaatgatgtcatcaaggcagacaaaatcaacctttacgtccccacgttctagatgtgcgagaagggatccattgaaatggatccgactaggtacatccgactctacagagatggagcgtcacctaaagtcaagtgtttggttatcgacaaaaagctagctcgtgatacttcttttgaatctgggtagatggtgggccaatagtgcttgtttagttcaacatcaccaatagttggaacatccaaggttcgatgtggattctgagccaatgcctcgaacgcggatatagttggccgagttttctagtctaatttgcaacatgtcatttgtccaatgacttttgctgttggccagctttccttaacctaataatgcattgttacatggaatcttggtggcatgattatcatagaactattcttcacgttaaatctccaatataattcacaagctctatcctaaaatttcaacattatcgaatccttattgaaggagtgtattggtgttaagccacaagagtatgaccataattggttggtccatacaatattagcaatcaagcttgattcccttcttgaaggttttgcaacgggagaactaatggcgatccttaaatttccatggcatcggatctcttgtcatcgtctttgttcattcttttgaaaagaaactattgcacaataaatttaacatagattattttccccaagacactaatctaataggcatgatacttttgatagttatgttgacttaagattttctttatcccttatttttgctagtgtgatgactatgttcatccctagctattggaaacatggagttaccacatccatgatcagtaaaaaagagaaagaatgtatcatctttcaccaaattaacaaccattaattaaaaaagcctctacattcttgcactgattgtcatagagcagatatgtaagacttgaccctccaaattatgatctttagtgctccttatatcgaactaaaacctcctctaccatattatctccaactaattgttgaatattatgtgaatttatagtgtaaacatgaccgtgacttgcttcacattgtgatattgtttttgaggctatattccgatactccattttttattttagtagttctaatatcattttttttatggttctaccatttttatttccttttttaggaaaaaaaaaggtcagcaaaatggtatttttctgaccattttcatcgtttcttcgtgggcaaacaaggcttgtaatggcgaaacacacatgcatacatgttaggtataaaagggttaaccattgtcaccataaccttatttttttatgtatattgggcttgtgtgtcggcctctagtccttaagcccttgaactttgacctcgccaaccaccgccacataggcacacccaactatgtcctgccgctagtatgcacatgttttgctcgagattgacttcctctagagctcccattggaccacccccaatgccaccagatttgatttcttccttatctttcttgaatcttcattatcatgctatatgtgaattcaaccactccggtcatgtctacatccatatcagaagcccatttcccttgatcaagagcttggcttggtggacttgatgatcgatggcaatgacaaactgtatgaagacatgtgctctggagttatatagatatgcgctttgtcgatgtaagcgtcaacattaattagcaccacaggctttagctgccaaccgcagcatgtaatgacccatgatggagtttctacccaaatagctcggttaactttttctaatatttttggtaaccaatatttaactattttcttttaaacacaagaaaaaaaattgcagctccaaagtaggcacttaggagttacgtactactttttatttagagggaatgcaaggttatgggatcttgtccctcatctctgttcggtatcccctaaatcatcgacgccggaggatcagtaccacctcctctatgtttgagcttgagctctaccaccacctcattgacttagcctggcggatgcgatgaagccgaagcataacctctctagatcgatggcaaccatctggcgatagagaagagttaccgacgtcctttctacttgatcacctcctccactctgtggcgattgtgatggagccagagctagagctcgaactctctccaccatgggcataaatctagttgagcttggggaggagagatactatgatgacacaagaatcgacaaggctagcgacaatcatacggacacatgaggctcgatttgaaggagtcgtcatggtcctgtgggctagtgaggagctcaagctcaccgaggtgggatggccctacgacctagagccagcatcttcgctattgtccaaggagagaggggtaatagaggagagcgtctgaaagccccagcctccaatgtcgttgtcccgcaaagaccacacccctaccttcgccatcgctgctcgatttgtattggttggtatcacctaataccccacaggtatgacctaataactacgggtgtcagatctgataagaggtaagtcaaatctgatgcttacctagtatcatcccgttcgaatgggatcccatacaatagctatcctcttgttcagtggtatagggagggggtggtgtcaatgactaatgaggactattacccttccttacacctgtagaacatatctatgcatatagtttctgtcttaaagaagactttgatctaattctacgacaatttactcaattacttaagaacataatatatttttgagggaagcacataatacattatgaagttcctagttatgaaaatacataaattaatttacaccaataccactatcataacaacttttcaatttgaataaattgactgtgtaaaactactctttgttctataaacggaaagtactaatgatcccctctatttctccacacctagtactttctgcgcaaagattcccattactgactataatcaaagatagtaacaaatgcaattatcaaaacatccaaatatttatcacaaataggaactataatgtaacagatgacccctcctacatgtatttctatatgtacctagttagcatgccgattaattcatataaaacataaccaatatattttaaatgggtttaataatattcaaccaaatcgatcgttttattttggaaatagtatggattagtcgctactctatgccatcggattgtcctgttttatagtaaatgcattcatcttctaatgtacaacttgtagatactgataaaattgtattaatagtataaatgattacattatcgtgtggtgaaaatatccatttcatatattttttacatgataacacaagaaagctttaatttctttcaagcgtgctttgttagatattataaatgtgatgatatgtcaagattgaattagatgtacataatattcatcaatatattgacaaacaaatggaagttatttacaagtcaacaaaacaagaaaaaactaattgatagtatgtcataatattttgaaagaaaaagtaagaagcctaaatactattgcttaaaataaatctagtagatcttgaaataaaacgcaaacaccttattcaaaagtgtatcaatcctcactattctagatatatcaaaaatatatataaaaaagcaaagcatatgtaacaaatttaataaagaaatgtaagattgcaccactaacccaatctttatgtccatcatcccttatttgaaggaacactgtccagtccccatctttgtagttatcgagttgtttcatccattgaggaaccggaacctcttctttactcgaatccactttttggtgaaaagccacctcttgcctgaagggaatggagttcaaaggtacaatatccaaaggttgattattgccaagcttatctggaccttgaagattcaacatggatgacatatcagacatattttcctcttcctctaaatctgcatcaatcactataggaggaatgtcatccagagtcgcctctgagtcagaacttgaatattcagaaccactcattggagctacgccctttgaagcgttattactcatagagagagagagagagagagagaggaaagtagtataaaggggatagccttaaacaacttgtcaaatatataatactaacacaaaagggtccaaaatagatgttgtcgtgtgtgaatacgtcctggttgccctgaacatttacagctcatgcttccaactggaattggtggcatactgtagtaatgacaaaataaagtgtatcgctttaactgatacatatcttcctccatacaaggattcaacatttaatgcgatatatatttcttcaatatatgggcgtatcatttaattctacatatatacatctttcatttgcacaatttaattctacctatattttgcttcttatttgaagatccatttatgtgatacttttttaacagatacacatatcttcctctgtagcacaaggctggatcattaaaatttaatgtgacagatattttgatccatttatggctgtgtcatttaatacaatacattttttcttcttgtatgggtgcaccaattatttgtgacaaatattttgttcgtatattcacatatcattcaatacgatacgcattttttttcttacaaggatgtaccttcaagaaatacatgctttcttcctcgtctggttctgctgtttgttgcaatacacgtcctctaacagatgcctgtatttacaaagacatttgtcccaccaactagagggaaaaaacaacgtacctcatgacaagcatgcatctgtggtccacatgcataattacaatattataattctttatatctttgcccttttttggatgtccttccattttcttattttgaatgtacatctacataaggatagtgtgaataatccagagtagtaacattctccaatgctttattagctatgtaccaaatgaatggcacacctaggaatgtgttccaagctgtataattttttggatgaatgtacaccgcaagtaataggaaaactttgaagcactttgtttttcttttctattttagcagaacaattggcttttctaagaagcaaccaataaattggttagccccaccttaccatggtcaccttcgcatccaaataggtcatggttgtagcatgttacacatagggtttaattactggtagttaccacgaaaactaggcttaccatcgagctttagtagcggaaacgaccagtaaggtttggcaaaatttatttaaattcatttctttttccaaagagaggaaattaaaaataaaatcatataagtagtatagtgctatctggtgaaacatttatgaaatatatgaagttaactttatattttgtacccaacccaagttgaaaataaaaaaaagaaaaataagcaaatgggctaggctaatagtgagtgctattcacaaaacctatcttagagagccgatcgtgatttctactatgtttcagtttccaaaatacaaaaatggtcacacgaaattgcatgcttgattgctttattcttttacatcttctgaatttgccctactttttctagaattatctatgatttacctgaatttttgaaactttttctcacttttcgggtttcccaagaataatgtttgtccccctgagtttgaatttttgaattcaattttttttaatatgaattttatcagggttatggataccacatacctaatagtagttgactaaatctcggcaggacccaccacatactatgtcttatacggaaacaatcttcggatataggaggagttccgcacaaggaaggatgaatagagttctacatggaaacgacaagaactactcagattgtatccatattggttttcctagttctacttggacaaggggacacctatgggtataaatacaaggctccataggaggagaggggacacgaaacaatagatcaagacataagatcaacatacaagccaacatacgccaaaacaagacgccggatatcgacttcagagataagtatggctagtcccctacagcgtctacgaatactgtcaggagagacatagcgatgtctttgatctcgctggatgcggattctaggaggaaggctaccctgttgtcgactatgagtcagcacttcagaccgccatgtcgacaatagttagataggctaccccaaatattgtactagtgtgattatgatgaataagagcaacgaccggcttcgaccaacaggagtaggcttattacttgacaatttaggggctcgaacctgtataaaaatcctcgtccctatatcttttattacaatctcgcatatatcataataccaacgatcctcatactatgcaaataccggaatcgcgacatcaaacgtcgacaaatttcatctagttttcacatttaccatgtgctatatgtgttatcctagggtggccgtagggtttcaattatcaaagcacaaggtcactgataagtccgattttcccgtttatcgctacccccgataaaatctcctatcggccaaacatttcgggttttttttgaattttctggacatagcgtcaataactactacaaagttgctttgattaattcgttatgacctgtaggttttaatcaataggttttgtgttcgattcaagcaaagatatgaatttcttctctctctcttttttcacttccatttgcttgcgttgtgtgtgctataaaaatgttgatattatctcatttataaagtatatattaattttttatacaaaatggtttggatataatctgtatgatttcctaacaacttttgttcaatttcttttcaaattttatccaaattttttttctatcaccgttagaattccgataaatctgataatccctttatcgctacccttcgatattttttagctatcgataattaaaactaactgtggaaactactagctttttatttttttttaaaaaaggaaacaaactggccttttctaagatacaacaaataatttggttagccccacctaaccattatccacatcaccacccaaatagtccatcatggcacgcattaagcccatccacaaccaagatatcatgcatggtaactaggtttacaaccacgcaaggccttcttcgtttagtcaacaagagagggattagagggattgtgaaaaattaattccacatctcaataggtgtggaattattctcctccaaatcctcctcgatccccttgtgggtgggattaactgaacaaggtctaaatgatagccaatctaattagttgtagtcacagtcaaagacttagtgcaataggtgatgttgtcaagctaaatggtcttatgggcgagaggggatagatgcatagtactccatctatcctaaagtctttatccaatttcattttttgtatttttttttcaaatgagatatgcttatctgtagtcttcatacatctaaaacttaaataaaagggctgtcttttcattttacaatgctaaattaaatttttgatcgaaactagagcgaccatcttaatattcattggttgcatgcaaacatataatttcttgattttgttatatgagggatgaattaatccctccttaggttgtgttcttctctcaactttcccaacctcttctctcttgttttccgcgcacacttcccaaattgcatttttttcgaagattttctatagggaagtttgtcagggttacggataaggtataccctttatccttggatgtatgttgtatactgatacggtatacccgcgcgtatacgaatagtttccgtatacgttaaggaaatctatcacgtgatagagacggtatctacggatggaaggagttctactcggacaaaactgggtctttaccatatcgtgaggggtccgatatctccgagtcctacttggagatcaactgacccgcggtatataagggaccccctgggcaggacctaaggcatcaaatatcactgccaacacacccaccacagcctacggagctagagcgtgcaggagccaagtcgccgggagatatagtcggaccaactcgactgcggtcttatcggtatcatcgagttctgctattccctttgtaatctgtggtttccatcatataatgccataccaactggattagggctattacctaccaagggacctgaactagtataatccttgtcttttgtttgcttgatatcgtactacgtagatcctcataccaacggaccccaataccctctatatccggtctacgggtatcccccgtcgacaaagttgttttaaaaaaattatattaatctatttgtcaagatttttttaactaatacttcatcaattatgtgctaatattttgctttgttttccgtggtggtgtttggatccacggattaaactatcacatcggatgttttgacattaatttggagtattaaacataggctacttataaaactaattacataaatgagagctaattcacatgacaaattttttaagcctaattaatctataattagcacatctttatagcatcacataggctaataatagattaattaggctcaatagattcgtctcgcgaattagtccagggttatgaaatgggttttgttaatagtttacgtttaatagttctcattagtgtcaaacatccgatgtgacaggaatatttgggagacttcctcattgcaaggctgttaacagtcatatatttgagttgaattaatttagtcggtctgaaacgagcttaaagaacatacgagtatttttccctatgcaaaaaaccctttttaacctttgtatgtggctgtgtttttgaaatgtacacaacatgcaactttttgacaaaaggatttgctaatcaaatccttctctcccacacaacgcactccgaagtccaaggaagaattctccccatcaaagctgtaattgcaaagccagcaatctcacgctgtcacaaaatcagctaaacttgatgcctatcgcacaatgccaaacccaaaaaataaaaatatcaaattttggattgcctcgagcccctgcattttgtgcggatcaatgcatcggcctgtagtagctgtaggtgccgtagaaggtctgcgtcatggtgagcagcagcaacaagacaccggcgaccaccgagacgatcgcccatgggttgctgaagtagttgtgcttgaggctggcgatccaggtgctccacttgtggtcgtagtacctgttcacctggtccgagagccccgagaggtagctgtcgttgatgtcgaacaccacctcctggcacagccggttgaagaggtcggccacctcggcgtcgctgcccagccagtgctcgatgatgccgcggtcgtggaggtacttgacgtcgtcggcggagttgatgaggttgtccatgaagatggcgtaggaggtgatgttgttgccgcccggggtggcgatgtccatgtggcattgctcgaacgcgatcaggttgaggaagagggacttggtgccgtcgtggatgaggatgcgcgggatctggagcacgccgtcgtggaacctgatgtcccagaagcggtccgtgttccgccgccggcaccggatgccggcctcccggagctccgacacgcagtggacgaactgctgccgccgcttgtccgccacgcgccggagccccgaccacttcttgagccacagccgcgcggggggcggcggggtgggctgcagccccgcgcggaggaggctgcgccggaacacgtcgaggcaatggagcatcgggccggacagcgggtcgaactcgaacgccgccgccgccggtgaggcgccgatggaggactccagcttggaccggtccttgcggagcagcggctcgtcggtcggcatgagcgggtcgaagaagcgcacagcgaggccggcgacggcgccggtctgctccgggttgccgagctggaggccgagcaggaggtcgagcacgaacaggggtatctggttctcgagcaggatcatgtcgttgcggatggcgtgcatcgcgccgcgcatggcgaagatggggtcgtgccgcgagtaccccaggtcgtcgccgaaccccttcccgccgtcctgcgcgccgcggaagagctccagcacgaaggtcccgtccagcaccaggcactcgacgagctcgttcccctgcatcccggcgacgcggccgtcgtagcaggcgcgcgcccgctcctccatcggccgcagcgcgtcgag

SEQ ID NO: 17422 - DNA, 2683 bp, Oryza sativa
ggagcgggccgatggacaccacctgcggcatgtacgcgcgctcgtcgccgtcgcggagcgacttgggcacgcggtacacggacagccgcgcccacgggcacgctgcctcctcggcgcgcgcctgcgccagcttcccgcggatggccaccacccattccgggtcctgcggcttcgggctgtgcgccggcgactgcacctggaccttcacctcccgctcccgctcctggcgcggcggcagcgcgtcgcctcccgctccggcggcctcgccgttggtgagcagcggcaggttgcggttcagcgcctgccacagcggcagcgcgccgggcggcggcgcggacttgttgaggttggcatcgacggtctccttgagcttgaccgtgatcaggtaccagctcaggacgtccttgttgaagacggcgaccatcgagatggaggctggcagtggcaggtgcagcggcttcgccggcggcgtggggctcgccgcagtagcgtctcgtggttgccaagatcagtggccccgggacagagagagcaagccaactcgagagggaggcgaggcaagcaatgtacctatgaatatcttagaacgataattttatcagctgatgatgattgatagtggaatttttgggattgcttgcttgttgtaaaatattgtgtggtctttgacaaaattaaataaagtttcctcttgcgatcatgtgcaattttcaacgatggacattgctgccagcctgcgatgtgcgctcatcagcaacttacgctgcattgcacgtactccattccgtcgaagactaattggcgactgcacgataatcccaccgctgtaatataaagaatatagatactttggatttgtaatataacgatgtattccatctaattaaaatattttatattttaagacggattgagtatttaactacgacacgtatgatcggtactccctccatttcataatataagactttccaacattgctcatatttatatagatgctaatggactagacacacatatatatatttagatttattaacatttatatgaatgtggttaatactagaaaggcttattatgaaatagaggaagtagttcgctaccctaacaatctcagagtttttcttttccggagaggatctagacatgtagttcgatccagtgcactgtaaccgcacacaagctaacatcgtagaagtacctaccacaagcgactgaccagcgatctgaaccagaagattactctacccgagcaaagcgccaaccagaagcccagaggcaaccgattctccttacgcttcgggaatcgtggaccagcgaaagctggcgaggcagtccggcacatggccgcatgcccgcatacatgtatccccttgattcccatagccgttgggttgcctctcggggatcggaagtgacgagctagtgcgacgccacgatgaacgcacatcctcactcacccagcgaaagccgaacacccagctgaagccttctgccggcatattgtcacgcgccccactggcgaaaaatcacgccgcccgtgctacgaaatgtacgcgtcgatgaagatggccgccaggtcaggtcaggtcacgtcaggcgggtgcggaagcggtgggccgatggtggcaggctgggcctgttggaggcagcctgcgggcaattaattggaaggcctgcagtagcagcatgggcgcgtatttagagcaagttcaatagtataacccgctacagacttcaaattaactataactaatttaatagcttatttatataatagttaattataaaaatatatattactcctattaatatccggtctcacatctcatacacacatacgtcttgaaattcatgctgcagctggctacaaatatatagcccgctttcttctctctcttctatttttttctcgatacgtggttataggtggcttatagcctgctattgtcgctgctcgtatgctccggggccgggggcaaaggtggataagctctttcggtgagacggtgacaattattgaagtaactgatcgtgattgtgatcccttcattgcatgatcaggcaatatttgagcagtagtaatttttgctgcacaatagattgggccttcaaacaggccgatgggcttcagtgcttcaccaagggaataagttcacttcgtgacccttaaaaagtgatcaaaatctaatccgtgaccctaaactacaaaaccggatatctcgacccccaaactcttaaaaccagtgcaatttgactccttcagcgtttttggagagcggtttcgctgacgtggcgcctacgtggcatcccagtcatcaaataaatttaaaaaattaagtggggcccacctgtcagtgactccctcctatattctctctttcttctcgttggcatcaaataaattaaaaaaaataagtggggcccacatgtcagtgactccctcctatattctctctttcttcttgttggcagcggcggcgggaggatgaggggagcggcggcggctggcggcaccggggcgcagcggaactaggggcggcggtcggcagcgtcggcatccggtggtggggacggcgttcggcagccgggggaaggagccgttgcccaatcgacaaagccatcggcttcctccgcctcatgccacttccactcgcttcctcccacggcgggctgcaggaat

SEQ ID NO: 17423 - DNA, 5286 bp, Oryza sativa
agggacggcgctggccaaaggagttgctgccgggggatgcaacggcgaccaccacaacgtcgccgtcctcgcctttcaacccgaccgccgcgctgccggggagcggctcctggtgttctttgcggcgtccaggtcgcgcacccgcttcttttgctgcagcctccctttgccgcccagcgcagctccagcgctcgccacctgccgccggcagaagggggagaatggatgagaaagggagagaaagagagagaaaagggagagaagaagggatttatgtggagaatagaaatggaatccatggcggcggctccggcttgctcccacccgccgccatccatggcgaccgccggtgccggaaaggagaatagaaaggggaagaagaagggggagagagagagaaggaagggaggaggaagaaggaaggtcagagggaggactgacatgtgggccccacatgtcagtaggcccacatttctttatgtgtgaatgactaatgggtcccacgcacatttttttatttctaatgccacctaagtgccacgtcaacgccacgtggaaagaagaccgagtcaatactgctacgtaggcgccacatcagcgaaaccgccctccaaaaccgcccagggagtcaaattgcatcggttttacgagtttgggggttaagatattcggttttgtggtttagggttacgaattagatttcgatcacttttgagggtcatgaagtgaacttattccctgagctaatgacagaagggatgggcctcttgagttatgtatgaagaggcatcatctcaggcattggtatcaatgcactgcatcaactttccttctctttttcagaatccgagggagcgatgcctatccagattttgtttggatgggaaataggaggctatccagatttgtaatattagaatatgtttgtttcaaccaaaataagggagtactaagtacatggacatcatactacttctttgttcatcctcaaataaaatgttgctacctagtatctgattggagtacttcctagtacaaagaatctgaacagggagtatctaatcaagtactaggtatagtaacattttaggacagatgaagcaaatgatgagcagcagtgcaggtgatgaagtggtcaagagactatccttctcattgcactagatgtcgtagcatgccacgcctctcataccgctacggaacatgacgatggggggcatcgccgcgcaactagaacactctgggactctgagtaaacatatttaagtataaataacaggacctcacgaggaagaaaaatacatcatataaaggtagatactatatagaaaatatgtatcagattaaatagtatgtgcatataacaaacaaaatatttgtcccgttaaatggtgcactcttgtgaggaaaaaagatacatcatatcaaatgctacatccatatcaggaacataatatctatcatattaaatggtgcaaccttatatagaggaagatatgtctatcagttaaagctaaaaactttattttatcaatattgtagtatgcccccaatttgcaatataagttgtaaaagtttgaaatacctagaacatgttcacaaaacacgacaattattttggagcatttaatgttcacatggtatatctatcaatgatatttcgcagaagaaatgtttaaggttaatggatagattcctcctatccccttacattttactttctctttggaactctatccaagagcactgaagctccaaagagcgtagccacaaagagagataggagtcgtctatctgttacccttaaacatttcttttgagaaatatcattgagagatatatagtgtaaacataaaggcttcaaaatagctgttgtgttgtttgaacacgtacgagtattccaaacatttacagcttatgttgccaactagtgggatactacaatgctaacaaaatgaacttctaaaagctttaattgatgtacatatctttccctgtacaaggttgtgtcatttaatatgttagatattttgttccttgcatagacatagcatttaatatgtacatctttttttcttccttataaaggtggaccaattaatgtgacagatattttgtttctataccttttaatatgatacatattttcttccttatatggacgggcctatatgaaatacattttagaatgaaagagtagtaattatcccatcaatcaactctcatttaaatttcttcatatctcataccccagtcatccttgaaccttatccacctctcatttaatgttgtgtgccaaagtgttttgttttttcccttattctctataattattttataaatgattattgtagtcggagggggtatattctaggataaaatttgaactctaaaaaagagatattccctctgtcccagaatatgaggattatatttttaacctaagttaaactattttaagtttgactaagttttaaactacacccgtctcaaaatataacagaattttcccatataattacatgagccaaatcacttattctttgaaatgggtatagcacagaagaatattaacatctaccacacaatctaccacataaaaacagtaaattataatgatatattttataatgggtctaatgatgctcatttgatattgtaaatattattttgttttcataaacttagttaaacatagtttgacttacaacaaacataaggtcctttgagacagagggagtatatgatatagtagtaccgaatgtaagagcatctccacgagtcccctaaacatattctgtaaatttaaattttgggaattaagttaaaacacatgtctccaacaaatacccaaaagagctcccaaattttaaacacctctaataccggcgccatcctgagctagatatggggcacctcatagaactcccaatccccggccacaatcacgccaattttttgccgctggcatcattttttggcaatcgtgcgcgatcaacctcgcaatgatgtacaggagaaatataatcggccaaaaatagttgaggagggcccactagcgatgagataatatatttcaatgttttgaaacctaagcactgactctgttggagaagtgggtgattttcttcttgcatatttttgagatgaccataatccaagattatcgggagtacaattttaagccattggcctaatctatacacacttatcacagttaacaagtataatccaaaattagcaggagtttaattttgagactggtatgcctcttattatggtttaccatattgctcatctaaatgtttttatcatactgtttttgagattaaaaactagtatttatcggtttgtcgaaaaccgagcaaaaacctgtgaaaaccaacaatttatatacaggaaccagcttaaacaaccccgtttcgggaagcctagtatgcaaacgtttgcggacaccgggatcacacgaacgcgttgacttcccattttccgacttcatgttctatggggtcgttttatttttagcgcaaacgagatgaaggcctttccgcccctagttttagctatttgtgtcccaactttccccacataaaatttcccgtcaaaactttacctacataacccttccttgtataaactttctatcgagaaactttcattgtataaactacttcccgaaaatattacccatataaacttttttcccaaaaacttgcccgtataaactttcgcccaaaaactttccacatataaactttctccacataaactatttccatataattttcatatagaaacttttatagagaggagattacaaataaatgaaaaaattatttcaaaatcatatgaaattttaatcaaatctcaaaaagtatatactcaaattcaaagaccttgaaatgaatctttcaataaaataacttctcaaaaccctgaacttaaccatggcatggagctcaccggggtgcagtggattttttgctggagagaaacagatttcgtgcacacaacaccttgccagagggaggaaaaagcacgtcgtcgttgacaaccacagctgcgacagggccacctcgcccttcgcttcatctgtgatgacgacctcatcactgtgcgctccgtccatctcgccaaggtgagaagagaggggaggggggaacagggctcttaccgaagaggtgaggaggaatagggagtatgcacacaacttgatttgtcgcgatagtggtggaggaagtgtgagaggaactcaagcagggaggaaaaaattatgtgatagaacagatctacttcctccgtccttaaaaagagtcgattcctagatccccaatgcaaattttgtataaacgtgaaaagacaaaagtgccctcattaactatatccatttatcaactatgccgtttctatgcacatgtatgtaagagacatcttatgcataataaacaacgccaaaaaaatttaaaaaaattcacttgctggaagaaaagaaaacatctacgatctctccaatctgaggggaaaaatgctcttaattccccctgtaagaactactactgcaaacaacggcaaaaaccaagaataaagaaaaaagaaagacaaaaaagaatagagaaaaaaatacaatggtatttgcctttaccactgtaggcttgtgcatcgagagtcaggattagatcccctgtaaatgaaaagcatacaaaacgcaagagaagagagatggggcggagataagatttgtggtgttaaagcgtgaatgatagggagagaggccagagtcattgaatgcttctattttttaagcattctaagtcggttttttataggacaaactctccctcgtacattcgtggtgaacgttcccccacccccacacaccccccgttttcacaaaccgatgcctaacatgcttgcgtgcaaacatcgatagtgcgaagtttttgaatttgaaatgaagagctggaattcatgagcagaagtatcaagatttcgctgtacgaaaatataaatgcagagacgctcagggggtgctaaacaacaaaaactgaacgaatgcacgcatccccacgctgggctcactcttcccctgtttccgtgccaaagatgagcatccgaagcaaaagagcgtagcgcaagaggaaaggagtagacaaaaaccgacaagcttcacgtttcggattaatggcaccgaggcattttcccagcacccaggcgttcgactgacgccgacggggccaacggcatttacgcctagcaacaagcacacacagtgcttgggggtgcagg

SEQ ID NO: 17424 - DNA, 4394 bp, Oryza sativa
ctagctgatggattggtatatagctcggcacgggcagatctcgcggagttttgggggaaattttttttctcttttttcttttggtgtgatactagaaattttttttttttgggagtagtttttggttgcgggatacaagaggccgtaggcggagagcacgcggcggaggcgagactctctcaacggtgggcgaggccgacgggggaaggcgttgcttttatcagcccaccacccgtgggagggaggaggacggagatgccagctacgcgcctacgctagggtttacgcgcgccccgctcgcctggacccggtgtttggtgcgccacgggagcgggtggccgcctggtctacacggggagcaccaagaccgggtccacgtatcctaccgctcgcccgtggttttttctcttgcgtgagagcattcctgtctcggtggatgggttggggttggaccgttcgactcggtcgtcgtcgttcgtagggaggagtgcttcgggttctgtgcaaattggtctcgaggcctgacgtgtgttgcgtcttgaccgcttcgttgggttgggccaacgttctcgaagggccgggccttttgggagaattgaacgtgtttttttctaaccattttattagggcaacaacaatatatataacaaaattagtccatatagatgggacccggaaatgctactgagcgagctcgcccaaggcgatcatattcgggccctcctctccacctggttttcttttttagcaccgcattactttcctattttaataaatttatacatctcgagtttacacatctaaagtttagagactaaaagtttataagtcaaagtttatatatccgattcaaatttgaatttgaattcaaatatttttttatatatagtatttctatacataaaagtttataagtcaaaagtttatatacccgtttcaaatttgaatttgaattatatctgatttaaatttgaatttgaattcaaatattttctatatatagtatttctatatatctaaagtttatacacctaagtttacagatccaaagtttataagtcaaaagtttacatacccgatttaaatttgaatttgaattcaaattttttatatataatatttatttacataaatttttctaacttttgttttttaaaaacaattttgtggtgttctgtagtagggaagagaaggagaggaggggggagaagagggacgtataggggagggggtcagcgatcacccgcttcatacgattaattatttttggaggaatactatccaaaaaaaattccctttcctttggtgctggtttcacaggaaaagtccaggaaaaaatcatccatcacaagctctttttttgcttcctacatgcaagtcctagacagtcaacttactgtgatccgcatgccctcaacttttgtactcctttgtttttcattattctgttttacgcttaaattccttctctattcctatacttttcagatcctatggttttcctatcctttaatccaaacgagcccttatatttacgaactctagaaaataaactagaagctagaaacaagtttttttcttcttctagattgtttctcaagactcatactctcccaaactcaattgtactgcttggagcctttggatgcctactttcattaccatccagtacccagttacccacagaagaaaggcaaagaaaatttccagccccccatgacgaagcatcgaagaggacatcattgactaccaagggaattcgttgcttttccagctcagaagtgccctttaaaaccaatcgtgtctaacacatccacggtatcagaattaatcgacaacaaaatggcaattttcccaaggactaaataaaagtacagcaaaggtctcattattaagaggtgaaacttagggcatgttcactttgatgccaaaaagaaaccttaccaaattttggcattaccatgacaggatttcttatatagttaccaaaatttggcagcaaactaaatgtagccacttttttttgataactttaccaaaatttggtaaggttgaaaatggcctcaaagtgaacatgcccttattttacccagatgccatactaacttccatcttcatacctactattcgctacgcagttgcaaccgagttgcttgcacataaacattagactatcgttaggatacctcgctactatttgatattctgattgaactcattcaattaacactctcaaggatgtactaacagagggcatcaaattggggagaactacaaatacaagaaggcataccatacataacatgaaatcttccactatcagcatatcagtatcacctactgcctttaactaaacttcaaagcaacaactagcatatcactatccaacatctctataattaacgacaaaaaatggcacttggcataacatatgcattatcttcattgtttacagaataccatttcaatagcacactacatgtataacaagctagataaatggaagaagaatcttaaaagagaacacaagttcaattatgcatgtttggttctaaaacctaatgcagaatcggagactgcagtgcaaagagcaaccaattatatataccatgttgtaggctgccctatacagctaattattccaatgtgctcgacagcgatggcagctatttttagtactgaggtagttaagcttgcaggccagatttctacaactcgaagcaaccaaagaaataaatttgtatagatgcatcctaatcatcaacaaaaagctaaaccaaacccttttttttaatcagagaaagggcaacaactgctgatgaaatagcaatggtaacacagaattatccatcatgatgattttgcgagaactagatagtaaaattaataacctaaggaacatgaatatgagattagaatgcataaagtagcaaataggttcatcaattttttttatctcacatcacagagctggaggattgccaaacctcctcctgagtgctgacatgacgctcctcatcctactacttgcctgggcagatgattgtgcattgctggcgttagtcgggagatccatggctgccatctgatcagtaagctctgtaatttgcacctgtccagcctcttgcccgccattttcaattgcacctccagcatcacgctccaatacaatatccaagctgatagagaatgagccacccctaaccaccttcaggttctcaatacattcatacgatacgccccggcatctcttcaatttcaccttgaccaagctggggcagcccccattcagtgcccacatcccacggtctgagactgggcaacccttgatgcaaagcttcttgagcgcagcgcagcgctcagccaggcaaatgatctcaggatccccaacggtctcacacccacaaagggcaagacgctccagtgagcggcaatgttcaccaagcatacggagactctgcacggtagggttgaccccaatcaagacgagctcttgcaggtctggacatcctcgtgcaacagccatgaggccatgatccccaatcctgtttgtgcgccaccatcaatatgtagcttgcgcagtttgtgacatttctcggcaacgctgattatgcctgcatcagtacactctggggtcttgacaagaaacaggacttcaaggtttgcacatgccgatacagcggagaggccgcggtcacccacctgcagcttctcaaggtggagctcaacaaggccaggtacacgcgcggcgatgacctccaatgggagggcccaggagccagagcacctcaagatcttgagcgaccggaggttcggcgacgaggcaaccaacggcacgaagcagagggcgctgtacaggtctttcaggcagactgaccgcagcgacgaggcgggcgggaagaggatctcctcggtgatggcggtggtggcgccggcggtgtcagggaggccgcgaaggcgcttgacggagaggtcctcgaggagggggccgaccggaggacggcgacgaaggccttgggcccaaaactgcaggacgcgacggagagcttgcggatcaccggcgtggcgccagcgagcgacgcgagcccgtcgtcggagagctgccggaggccgcggagcttgagcctggcgagccgcgcggacggcagcgcggcggccacctggcgcgccccgtcgtcggagaggctgtccgtcccggagccccgggcgcagcggagcgcgagcttgctcaccgccgtgaaccgcgcgaagatcccctgcgcggcgtacccgagcgcggcgcgggcgtcgagcgaggggcggtggcgcgtggaggcgtccacctccttccaccgcgcgcaggtgagcgagcacgcgttgcggtcggtcggggtgagcgacgcgaacacgaggga

SEQ ID NO: 17425 - DNA, 9408 bp, Oryza sativa
  unsure (1)..(9408): unsure at all n locations
ttctggcgagcggcggagccagcggccagtgtatgaacctgtgggagcaacaccgtttctgaccggtttactatactaggaatttgtttggtgtcacccgaagtacgactatattaaggtctgtttataaaacccttatcaaattttggcatgtcaaaattttaatatagctgtcaaaattttgttaattaaatatagccactttttttttataactttaccaaaacttaataagattaaaaatagcatcaaagtaaacagtctcttaatctgaagttgttgcgggggagggatcctctctttactctcttttagtacgtgcttgacctaatcctaaacaaaagaaacgggcccgatcaggtcaggtctacctcaacctcaaccggacaattgccgtgtggttgcccaaaatgggtggtctatcgcgtgacgtgccgaattacatcgtgttttgtattcggtgcaggtgtcgatttcgcgtggagagacccacaaagagctgacgaagagaaacgaaaacttgcagcaaccattgttttgttggggagaagaaaaaacccaaccaaacaaacgcattgatgacgtccacccaaaaaccacaaaaaaacgtacggctctagctacagtagcgtaatgctcgcacattgaaacagtaataatcccttgctgttgctgaagactgtgtacatcgtacatccagcatgcgtctacgctactgctcagctgtaccgacgcggatggcagttgcatccccattatttgccgggaccggtgcgcaccgggtcggaatccacgtcggtcagcgcctcagcgggcgcggcggcaacaaacagcgcgaacgctccacgacgcccgcctttgctggagaagagggaaattcggagcagtttgttgccggtgagcctgcagaattcgcgcgcgcgtacactatttctgcagcttgcggctgaattttaacagggacatcgcatcgtgatcaccacgatatccacatccactgttccgttctatagcatcgttccgtgcaactacttgaggttgatgttttcagaatcttcagacaagcaccacaagcctgcatcagcctttcggtccatttttacagactacacaagttaaagaagttgcccggaaacattagcttcggtccagaaattcagtccatgcaatggtgtagtctttatcttgctttacagctcaggcatacacacaggtgtatgtacgcagaagcgtagtaatcagtggagtcaaatctagctaggaagatttcgctttgcagttaactacgctctctttctgctaagtggtgcagctttgctgaaaagacgagcttcccatacgtagtggggcgcactactgcagaacaacaagaagaagagaaatggcgcaggacgatgtgaaatgatgaagtgattatcataatcatgtaagacaaggatgttgcttgttaaatactcgtggcctgctctgaaaagaggaggattctggataagaaaaggagcagccattggttgctttcagcacaatactcagcttatcctgtcaaagaacaaccaacactcgagtaatcattcaccattaactttcagtgaatcctacctacaagctttctgaatcgcctttagcggctctgcactcattagctaaaattgcaaaattactggaataaagaccaaagcagttcatgttcatgttcatcctgcctcatgagtcatgaataaagttacttcgttctacttttattgtcagatttccatttgatgagtaatgagccttcagatgcaaaattgccgagctggagccctggaaggtggcgcgtctgtatcaaggagccaattttgtctcttttttggagtgggatacatcaagaactactttttatacaacttcttttgtgcaattgattgatcgatcaacagtaatacagaggagatagtaagatacagtggtttctgtaagtctattataatctcatccccatttcgtcttgtctgttgggacatgggactgtatcacagtacagtcatgacaatcgcaccgccgtgaactaactgcctttcgacatgctaattatcagttcgcaactgtattattgtaattattgctgcagtctgccgaaacatttcactcaaagaatcgagattccgaaggaacccggttcttttctttcttcagccgaggtggtcaggtgggtgtgttagctatacctggtttccaactggaaccatccacacgaaaaacggagcggtccattagcgcgtgattaattaaatactctattagctatttttttctcaaaaatggattaatttgattttataaagcaacttttgtatataaaatttttgcaaaaaaacgcaccgtttagcggtttgaaaagcgtgcgcgcggaaaacaaaggagatgggttaggaaaaggggcatccgaacacaagtatagccaactactagctctaattcatctatagccaatctaatagcttattcacataatagtacctataagcatatactacaccattaatatatggtcccacctctcatatacacacaacgtattggagtccacgcggtagctggttacaaatctgtattccgctttccttctatattttcttctctcctccacatgtgcttacagctaacttgtagtctgctattgtactcgctctaagggtgtgatgatgtcacggaaactgaggattcgttgggtttaaccgtttagagcaagtataatagtgagctataagcttactgtaaacttatgtggaggagagaggtaacaaaaaatcaaggggtggctctcatgtaagagctagcttaacacaatatctaagacaaatacattaaatgtataagtgagagatagcgagaggagaagaaaattatagccaaacttatagctaattttattatatatgttggcttaaaatgagttaatagtagaagttgagttatactattgtccttgctcttaagcgtcgacggaaggttgatcgattggtgggaatttgggtggtcaatcaccgcatcccatgagatcgttctccaactgatcgaatcgcaaggagttaccggtacttctcgcatagctatttgctgctacgcagtctgcaaagtaacagcaaaatcttcacgggaacaatgaccgaggataaaaggaagtgggctttctgggatggaaacaaaggtttcattccaggatagtacggtataactctggatttcaggattggttttataattctgacttccagtgttgaccttttttcttcagaacgattggtttccatttagatgaacaaggcttcacgtacgattcatccagtgttaggaagggcctgcgaattcggcatgttttctacagttaagatgggctgccaaagtccaacaaccttaaggctcactgggatcagctaattacagtaattgctctaactgtttaattaaacctaacatgtttgaacagtgatattcatgaaacttatttagtagtaaaaaaatatagtacttcatccactcaaaatataacaacttttaatctttaaaatttgtatcaagtataactacatattcatccacattctatttttaactgatcacaacaccattcaaatttccacatacctcatctttctaatcaatcacaacattcttctatttaattctaccaacttacttagcaatcgtgtataattttaaaacttcttatgttttttggacgaagataatactccccgttataaaatctgagctaatataccacgggatcccgtctaaatgggatgataccgatcaagtatcagattgatctgatacccgtaggtaccagtcaccaacctatacctcgttagtattagctaatgcctgctgggaccacgtacctggtcgatacccgatggtactaggcgtggtacctatcagtactagacctggtacctattgagtatcagaccagagcttagaggggaagagaataagggatgaagatggttatatgtgttggttctctcacctggagatgatgacgccaagctcgatcaatgccaaatccaatagccgaggatcttggggtttcaaatttgtcgaacatgagcaacaagaaggacacttcctcccctatcctcccttgcacttggcggcaatggtggtcggtggtggtcttactcgacaacaatggcatcgacactgcctcatcctctatcaacggtgatggaggcggaagctccatgtcttccatcaatgcaatgatggcgcttcccatctccttcggctacgacttcctttgtcctcgcagcgtaagtccacctaattttattgtggtcctacggcacaccctagccgatatgggactgttttagtgcttacctgcatcttgccctccgacttgttgctccgcgttgatccttcttccccgccgtgtcggtccaagtcttctccgctgggcataggtgccggagaggggatctcgccccggatggtagggattgggtgacggtatcttgtattttctaacatgggttatttttctttagtgacaattttgttctttcccctactctaacaccacaaaatcttccccttgagttgtgattcttactatgaacatactacgtccaaaccgagataaatatacacgtctaacagaatatctaaaccgagagaaatcagaaattagaaagagaattcacatcaacattgacacgggtggttttcgcgctgcaccaatcacgaagcacccaagcacgaatctcggagcgccgatgcctcaacgcatctgagaaaccgttccaagctcgccgccgacgacccggccggaccctcccacgccgccgccatcgcgcgcgcgatctcccccgccttcctcctcatcgcctcgcccttctccgtctcccccatcaccgcccccacggcctcggccacctccccactctccaccgccgagctctccaggttcccgcgcgccacctccacgcacaccccccactccaccaccaccatcgcgttgaagaactgctcggcccccaccggccacccgagcagcggcacgccgtggcggaggctctcgaggatggagttccacccgcagtgggtcaggaacgcgcccgtggacgggtgcgccaggatccgcgcctgcggcgcccacccgcgcaccaccagccccctgcctgcgcgcgccatccggtcctcgaatccggcggggagccacccgggatcgaatccgtccttggggtcgaaccccaccggcggccggacggcccagacgaacggccgcccgctcgcctccagccccagcgccagctccgccatctgacggatgctgatgctgttctgcgacccgaacgagatgtacagcaccgagcgccgcgggtgcgcgtccagccaccggatgatgctggtgtcgtcgtcgtcctgcgatttcgaaggatccggcgccgcgaggatcggcccgatcgcccatgtctggacgccgaagctcgctctgagcatgtctagcccggaggtctccagttcctggatggtgttgacgagcacggcgtcggtcttgcggcagcacgggatgacccgccggaagaaggcgtccaggggtccgccccgtcgcggcgagcatgtactgcgggatctgggtgcggtggaggacgacgtcggggaagtcgggcagcagcgggaactcgtcgccgccggccgtgagggtgtgcgggaggtgctcccacacggagaagaagacggcgtggccgaaggcgcctccggggaggaacacggcgtgggacgcgccccgcgcgcgcgcgacgtcggccgtccacgcgaagaaggagtcggcgatgacgcagacggggggccggatgccagcgacgaagccatcgaaggccgggcggagggactcggaggcccggaagagggtgatgaactggtggacgtggaggtcggcgagggactcggcgccgtcgggcagaccgtggtcggcgggcgcgaaggggagcgcgtggagccggatcggaggggaggtggccgggagggagagggagccgaggaggcgtggggtggagacgagcgtgacggcgaggcccgggcggagcgtctggaggtggccggcgaggcggaggaaggccgggatgtggccgtgcgcgaggaaggggaagagcacgacgtgcgggctcctcgcctcctctccctctgccgccatggtgaggtgatgatggggacggggtgttcggtacttcggtggaagtggacgctgagagtgatgcggctcccgcgctgccactgaaaaacaaaacgctgatgcgctgaatggctggaaaggcgccctccactcaccgggtgagataccgagatgtgaccgcttcctttctccaattcttcaatttcgtccaactgaactgtgcactgacgccatgatcaaacaggtccaggtttgagcagcagagcttcatcagattatcaaaaggagtacagaaagacgaagggatggcacattggtaccgatcgatgcaatgtctgcagttctccactgcattctgctggtactcctatatgtactctggcccccggtagtactaataccacatgagtaacatcagtgattatatgattattatcaaaggcgaactttaggaagggatggagatactagctgaattgcttgaagcagaaccgtagatggagataatcagagctttccaaacgggaacactattaacaggtatttggtctatcgactattatttacaacaactgggcaatgaactcgaagaaggaactagaaaaacccacatcaaagtcagataaaaaaactctagaagtaagaactgccatcccgcccatgaagaactctgcggctctaccggtaattcttcgttgttctgaaggatatgctgagagacactggatgtacagaatggcatttgtatgagtcagttttatttatctccctagaaatatgacataaagaatgaatgcaaactcccaaaaaattcctacataagtaaacagagagagggagcaaaagggcattgccctgactagaacatatataaatacatcataagttatccttctttgaagaatgatcagaagcaggcgaggatgaagagctcatcctggccctatctctagactcacttaacataactacaacattccgcatcggtggtctgtcatatggagacatactagtacatagcaatgcaattttcaagacctcaatcatatgatcgacagacgttttgtcttccaaattcagattcttatcaagaatccctggacccaaagaattgtccctgatgtaattctttacccatgttaccagatcacctcccagttctaatggttgtacaggggcacgtccggttagcagctccagcagtacgacgccgtaactgtatatgtcacttttttcagtaaccttcatggtgtatgcatattctgatcaaaggagaactaggttagtactttgtaggaaacaatcacatgtactttctgctagtataaagcaatcaagtggtatagtagcctaggattttacaagcaatttcaagtaaaagagataagagctataacaggaataagtatgcaaagtaacagtagaagactcaccaggtgctatatatccatatgaaccagcaattgcagacattgattttgagtatggcatgtctatcacctttgccaatccaaagtcaccaacatgagcttcaaagttctcatcaagtaaaatgttatttgattttatatcacggtggatgatgcgaggtttgcaatcgtgatgcaagtaagatagcccttcagctgatcctagggctatcatgaagcgtgtctcccaatcaagtgaagacgaagattgcccatgaagtaactccccaaggcttcctcttggcatgtattcatacaacagaaggttggaaccctggtgatagatgaacccatataacttcacaatattacgatgccttatctttcctagagtaaggatctctgcacgaaaactattgtctgtgttgcttccctctctgttagaagccagcttctttacagcaattgtctgtccagctttcaagatggctctgtacactgttccacatgcacctcttccaataacacaactctcgtcaaaattatttgtggcagaaaccaattcctgaaatgtatatgcatccttggtagaaacctgcatgttagacccagcagaaaatatttgcttgtcttgcaaaggagctactgtttctagtggttttctcatatgatacacaattataacgataagaataagtgaaattcctccaataacagcagcaacaattgctatgaccttgcccaaaggggggctgcctgaattggatgactgggaagaagatattgactcagacccacatttgccaagttgtccgccacatagtcctttgtttccaagaaagctggttgacgccatgttatcaaaaagtggtatagtggggagagcgccggtgagattattgtaggagacattgaactcaagcaaactagacagatttgcaaaggtatctgggatttcacctgtcagcttgttattattgagaaacaaattttccaataatgcaagattaccaagctctgatggtatgttgccagagagattgttataactcaaattcatggcgatctgcaaacttgagagtagtccaagctccttcggtattccaccagagaattgattgccaccaatctgtagagctgtcaaatgtgaaagtttaccaagaataggtggtatctctccagagagcctattgtcagcaaatgatagcagctccagctgaggcaggctgccaacttcatttggcaatgaaccttcgaagctattttggctgagatctaggcgttgcaacatagtgcaattgaaaatttctaatggtatgcttccgcctagtctattggatgatatattgaagacgacgagctttgacagattacctatttcttgaggcaactctgatgtgaaatagttatttgttaggtcaagcctttggagagacttgcaattgcctatctgaggaggaataggaccattgaacttgtttcgacccagctcaattgttgtcaaattcaccagattgcagagatcagttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17426 - DNA, 3221 bp, Oryza sativa
  unsure (1)..(3221): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactctctttactgtatgtaaacaaggacgagcttataatataatcgcgtaacctgagcaaagataccaggtacataagcagaacataactgtatgtcagagtcacagtgcggagggacgcttcctcgcgcaaaggggcgtaaagtaccacctgtgctgggagatcggcttctcgcaagcccgcaattgcacgaatcagagtaccaggtagcagctggcgttcgcttaaaccggcttaaaattcagttgacgaaaggagtatggactatgataccatcagccatcaggggaaaaggtcaagcaacaataccagttcattaacacgataacacgaaacattacataacatcgaaaatgcagaggaagcacgccatatttacagttgttccttcccatcagcaccgctacatatttacacggcctaaatacgtgccagcccttcaccactaggccatccatcagacccttcagcaccagggcgaccagacacaccgatacaagcaggactgacgtacagatcactcgagcttgttcttgtgggaatatgtacatttgtcctgctctaagcaggtggatatttacatgtggacacatgtgcagctaccagattactcgggccgcacactgacgagattgggcagggcagccaactggagcttcttgatctcaatcgcggtcaccttgcaggactccagagacaaggacctcaggttctggagtggcttcagatggtggagcccagaattcgacacccgagagttcgacacgttcagggagaccaaggcagtgaggcctgtacacatggaagatatgcaaataaatagataaattgtgtgttgaatgctttcattcctgacgagcgcaaaagacatacgggaaatcagctctaaggatttgtcagtgaggttgccattttgagataggttaagcagcgtcagagctttgaggtctttgatattcttcactccagcatctgtaattaacccaccgcagacctcaagggactgtagattcttgaaatctgaagaatgcattagcaaacagatttaagtgctacgtgatattttgatgcataaaaataacgagaatcccccaaatttccaagggaataataatttcccagtaaaatatgcaccaagatgctgtcatattcaatgctaataatagcaggggttgagaaaaaaaagttccacagaatgctaggttaataggatttgctttatgtgtgcacaatgataagctcggtgctacacaagtgcaaaaaggcccaacgtgccattatcttaactcttatagtaaactagcttgttccgataatccaaaatcaccagactagtaaacagaaccttagcatggaccaactttttatgtgcacacttacatttcaagcagtttgtcccagcatcagttatacgagctccaaatagatcaaggtgtgtcaacccagtgagacctgcattaaacaaatgtcacttcaaggcaaaatacaaccaaaggactacacaacgatacagaactggagaattcagacgataaccttgtagccaaattcttactcctactacaatgcacaacaatcaccatttgattaaagcgaaacatcaaaccttgagaggaaaggaacaccatcctaaacagacataaaaaagaccaacactctacatgccccaaaaaataacgtagcacccaatcatgccatatccaattaaattgctaaaatgggtaagataccatgtctaatgcataacaggaaacccaatcatgcacgccagtattaaacaatgtaattttaccaaaaatgaggacatacatgtaagagctgccaaaccattatctgtgatttggcgattatcaagattaagggatctgagtgaattcaggccagaaattttcttcaagccaatgtccgtaaccaatgtaaaagagagattgatgctctgcaaattccgtaggcctgaggagatatattagttgaagaactgttgtgagtaataactaaaaactgaaaccgcttgaactattcaaacatcatatattttttttaaaaaaaataaagtcaatggcactagcatttgtgcagaagattaaacaaaccagagagatgacgaagtccattgctcccaacttctgtgtctgaaagttccaagcttcttagtttcagaagtcctacagcacagagagatgtacaccaatgatttgagaccccaaaaaaaaagaatgtaaccagtaatacaaacaattaaaccaattaagaattccataaggaacaaagtatacttagtcaatgctaaactgacaattgcggactagtctggtacaaagcactaatactatatgccattaaacaaaagtaaactacgacttactgcatgaggcttattgtgtgattctccgccttcagtgttttatgaaatactagcaaaatgccagtattttaaagcccataaaaagttattcctattgtctaatatattgtcatcatgcaacttatgttgtcactttctagctttgtgcctgataagctagctgtagaaataggcaaagtcttatttcactgttggtgggtcccacactaccatctttcgtataagtatagacaagataacaggaaaaacaaagaaaagacatgacaactaagaaactcacctttcaaatgtgctagcccctcgtcaccaatcttgcatgagtccaagttcaaacactccaaattgatcagttctacaagaacagaagaacatcaggaaagctccccacttcatgtgttaattagcatatatagtatataatgatgtcagacttctgacatgtttccagaaaaatcaatacaatcaagtgggtacaccttccacttggtgcggcgtaaacatatatattgaacaaaaacaacatggcaaaagtgaaacaaaagcgtattctggtatgcatctagtctcatatcatcggcaattttaatgacagaaacaagagaatactggtatattaagaaaatataagtgttatttcttgagtaatagtgatc

SEQ ID NO: 17427 - DNA, 4563 bp, Oryza sativa
aaacttttttgagaatacgcacaaaagccttgtgcatcttttgtattaaaagaaagggagtttttaaaactttacaatcttccgctgaaaggaaaacaagcaaatgagaaagaaagaaaacacaaaaggcgtggggctatatctcgcaacaagtttggcaaccgtttagtgagcggtggctcagatgggcaggccagccacacgccagaccgctgcttcttcctccatggccgcgcttattacccccccccccccccccccgcccgatttcctctcgttgttgaacaccttattgtttctattaatgaaaatatgatctcaccaaacagggagcttgttaagtgttatgtaatcatgaaatagattacatcaaagagcagtacaccagagttgtcaaacatactgtacgctgagtacagagaaatatcttaggcaactaaagagttctataaaccaagcattttaatcgctagctgcgcaacagtaatatggtaagcctacccttcacagagaaatataggaccgaaaaaagaaaatcaaagtgatcgttaagtcgaaaataaaatttctttgaaaataataaaatgaaatcccattaccatttataagcaccaaaagtaataaaaaaatctctcatttacaagaagcagcataatagtcctatagtacttcctccgtttcacaatgtaagtcattctagcatttcccacattcatgttgatgttaatgaatctagataaatatatatgtctagattcattaacattaatatgaatatgggaaatgctaaaatgacttacattgtgaaacggagggagtagaagcaagacactctcaagttacctagccactttgtcattctcattcaacttgcaaagggaatttctaaaactttcatgtcaaatccaccagaagagatttctctggggataaatccatgaggtagttgactatatatagaatgagaaccaaaagaaatgtgtgaaatttcatgacatgcacttcttcaggtccctaaatatccatttttggtaatgaatttaatggattattctacatgagttctggcagatgtggcaccctttcaacagtcaaattaaattaccccaaggacttccctagaataaatgtaagacattttcatggaagcgtgaactgataacatagcactcgtatggaaaagatgcaaaacctgaaataacctccaaacaagcagcagttactgcacagccctccaggtttaggtgagctagcttcgatagacctgtaaagaacaaatacaaaatatgaaacagaggctaactttagatgaaacttcatgtcattatattaatagaaacaacgaattaatcagaatattacagatacaaatggatgtagctttaggtagataaggttccactggaaaaggaagaaatttatttctgggatacctcttagataagaaacaccaagatcacttattttgcagcaagaaagttgaagctctctcaaatttgtaagatctacaaggaaaagggtatttattagacgtgcagatcagtatgtgtgataacatacactgcttgacactagatggtcaacataaaggtgttacctgataaatgtttcatatcagaatctgtgatgccattacaatacctcaaatttagcttttccagttttctcaagcctgaaaaagaaagttattattggatctgacagaagtataattaaaatgtattcacgattgagtagcgtttgaacaaataggtagcatgccagtcttccctgtatttattacaaagaaagatatataaaagctctggatgataaatatatctctgtttcattggggtgtagggtgcggggaacacatggtaaatgataaaattagatcatgcatttataataaataagttggctgtggttacattgtgatgatatattaatgaaatagcaggaaaccttttaaatgaacaagtccaccatgaatcttcggacatcgctcaaggtccaagctacccaaattaaccatgtttgcaaaggctttagctccttcagcagtaacagcagaacattttttaaagctcagggatgtcacatttgagaggcctgcagaattaaaaagcaataccataaatgacaggaacagaatatctagtgatcaggaacattgacaccactcttatcatagagatggaagaaaactcaactctcaggctatcagaaaatcactaacctgacaatgttttaagtccatgctccgatatctgatcacagtaattgcatgacaaactttgcaagttgatgcaatccttgagttgattcagtccaccatcagtcacatcagagcaagagatatcaacagataacaatgattgcccttgagaagccgctacttccatccaagcatccctcaccccagggtagtctgccaaacagatgtcctgagaccaagtagaagaatagcataggaggtcaatatctagtctcagagtaacttatcccagaaacaagaaatactccaaatttggtcctttctttatgtggcacacaagtaaagcgattgcttggcttgcttgtagcaggaagatagaagcatcatctgagttacacagaataagatagcagctgtgcacgtgagctcaactggtctattagtatcagtacccagtggaggcttccttgagtggattttcctcaattgcttacaggataaattttaccaacacattttagtttactttcctgagttagcttataaaaataagctataaaatcgtttacaacatagtaagaattgttccaacaagatgcctttattcgttccctgatactacattgaaagttagaaactgctacaagggaatgtcaggattgcattccatagagtttgcaataattccatattgattttccttgtttagaattgagtcatttttttcgcgaacgtgtttagagctcagtcataattacgtgccaaacaagatcaagcacttcacctgcaatgcacaatcacgaaaagctccaagcaactcttcagtgagaatgttccactccaccagttcattaaatacctgctgactaagatctctaggcagcagcgagaaatcagaatacttcccaatatcctgaaatcacccctcatcaagtcaggcaacaatacacacagaaaactcaatcatccaaggccacaagcactacctcgcggactttggccacacagagctccattagcgatgggcaccgcacaggcactggtccctgcaccttcctgtgtacatcagagccgctgcggggcaaggtgtgcagtagccacttgaagctgctgctcttggagaaccttgcactgtagagatcttcctcatcaacaagcagctggcctctcttcctagagcaagcacttcccatggcgacgatgcgagcaccgatcacaaaccaatcacttcttcttgatggactaaaaagcgcatatcattctagctcgtgactgtgtgattctttgtcatccattcccagcacgattacgacttggcatagacttcgctctctttggccccattctgcacatcaaacaatcgtgtaaattgacttaaaattatcagattatatacagatactgccaaacaatactaaaccccacgagtcctcagtttttggtgggtgtgttcatctttcacgcaacctaggctcttacaataattacggattgctgccaatcctaagtgcaatccaggaaaactaacagatgacactagctcaagaaaaatgaaccatgtcttacgaatcaaagcatcaaccctatctacgtattatcaaatcccccaaacccctaatagttcagtcactgtaccctactttcgattgttccacaccctgttctgcaaatcactccatcaagggagaagaaaccgtaaaattaaaaaaaatgcccaaaattccaacccagaataacacataagcatcgagagagtacgagttgggcagatcaacacgacaaccaaccaacccacccacccaataaaatcgcaacagaattacacagaatacggtggtggagaattacccgattggatatggaaattctcacagggacgcaaatccaccaaaccctaggccaagcaaactcccggattagagttaaaccaatctatcgcgattaaattacctctaatcacacagccaatcctcgccgagaaagagagaggggggaggagagggactcgagaaggggaaggaaaggtggagaagaaatggtttatagcgagagatggagcaacgtgggagctccacgtgtcgccccggaggcccgagctggtacgcctgccccgcagactctgtcactgacatgtggggtaggggtaaaggtggccaacgttgtcagtgggtggagtgggtaagaaggttggtggcgctgtgggggttggggggatgggggccacaggggagtggaagggataaggcaaaagagtaccgggcgggcgctcggcatcccccggattgtgctgccggttttgtgggcccgcgactgttggtccgttctgcggcctacacgtgggccccgcggttttacttctactg

SEQ ID NO: 17428 - DNA, 3508 bp, Oryza sativa
tttagctgggaggtgctgtcttgtaatacaagtttagatttgttactatgggctggtttggttttgggtctaaattggccttaccaatttttatcaatgtcaaattttgtcaacttttggcatggctaattttggcaaaggtaaaattgtgtttggattgaaaccaaaatagcctaaattaactgttgaaatggcctattttcttaggcatgccaaaatttggctccaaaccaaatagacaataaacactattgaaattgacaaatattggtaaggccaatttaggcctcaaaccaagccagctctatattaggagagattatattagaagaggtcgcatacccatctagattgaggtcgtgtttagttcaccctcaactaccccaaactttcaactttacatcacatccaaaactttcttacacacataaactttcaacttttttttttccaaacgttcaactttccccaaactttcaacttttttcaggaactaaacaaagcctgagtaattttgggatggagggagtatgtctgaaaataactttattcttattttcctttttaccactggtttgtatttttctattactttagtgctctttaccaatcccttgcctcttacctattcaccattaatcctatcattttattaatatatgcttgcttcgttcataaagaactaagtataatatgtgacgcatcctattaattaagaaagggagactaccttatcgaggacggtattgtttctcggagtaaaagaaagctagtctcggggaaggtatggttgcttggagtaaaagaaatatagtagcaaaggatagttggttttgtgcgaagaaatagtgttttctattttcaagtgagagaaggactaccttaccttggatatgttaggatttctcttagggtgtgtttagttcacgttaaaattagaaatttaattgaaattggaacgatgtgacggaaaagttggaagtttatgtgtgtacgaaagttttcatgtaatagaaaagttggaagtttgaagaaaaaattgggaactaaaccaggcctgagtaaaaaaaaaaaagcacggtgctacgaggagtggccttgtttagttcccaaaaactttttcccaaaaatatcacatcgaatatttggacacatgcatagagtattaaatatagataaaatgaaaaactgattgtatagtttatatggaaatcgcgagacgaatcttttgaacctaattagtccatgattagccacaagtgctacggtaacccacatgtgctaatgatggattaattaggcttaataaattcgtctcgcagtttctagacgagttatgaaattagttttttcattcgtgtccggaaaccctttccgatatccggtcaaacgttcgatgtgacactcaaaaattttcttttcgcgaactaaacaaggccttagagtcacacccaaaatcgaaatgaagctattttgggatagagggagtaaataaactccatagatgttgcctcttatttcggggtattttggtttagggtagtgctaaaacttttggtagttttccggacgtgtttatagagaatgagcgtgtgcttataaaggtgagtgagagcatgtgtgtgtatgactatttgtacttatactatgttttgaaaagaaaaacagtggtgttaaatcttaaataagtttttgcattatcaatatttttggtatggtggagtagctttactcgaattgattgacaacttttgatatcatgcttgtttactttattgccaacaaagtaaaactgatcatttgtgagtaagacgtaagccaaagattggtaatgctattgttaaggacgtatctacaacgagaccgttctctatatagtcataaccaactaactcaatctcatatctaattgctactagtatactcaaaagtgcatgtatttttttttcttatgaaattttctcttagattagtcatccgatttacgatccaattacaccattatgttcataacaattaaatctttataacaagatctcacatgactatatttttatgaaaaaatacaaattacttttataatatatgtaaattacttttagattacattaaattacttcttagtcataaaagtaatttacctatatatagaagtaacttaaaaaaagtaaagtaacttgttacgacattaaaagaaatatatacattcataatgttattcataatattgtgagttgtttgttttacaatcatttttagtcagtgacgtaatttgtgccggttaaatttaatttctatatagactcatgtttttacctccataacggatttaattttgatgtcgtgataaagttactttctttctgttttaagttacttttataatttatgtaaattacttttagactttactaaatttactataatatgtctaagtagtaatttaatgaaatccaaaagtaatttagatatattataaaagtaatttataatttttcatcaaaatataatcatgtgagatcttgttataaagatttaattattacgaacacaatcacgtaatcggatcatagatcggataagttatttaagagaaaatttaatttgaagtataagtggttcctatttgcttgaaacataggggataaactactctctctctctctagcgtagtagagtgcgtcacatgctttccgatttggtctgttctggccttcttggcaatatcggcatgtggaacagatcagacgactacaccagcgtgtgggatcggacggtcctagatgcgtcgcgtgataagaccagatcgagaggcctctcgacttagattttatgtattgttaagttccgacaaggttaaaaaagtaaattaaaggtggtgttgagtcttatatcttattaaattttggtgtagtttcgagagtaaaaagggtatggaattaccaaattttgattgaggttataacgttgcaatagtaaaatctcttgggtgtgttctcaacttcttctctctcgttttcacacatagcttcctaaactgctaaatgacgtgttttatttaaaaaaatatattaattcatttttatatacaagagagaagttcgtaactttgtatcccgaacacaattagacaatggagcgaacaagcacatcaatccaaaatgtagaccattctattaatgctattatattttaggaatgttggattcaaaccaaatagccttcaccgttgacccagtcgggaacccaatagcacacaaccaccatcaacgtatatacggtatattcgacccgtcatcatgataaaagagatcattagtctggcatttacgtaagtattttttattagaggaagtaacatacattggtggagaaaccatctttggtcggtcaaccaaaattcataatagtcccggttccactaaaaactgaaactaaagatgatctttagtcccggttccactaaaaaccgggactaaagatcgtatgttgtcaggggctgtcaggc

SEQ ID NO: 17429 - DNA, 3273 bp, Oryza sativa
gaaaaatcgggactacaaatgattaccaatcgggacaacaaagcgtttctccaccagtgatagaccatgcttacatttgtcatacgttccatcataatctactaacgaattaacggagaaaacacaactatcagtaaaccaatttatagtgttttggcacaatttgattttcttctcgatgcaagggttagatacagatttgaatcaatatttatatattactaactttttaaataacgttttaccatttatcttatttaaaaaattagtgtaatttgctaaactataagtagtacttaaattttctataatgataaaagatatcacaacaaaataagtaatattatataaaatattttaataaaatgaatgataaataaagttaacgatattatctattaaaaatggtaggagcagtacttgggccctgatcttttctaaccctaaacttcaatttcctcccttttgtttttcatgtttcttaaacggtttaattgatgtgtttttaaaaatattatatagaagttgtttaaaaaattaaattaatttattttaaaatttataatagttaatacttaaggtttacgcatgtagaaaattttccttatatttaaagcaacgaacggggcttaagaagacaagaacctccatgccattatttgttgaagaatttcccaataactttcagaggaaaacaaaaacgatgaaatttcccatttttcacgcttttctaggtgatgactgatgagtagtgcagagcacctgaacggaaatctcccccatatggtccggtcccgatcatctttctgaagactgtaggcgctgccgctgacccggacggcgcggtctccggcggtcgattcgccgccacgcaacgcaaccctccctccctccctccgccgccggtcaaacctccgccccgccgccccccacccgagcagcggctcacgcacacacatcctcctcaccaacccacccgcaccgccgctgacgcgtgggcccccgagcccacctgccagcagaggccggtggcgccaacgatatactagtataaaatatattcagctcgtcggcgtcgtcgtttaccagtcgcctcgcctctcggcgtcccggtcgtcggtctccgctgcctctctctcttctctcttgccctactctactactactaccagcagcacacggtttccgtgaccggagcgcgcagcagccgcccacctaaaggctaaagatccgatcaaatcgaagagacttaatataccttctttttttttcttgagaggaatatttttttttcgctttaccatttcttcgtccctgggggattttcggggggattctgaggagcaagaagcattcggccgcggcgggggtccggcgctaagctcgagagattcttctccggtgagtccttttgctttcttggagctctatcctgacgcgtggtgtttctgtggtggtttggtgtaatcgttattgcttgtttacgcggttagattgcttcatctaaaacaaggatggttttcttgcttgatggtgtggatggcaaaccgtaggaggtttgtcgcatcaccgatcgcagatgattctaccgttgtgttcttgggacatcgccatgggagcctctgtggtagtactagctttcttgatggttaccctgtgccgtcttgtatgcatttttctataatggacagtcacctcgcgttaagattgcgtgttagactttctgaagctctaattttgctataatagcgaggggaagaggggaatacctcgtttggtgctgttctccatttgcgggatagctcaaagtcaactctcagtcaactcatttctttgcctgctttctgtacacatgtgttcgtctatgttataatgatttggttgttcaacaagttcattaattgggaccttatcggtggtgatgtgtgtagtaggagtgctatgcgtactacatagcacgattttgcttttgtaatctgcattcttgttgcatgcattgctcagttgctcaacaagatactcgctataaatatgtagaggtcaaagactggcacttaaaatgcattgtgcaaggcatacgccaaaaggaagtctacctatggtttgggagataattcattcatacaaagtgtaactaatattgcaaaatagcatggatgtctagaaccgaattattcttctactagatggtaaattgttgttccactcattatgaatcttctgattacacgtggagaagctgagagttctcctttcttgattgatcggtgcatattttggtgacaaatatgtctatttctgctattcattttgtactaatgtactaccgtggactcatgttatcgctcctcgtatatcttttagtggcattctttccaaaatgctaaactgaatgcttcgatctttttgcagtttggattgcacttgtcagagtaaaagggctaaggacactatgctaatttaagacatctcatccaaatgaggcgcaccacacttctttgttggcaaactgaaatcagatagcattctggtagccactaaacctacagggatgtttcttgtgtgttttgaagccatgtgcccctgttttggttcaagaaggaaggatgggagcgaagaccctgttcttggaagggatggaaattcctgtaagttaaatagcaagctttcatctattggtgatctaatctgttaacacaatgaaacaatgtagatgtcacgtttggaagtataaatgaccatcatgaattgtgacacattccttcatccttgtttttccagtgaattcttctgagctgaggtcaatgtctgatagagttcctccaagccctcttcgagtacctgcaagtccatctagattttcattgtcttcatcaccaagtagaaatgagccattgaacctgagtcttgaacaagttattaaactgacacataactttgcaccagacctgatgattggtgaaggttattttggaaaggtctacagagcacagctgcgagatggccacattgtggcaattaaaagggcaaaaatggtaggttttattttttatttttatttttttaataaaaagcagtgttggcgcaatgatagggctgtcaacaagcagctatactagagatttctctatttagaatgactgaggtgttttttttcaagtagtctcgctggttgatccatttttgtgtagatcagtacggtaatgaaacagtaatgcaccggtaaagcatgtactcacattgcattctttgcaccagtagggctgcaggaat

SEQ ID NO: 17430 - DNA, 7564 bp, Oryza sativa
ttcctgcagcccgtcttcatcaccaagtagaaatgagccattgaacctgagtcttgaacaagttattaaactgacacataactttgcaccagacctgatgattggtgaaggttattttggaaaggtctacagagcacagctgcgagatggccacattgtggcaattaaaagggcaaaaatggtaggttttattttttatttttatttttttaataaaaagcagtgttggcgcaatgatagtggctgtcaacaagcagctatactagagatttctctatttagaatgactgaggtgttttttttcaagtagtctcgctggttgatccatttttgtgtagatcagtacggtaatgaaacagtaatgcactggtaaagcatgtactcacattgcattctttgcaccagtagttgtggatagttattataatttggtgtttttcaccgcttgatcttgttggtcactagtcaaatttcttttgcaatttatatttattcaaaaggtcctgataaagtattaaagttgctgatagaaactctgcttcctacatgtgatttttcttacaagtgaatcgcagttttcatccggtttctttatgcaggaacattttgcctctttacgggccgaattcagtaatgaaattgcattactaaaaaaaattgaacacaggaatttggtccaattacttggttatatcgacaaaagaaatgaacgaatcgtcataactgagtatgttccaaacggcactcttagggagcatctagatggtaaactgcatactaagattctcttttgttgaattccatatagaacaatcagtaattttcaaattatctttcaggtcaacgtgggcttgttttaagctttaatcagcggcttgaaatagctatagatgttgctcatgggttaacttatttgcatctatatgcaggtatgctttgtcacatgtttctgttgctgagcataaaaacagtttaaaaaaacaactgactgttatttttatttttatttttataccaagtcatgcatcggggtattgtcactaagtaatgcaagaactgtaaaccagtattttaactatattttccccctctaaaggttggtccattggctcataatctgctaataaatgctagtatcagatatcctgactgtaatgttctgtagttcggaaattgtttgtggctgtgcatcaataaaggttgtgaaatgagcctaacaaccaagttgaataaaccatgaaaattagccatgtaatcagatgtgtatctgattttaattctttgatcttcaagctttaaagtagcttacagagattctagtttgactattcctattggcaatttgcatatgtattttatttatttgttctgtacttttatgcttttagagaagcccataatacacagggatgtgaagtcatcaaacattctactaaatgaaggcttcagggccaaagtggccgactttggatttgcaaggactggtcctacagagccagaccagtcacagattcagactgatgtgagaggaacagctggctatgtagatccagagtatctcaggacaaaccatctgacagtcaagagtgatgtattctcttatggagttttgctcctggaaattctttctggtcgtcgtcctattgaggtcaggagagctgcaagagaaaggatcaccgtgagatgggtatgtcttcacttccctactttgtgtttacattggtttagacttttgtttctttccattgttttttctagataactatttaggagcaatttacctttgttctggttattttcttgcccccctgacccctcttgcccctgcatacgctcttgcttttctttctcgagcagttatctgcacatgaattcattttctttgtcgacaatttgcaatcccatcacaagttaaaccatacaacatgtaaacttccagtgtgcatgcacaaacataacaaaaatataatattttctaaacactcaacattttcatttacctgggaagaaaacaataataagcttgattcattttctatagcagttaagctgtttggtcatgggttttgtcagaatttaaggcatctgaggctctctattgttttctaattttgatacaggccttcgagaaatacaacagaggtgatgttaaggaaatattggatccaatgttgaccgagtcagtaaatgaggatatactgaataagattttcgatgtagcattccaatgtgttgctcctactcgtgctgacaggccaacaatgaaagaagttgcagagaggctgtggaagataagaagggattatgcaaaaacccaacgcagagcagaaatggctctgtaaaccatctgatcctagcttctgcttttactcgagagagcatttggtgaactcaccagtgtccagcaaagatccacaaaaacaagttcagttttgcgaatcgggacaactaaaatctatacatggttgcaggattattatatgcgctgtacatggacttgcatgtttaaaagatcaatatgatgtacaccgacatgtgaatcgaagttttccccatatagcctttttgctctatccaagctttcagtaatttgtgtctcaaggaagtgtgaatggtcttgttttgaagcctttcaacactcaacagttcttgatacagctttccgttcttgtgtatattttgctggtcctcctagtggtacagctgatctttttgtcatgttcagtgttgctcatgatgtgaggtgtttttaagtgtaattatggcttttgggatgctatgttgtattcgtgtgctgtaaccagatcttaaggcaatggatgtgcattaattgtgattttttaaaaacattattttcaaccttttacagtccttgaagatgtattgagagatataccgcatttttgtagtgcataagcattttttatgctgcacccaaactattttcgtacaaagtttgacaaatctatcacgttctatatattggatgaagcctggacaggcattcccagttcagtttccctaacacggcttcacacagtccatgaataggcattctcatgcatgcttgaaaaactggccaattgaaggaaattgctctagtgccaaaaaaaaaatcagggatgagtcaaggcataataacaaccaggatttccaacagtgatgaggatctcacctgtggacctattcgccgaaagttgatggcactgtcttacattgctgactatccctgacaataaaaggctgtccagttctggatttaacaattcccctgtttagttgacacaaaacttcccccaaactcctaactttccatcacatcacatcacatccgaaactttcctacttatataaactcccaactttttttccaaactaccaactttccccaaacttctccccaatttcagaaactaaacacagccgcattggacgccagattcttccttcatccaacaagctcttccatccattcattcctctgaatattttagtttgctcctgctaaaatggaaatattacagcagcatacaagtggaaaaacatcgttaaaggtggtggtcatggataaacttcagaaagtagtacattcattgaaacggtggtaacttacaaggaaccatctggcttaaacgttcaattgcataaagcttcgcaagacatcctagtgtacagacaaagctctcaagtctaaaatttctccgagggattcaccctcatatatataaaccctgctagcggttcatgctctagggaatttgtacaccggaatttgcctcctctctaattctgtatcctaaactaccaaataaacctttgtgtcccaggctcatgttgccactggaaaggtctgaacagaaacattgccagagtgaagaagtcaacagcggcataaagaaaccccaaagcaagcaatttaacattgctgatcactggagaatgaagaacagtatgaccaatggaattgtatagtatctaaattcaaccaatggggcagggatgagagcaagggcaactgatagaacaaaggacagcacccaaagtcttgtctgtgacttccctgtaagatgaaacaaaaaaatccaataaatatcagttcatatatactctttaaagtagcaacttctacaaaatttatatagagaagtttacctaagatattaacaattgaaaaccatgagtacacataaactggagtcaaaatgtatttcatcatccagtgaacttggataaccttcctccaaatataaaaggtgtagtgtctattgtcagcaagaagatatggatgagcaatgctgcacaagaaaaggggtacatattaggagttggtaaacataagaaggcaaagtacatcatgctttaagaacaacaagaaagtgcagtcaaggaatttgagaaatatgtttgacaaacatgcttccacaccaaaatttcaagcattataaaattgtacataagctgttactctccagttagattcagtgttgtttttaacgaagtatgagtcagcattggaagatgcacctaaatgttcagcaggaagtacttttagcagtttctgggagaaaaataacacagaagagggaaagagataccaaacctgaataaatgtacagcaacaaggcttaaaccaagagccaccaaaattgcaaaagaactatatgttttgttctttctgcaccagtggaataggtctgatgctcgggtaggagtaaaatgccatggcaggagggcagcagctgacactagaccaaagtacaaaaactgtgcaaagtgtggtgaaacaacatgagcttccttagcacctgcatcactcaaagcacaagggtgtatgaagctttttgtagatcattctgtaagctgccagcgtacaaaggttgaaaggagctgacaaaaataagaaatatacctagcactatgccaccattccagactatgaatgccacaaacaccaaaagaaccattgcaaatggtataaaagcaattaaaacttcacactttgaattccataacttgaagatggcatcccatatttcctctgtaaaacctgcaaattaccaacagacatcagatatggcaacaaaatcattggacacgaaatttgagatcatatggatgcgtttaatttccacctctttttccaaaataatatttcatcgcattcagaatgaattcatatgattgataaagaactacagctagtgttctagcaatataaataaagaaattaccagtgaataacaaataatgtttagaccaaagcataataaaaatgtcaaaacgaagttaagcatgcaacctactgaatctcaaacatgaaatccaaatggttggagaaatataaatgcatctttttaattgacagagttggaatactcactggaatacataatgtttgattcagaaacaacttctctcttgtttatgggattattgtttcgccgccttctcaaacctggagcagtggttttattatccatgtgagatgcctctttgtttgacttatctgttagttcactgttctcgtaacaaacattgtccttgacataaagatattgtgcatgagcgatggctccattggcagcaaaaaatatcatccatattacattagtctgccggagaagtatagaaaaagcaccaaactgcaggcaaaaggaagcatttaattaatattgctaacagatttgtgatgaaaatcaataccatatcttaactcatgccaagaagtatggaaggacccatagaaaacctcaagatcaagattacatatttacatgaaagaatacatacaacagctataaagagttgttttcttctccaaaattatatcaattctggaactagaagaaccaccaacaagtatgctgtggaaaacagttatgaatgtacgactttctacaatctaaaaaaaaacttaagatgtgaagttgtgaacaaaacaaataaacaatagaacacttaatttaaatactcaccgctgcactgacccaaaattgtttcttcaagcagaaaaggtacatcgcaagaactgccgctaatgatgcaacatcagtataataaaggaaagtaaagaaccaatgaatagggtacaaagctactaaaatagcaaatgcagttgccttcctcttgccaatttttggcctgatgcacaaaagcaggtcatggactagaacaccacagatcatcgccatgataacattagtggatctcagaagtgctgtagtgcaaagggcatcaaatgcctctgctattctagtcacccatgcaccaggaaacaaggaagcaacatatgctagtgaaatgtagtacctataaaattgcagagaacaatccctcatcacaaggtaaaatttgagggtgaagtaatgaggagttttgagactcacaggccaggaggggtggtgatcatgggatcccatattaagaaatctccacggcaatagcgctgcacctggggaacatggaagatctcatcctaaacacaaagaaatgagttaagaagggtaatgaatgcttttttgtcgtgcttccaaatgctgcctacatttccaatgagaatgtggcaagatgtgacaataagtgcaaatttagtagagtaactcgaaagcaatacagggaaattgaaaatgctcaagaaattcaacacgcctgcttgccaaattttataacttccagagaagtccatttcctggacagtagagaactcatcaaactcattactacaaaccagatactaatgttctctccacatgaaaagaattattcaaatgctctacctgatacttttatagacacacatcaggcgatagcctagttgcaatttcagatccaagagtctagttcataagtttcatatgcggtttcttccaattcattctggactacatggaaatcaagtaagacattatgcagatctacccctgaaactgcactagccaagcactcgtggaggaggagaaaaaacgctcaccatgtaagggtcgggcacgatggaggcgaccagagcagcgagcgggatcgcccatgcggccactgccgcggcgacggtcagcctccccatcccccacccgtactggctcctccccgctgcgctgcgaaaccccgctccagatccagccccgcgcgccccgggagcacagagcttaccaccaaacgaaccctgagctcgtcacgacctcaccggaggcgctccggtaggccttggcgctggggctcgggagcagtttcccggagtcgactgacgaggtgcggtgcagcggcggcgcagtacaactccctcgccggagagagtctcgcctcggcgttcgttgcggttggtttcaggctaggctgggcattttgggccaggcctacgtacgaggcaggctgcgcaaactcgccggcccagcccagtagcccgaaaggaggaagagtcgaagagagtgcgagactacgcgagtctctccgatctctctcctctcccccttggctctgatctctcacccgagatccgagcacgaaggcggccgcgggcggatccggcgaactttccaacgccgtgaatcgccccctcccacggtgagcg

SEQ ID NO: 17431 - DNA, 2198 bp, Oryza sativa
cccgtgctggcgcaagggcttgtcattaggaagaggccaaggaagaaggaaccatgcttggggaggctcatggggggttataggaggaagcaagctaagctgctagatctagtgatgcctaaggagggtgaaaggggattgtagtttaggggccagatctaatgtgaatccaaaatgggcgagagtaaatgccgatagtagcatgaatacagcacattggctagttcagcttggcccttgacccaggaataattttgtggagtgatctaatgtggaaatggggttaaatgagcaacatcaaaccaatatttgtgttcaattgcagttggagagtaactagtccaagtgttggtggaaatggcaagcacggcgtgcttcgcgattgttagtaagaacgacatcccaatctatgaggcagaagtcggatctgcaccgaaagtatgtattccacgcctcattacttctatgaatttaattaattgcattatgttgctgtttatagtgccttgtgttcaggtcacaatgtcaacattttggttttgttgatataaaagcgacactaatatggaaatggataatcccctctctcaaaaagaaagaaagaaacaggtgttggttgaacataaatcatgttgaatcagactcttgattcccatgaagatgcccaatggaatagttgagttttgtataaaactggatatagatggtttgctacctttctacagcgtagtgatttttgttgttgccattgttttcctccctcccttgtctccattgttttctaggatattgattcatatgtaatagtgtaaagttgctaattgatattcagtaatataatggagccttcatgggatgagaatttttttccttaggtaacatcatactgaattactaatgtgcatgtctaatcttctgacattcacttactgtggcagaaagaagatctggcttatcagcaccagttcattctgcatgctgctttagatgttgttcaggacctagcatggtccacaaatgcaatgtgagtatttattgcttatacatgtttttttttccgtcaggtacacctgaacatgtgtattgtaatttggttgtaggatacatacaagatacgacaggccaaagatgcctttcgaaaacttttatatatatttcccttgcataattcctctacatattttattcaggttcctgaagtcggtcgacagattcaacgaccttgttgtgtctgtttatgtaactgcaggtcatatcctttgaaacgatttgttgttgttgtgtaacttgactgactatgtgaaacttgttaagttttacctgtacaacaatattgttttctttaacttgatgacacatgctagattcatgttgcttcatgattcacgtagtgaggatggaattaaaagcttttttcaagaggtccatgagctttatatcaaggtaaggcaattttgtgtcctttacaataaagtagtttgctaaaaagttatgaataacaaggatcctgtcagtgcatttcatatctaaatatgttgaatcagttatacgttcatatgccaattctcaaacatacatgatattagggtgtagcatgttctatgtatgggcatagtatccaaaatagttgttggctgacacagagttttgtagtttctgctgtccacaatagattctgagaataaacctataatcattgctttcgttacataattttcattagaaatgttcgttgtgcagatattcctcaatcccctctatctgcctggatctcgcatcacatcctctcattttgataccaaggtcagggctctcgcaaggaggtatctgtagggaacagtcatggaggtactataagcttcacagctaataatatagaagcatgcagagagaagacaaaatacactacttttttttcttccatttatttcctgctgtcattattcagactcctgagaaatgctgattgtttttctttgggctttctccagtgcttatgaaacatgatttcaattttcacccattttgttctgtacagggaaaatctataaaaatgtaccgtttcccttttaccgtatagcatggacacattgtattgatttcctgttttctgtggcgcgctaagacactcaaatttagtattgtgaattttactcctacctctcatttttgcattggttggtaagatcttacctttc

SEQ ID NO: 17432 - DNA, 1816 bp, Oryza sativa
gataaacatcaacagcgatcgatgcgtgtgcggtgtgatggtgcgtacggccaacatcagtcgacagctgattggggggaggagaagatctcgggagcgattctgggagcacacatcctctgacgagcctatcgcagcctgtcaggttagtactaccaaaacaaaaaaaaagtctctcgagtttatctgaacccaatccagctctctgcgtgtgtgttaccaggtcaatcaggagatgagatgctacacgaccaagcacaccctagctaggctcatcactgtcacctgacctcactcactggactgagtctgaaactacgtggcctttacgccaggagggattgattgattaatcacccgggacacacacaccatctcccctgatcgattcggctaaactccagagctttggacagtgcaaagagagatcccagaaaaaagcgctcgccgcggccgccgtcaactgctaataataacaagggctctctcgcgctcggtgccgaatggtgtcactcgcatgcatgcccccgtcgccctctcgctttctcgagatcttgttatctagctcgatgagtacgtgcattatctcctcttcctcctccccctctcgccgcaagggacccgcccccggctactaccaccgccctgttgagtttgctaaaagaaaatttttagatatcacatcggatatttgaccggatgtcggaagaggttttcagacacagataaaaaactaatttcataactcgtctgaaaaccgcgagacgaatcttctgagcctaattaaaccatcattagcacatatggattactgtataggctaattatggattaattaggctaataaaattcgtttctcgatttccatgtaaattgtacaattattttttttatctatatttaatgctacatacatgtgtcaaagattcgacgtgatgtttttttaaaaaaaattaggaaccctacaactactactaccagcgaacgtatcgatcgatcgcactgagaaaacgctaggatcacacggcgtcccggccgttttttttttctctcttttctctcgcgcggggcggtgcttttcgagggctaagtcgctgttagtcaaatgctgccatgccatgccaactgccaaagccacttgaggccgaagagagcgaccagtccacccccgggctgtgtgtttgcagggagatatctcttgtagtagtgcagccaatcatgctggctaactttgacggatatgggtgcagcgtgggggcgagaggcagtcttaccggccggcacggtaagtgcgagggagtcgttaatgggacggtcgtcgatcgatcgatcgtcgtcgccgtcagtggcaatgggctttggaccattctagggagaattttagagcgttgttacgagggtagctataggatggtggaactaaacctttcgagcttttggatcataatatagttttagtgctagacgcgacttaagctagcttgagtcactgtagtactgtactgtatatgctaatggctatgtttgggaagcttctatcaacagcaaccttttgtagaatctccgactctcctaaacaaaggcgagtctagcatggaggtaatggagtctcgagtctctactactagcgtgaagaccataaaagctctgtaacaccctgaaaatttgaccaataaaaacaaaactctaaaaatatgggccttcgaaaaattttaaattaattgcatcatgccgatcttaatcgcctattttatttggatttgatttcaaagttcattaatcgtgagtaaagaatagttaattaggaataaaacct

SEQ ID NO: 17433 - DNA, 715 bp, Oryza sativa
cgatcgtgttcacatgttgatctagtaccggcgttcatgatctttcagcaaaagcgatcgaatacgatggatgttacagttcacgaccgtggtggtcgcgtcaaatgtgacaacgaactctcctcccgtcttgacatttgaagcttggaccagggcctacctgtcactcgccggcaatgtacattgggggcgagccctgttgctatccgtctctccatatgcttggaacccgtgggtttgcaagcaactagctagagagcaagtttactagtatagccaactattaattttaaataatctatagttaattaaatagacaattcacacaatagttatatataaacatatactacactattaatacatggtcccacctatcatatatacactatgtcttaagtccgtgctgtaactggttataaatctgtatcctactgccctcttctctcttctcttttatctcatcgatatatgtttatagctgatttatagtctgctattgtacccctcctagtactaatataaaacacatatgtagaatacctagtaatattatattccctctatttcatattataataactgctttaacctttttaagccaacgttcttaaaggttgaataattttaatagaaaaatatagtaatacttgtagcaccaaattattacatttaacattgaacatattttgatattttttgggctgcaggaatt

SEQ ID NO: 17434 - DNA, 418 bp, Oryza sativa
tctcatcacagagagcattcatcacagagaacaaagaaaggaaaaagaaagttcacatctacaatatcttcagcattcatcagatagcacagagaagagaaaaaaaagttctcctgccgccgcctcctgaccagcgtcggccgccgccatcccgaccagcgccgaccgccgccctcccgaccggcgccggccacccccaacgcagccggccgccgccctctcaaccggccccatctcgccgtctcgcgcccgacgcagccagccgccgcttcccgaccggcgccggccgccgccgcctccatctcgccgccctgcgtcgggccgccggcggcggcctccatcccaccgcccgccggaggggaggagggggaggagagaggggaggaggagatggggtgagaaaagaatgaagagaagg

SEQ ID NO: 17435 - DNA, 32036 bp, Oryza sativa
  unsure (1)..(32036): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgataggatgatgagtcgaacgtgattgatcgttccttcacaaaaaacacaaacatacatatcactatatcagttataagtatttacagtccgctgagaagagatgccatgccacgcagatggcgaaatccccactcaaacagtaacaatgatcgaggcgctcacctgaaaccgcgcacagatcgcgaaggctagggcgagggcgagttggggatcagcttgatgtgtggcgcggtcgtcgatcaacttggcgagggcgaacacggcgagggaatcggcagcggaggcggtcgagagctggcggcgagggcgtgctagggctccgtcgtcggggttgccgtcgctcggaggttgcggggaatacatagcttccgcctcagcgcgcaaggaacggcgaacggcgggcggcgggcggcgcgaggaggcgtccggcggcggcggaaggcgagccgatcgaagcgagcaacggcgaggggtttaggagctgagggacgatgcgtcgccgtcggatgttctgattgtgtttaaattacggatgtgtagctttaggattcggacagtaagtaccaaaggaaattgggtctttttaacgacaaaattctagatgatcgtggattatgctttccttcttgataataactttatgcaacttcatgacgccaaacgcgttgctacagaaaattgtactatgaatctatattggttaagcttcttgatgacatgccctcaggcacgagcgtatttaaacgatgttaatgagttgtagttatgcgcttgtttggtttagagctaattttgtcatttaccttatcaatattttggtaaatacccaaaccttggaaaattttgccgctactaaggtactactatcaatttgtaactgtgtgatcaaaattagcttccatctaaacaagcactatatattagctccaatgggaagtatcgagccctaacagttgggtgctaatagttttcctccagttttctaaatagggcaataacactataatcctcttcaatagctttcacttgtgcgcttggaatagttggatcatatgacaaaactgaactaatacgagtatagaagttaaaaaaggctcaagtttttatttgactactttctaaagacgaggatgaaaataatcgtttcttagtttaatatgaaaaatagggcataggaagatctgactctatgggagcccaaaaaagaagttaatttagattatctaggatattgtaatcaacatagcaaaatagttttatagttgtcgatatttcagtcaggagagccttccacgtttgatttctcatgcaaaaggcataaagctggatgcatggtgtcgttccttagcaaaactgcttcgcgctataatgcactgccgtctatacatatacagcaggatgtcacaccaacaaaaactacaaaactgaagggtacacatgatcataatcatgtccatcttttgagttttgatgttgatgaacattttattacttcctaactcagttgcacagtccagcctagccaatcttctgcctggcccatctgcaggcttgtcaatgaagtatatagctgctgagacacgacaccaactcctttgttgccagcatattcgaccctgcaacgaaaaatccattgcatagtatgatggaacttggaagaacaaactttctctgacttcggaaattttaccaagacaagtccatcttagtaggagatccaacaaaaaaggttagccacgacttactagccactagtgaataatatacacctttcaattgtttttatatggctttagtggttcctttattcaagcaacatggggtgaagaattggctaggtttcggcccattaggtagttcatatggcttaattggtgatttatttgaggaacaatacataatacgggtgtaaggaaaggaaacaatttaaattttgacttttgactacacatacagcaaacggctgaaatttcaaggaagcaatgttctaaaagtcagcactgggtgccacctaggagcctggtagccgccacaattaggaattagatggtgtattagactgttgaatttcttggatggtgttctgttgctattttagtgttatattgtctaattttcatgtaatatgcttgctaatttcttgaaacaatgcaaggaaggataagagtatcaccttttcccttgataggtaatactacccacaggagacactacgacagcagttcctgtgcagaaaacctcatcagcttcaagcagctcgtctactgacacaagtcgctcctcgaccttcaagaaacaaaaaaacattaatagaagatttcccaaaaaattgagaatagatgtaacaattttcagtaacagattgagaacagtgttttgctgcttctaattggatcgacatcgctaggaaaaataggttctatcttcttcaatgtagccgtagctcatatgaacctaaccatgaatataacccttggtagattgaaatatagataacccattgttaatattcacagcgaacaagaaggatgatatggacaaatagaaacatggacttggatacctagcaaatacacaaggatcaatgttgaatacctaatgctgttgtcaaagatatcaaatcacaggctactaatttgagctacactgaaagtaaaacatcttgcttgttagttcatgggattgatgattaatttacctggaaacccttgctcagagcaacatcaatgatacttttccttgtgatgcctggcaatattgttccttttactgctggagttgaaatgacattgccctggtgcaaaagccaagaaaaataataagggtgtgtttagatggggaactaaacgggccctaaatagatctcaagtcaaaagcagcatgtataagatattccttcaatttgttgactatccttatgcaaaaataagcaataaatgttttgtctgcaatggaaatacaaagtccaccataaactaaaacaaatacaacaatagtttgccattcaggatacgacacagacaacctggctgaacctaataggtgtagaacaaccaattgttagtacgatattatcctatagaatagtcatggcactgtattgctagcgaaccaatacctatgaccatgtgttgtagatatgcctgtggttttcatttaggtaacaattcatagaggtttatgcatggtagaaggtactccctccgttccaaaatataacaacttttagccttcaggatttgtcccaaaatataacaacttatctaccaacattctcttcccaaccaatcacaaccctccaccattcacttttcccacctacctccactactcatccaatcacaaccctccaccactcgctttacctactttcttaataaccgtgtccaaccctaaaacttcttatattctgggacggagggagtagcagttttgagtttgtatgttatgaaattagatcccttgacacattatctccatcatttatagaagtacactaacccacagggtatgcatttacttatggatgttgctagcaactaacacataaaacacatctatattttttgggtactaccatgctatctgttacagattttcaaaagttttgagccagaagcctgttcaatctaagagtatcaaatatctacttcaaagagcgtatgactcatttcatttatttgaaacctctttaatctatatagacataaggacatacatctatcagtaaagaaaacaaagctgatcgttaatacttaatagagtaggttacaaatcttagcatcggttaatttactgtggtagctttcagaactaaaaaggctaatattaactggacctacaggagaaagtgttcgaatcaaactaacaggtattattgacagcataaacacaccttgacaacaaaaatattacatgaagaaacttcttcaagatactttttgtgaacagcatccaagtagagaacatcagaatagcccttttcttttgcaatcttttgtgccatcaagacctatgcaaagacagtatataaattaaagccagtgaaaataataacagaattcaacatagaagatagcagaaaataataatgataagatagcagggagatataagtcgtcatacaaaatagcatttcatttgaagtatatctgatggttcaattatttttcatttcacagcttcataatggcctgtatgttcttaagagaattgcactgacaactctcctttcaaccacatgttcacatcaatagaatgactgttccgtagtttaatatttgcagatctgaactaaaaacattacatcaaaaacatcagaaagagaaatatcaggtagcgaagttgcagaaatagccatgacaataacttccgcatcaaagctgtaagtaatgggtttcaaacttgactgtagaattaccgaggcataatttcctatggtcttcacacttccagttccaccaggggttgcacgatgaaacttatcttcaactatcaaatttattggagctaaaccttcctgaagatatgagtgaataaattaaattaaaaaaaatccatgatacatgagctgtttagaaattctacattcaaccatcagttatcaacaaccaacaaaagtggaaaaaaaatcataaattcataagtcaagttgctgcgaaatatatattcagaaacacggtgtcaagtagaacgcagattataacagtatctaccatagcttttttttttatttatggcaacaacgctgcggctaaaagagggagcagaattaaagaaaaaaacacaaaccttaaagtagttccccacaggggagacaaatataatgaacgtatactcaggagcaggtgcaagaccaagaacagcaccactacccataagtagcggtctaatatataaagaacctttaccggtaggaggcacctggaattaaaaattatttaacaaatgattaaatcaagagtatgaacagcggcctagcccactatgaaatgatttactttttacagtaaacccacccatctcttgtttgctaaaacagtctgctttactgcatccacaaactgctcaacactaggcgcaggcatgcacattctttctgcacctgttctcattctcagtgcattttcctccgggcgaaataataagatagagtcactgttgttctatatgcttttagaccttcaaacaatccctgtaaataattataatcttttaggacgaaaagtatttaaaaaggctcaattttccttatcttcagttaccacaatgtactcaggatatatgaagcaaggagatctacctccaatacaaacctatccgtaattaaggactccagaagatgggttcagcgctataggtccaaatggaatcatttcaccctcagaaaaattcccgtcctgtccgcattttgtgatatacatgtagtcggtctgcacgattccaaaaccaaggttctcccaatcaaaatcagctacctcagatgccttcctgaaaatatgcaagagttgccatcagaattattcctgaaatgaccaacacatcgtcacaatttgacaggcaggtcccctgcctggagggatacagttcaacgaatcatgcagcttatggtaagaatcacacacgtgtagtcacttgctagagaagcctcgcatcttctcacgcctcgagcctttagtggaagcgacgacatcgaataaagtcgattctgaatctgcagcagcgagaaaacaccagtatcaaatacagtattttaataaaaaacgaacataaaaaaaaacagcatggacttcatcaatttaatctccacaagcacttcacaaatcccacctacaacaacatataatccaaatcctaaatctccagttcgaccgtacacgccaatctagccaccatgatccacgaaatctacagcacaaacgcatccaggagaccgtgcaaaccaaataccggcctagtcgcgcgcgtacctgaatagagggcggcgacggcggcggtgagaggggcaaccggctacgccgggcgccggcgagcagggtggccgcgaggagcgcgccacgcgttgctgcaccgtactccatttgctgctctctcgtgagctcccccgctctctcgccggggtatagggtttctgcggctactgcggcggcggcggcgcgggagaggcagcggagacggagacgacgatgatggccaaatcggacgggaatggcacgggggccaaatggggaagcggctttactcacagaaccttctagccattgtagccgatgtgagaccgactggtggggcccatgctgtgtgggccccacttggcagtggctgggctcgggatcccgcgggtgtgcacgggggtgtctggaattctggatgaggagcgcccggtaatcgagcaaccaaaatatagttttttatccacatggttttctggcaggtggggcccgcgcaccttcacactcaatggtgttcgtggctgccgccgtgcggtactgcggtgggtattgaaaagggcaaaaaaaaaagtggtggctcgaagaataggccgacttggctttggctagctctctttcgccacgtcggaaggcaattttattttgttttttcttggtaggatttctttctctttttttaaaggtttactcctctattacaaaatatagatatttttagcataatagtttattccaaaatagaactatttttccgtttgcttctcttatcaaccaatcacaaccattttcgatttaattatcatattcgcttcatcttcacaattaatcataacttttctctaatcatttctatcaactttcttaatacttgtatccattttagaaatggcaacaatttatgacagatgtggtagtggttctgctcttattgacctgttacctcactctcaacatcgttatatattcaattttagcggcataactgttaaagtcacataaaaaatatatatatatatatatatatataagaacataatatgatacgaaagacaatcagacaaatattataatttgatagtaaaaaataatgcattgggggtgttcaatctttgctaccagctgcaattgccaccgtgagttaatactgaataccctcattgcatgactactaatgttgtggttgtcctcctttgtctaatgtgtgatatcgatctatgtgcaagttgacacaaacatcacaatgtgtaatgctctatcaaccaaacaggtataagagaagcgtatgctaattaccggaagaatacttgctttgtctgtagacataagttgaagtattgtggagcacgattgcttaaattctaaaacattcaaccgcagaaaaatgacattgctagcttgcaacatatgtttttttccacagcagctttggattgatttattttcagctagggtgcccattcagctatttgatgctctctttttcgcgaacgcgtaaaaaaattgtatgtcaatatattagaagaagcatagatttttaaaatacacgacacaaacggccgaaggacattgtcagggaacaggagaaaaacggattttcttgggttttcttgccacatgctctatcaacatatgttcttttgcacagcagtgtttggattgaattgtttttagctattggattaaattgttttcagctatttgatgctctccttttcacgaaagaaaaaaggattatacgtcaatatattagaagaagcagagtttttttttaaaaatacacgacgcaacggtcgaatgccattgtcagggggaacaggagaaaaaaaaaggcttttctccaggggcatcgcgcaaaagaacaaatttgatgctctcctactctatcacaatataaggcaatcttcttgccttctttttatttattttttcaaactcacataatcatgtctcttctggtatccgatagagatctctctctagtccaagtcaagtgttgtccttttattttttttttaaatcattgtcctttaaaattttagctacttattaatcagcatgcacagacctagatcagtcccggctccctggtattggatccgaccgatcgagtgatgtgctctcatccatccatagccatattatccctgcaattgtttattttcattgccaaatgaaccttaagtgataaaacttttttttgtttgtgtcaatcgcattgtttattggttaattctctgaaagtgataaaagggcattttatttgtgtaacctaatgaaatactagtttttgacatgcatattgtgtttctcgtgactgcaagaatatgaacatgtcactagtttaaggtgtgtttgaaagatagagaataaaaaagaataaaaggatatgcaaaacaaggtgtgtcattagcgtatgattaatcgagtattaatcattttaaacctaaaaatatattaattttatttttaaaataacttttctataattatttaaaaaacgcacacaccgcttagtagtttagaaagcgtgcgcacgataaaggaggatatttttttccgaatatgcttgaaacaaccaaggattgttgacatgtgtcgacgggtgatacccgtagaccggatataaagggtattggggtacgttggtacaaggatctacgtagtacgacatcgaacaatcaaaagacaagaattatactggttcaggccccttggtaggtaatagccataatccagttgatatgtgattatatggtggaaaacacaggttacaaagggaacgatggaacttgttggattcggcgagatcatagtcgagtggattcgactagctctcgatgacttggctcctcgcagacttcggctttgtaggctgtgtgggttgtgttggctctgagattcgatgatctatgccctccctaggggggtcccttttatatcatagatctggaggtctccaagtaggactcggagatatcagacccaatacgatacgtcgacgacccagttctgtccgagaaggactcttcccatctgtagatttcgtgaaaggtttccttaggatatgtagaaaacatccgcgtgtgtgtgggtatgccatgtcgatatgtaacgtatattgaagggtagagggtatgcctgacccgtaaccctgacagtagcccccgacttctgcttaaaatgaactcgtgcaaccatttatgacttcgggtgtcgagaacgttgtcattcttggcgcgaggaccgcggagatagaacgtagtcgagcatgccgtttgaagcccaacggtcacgagtgaattttgaactgaagtccagaaaactaccgcgcgtaacgggcccagagatttccggcggggatctctctccgttccttggaattcgcaccgttggtagtgtgcttatttaaaggaattttgggagctcattttgaagtctgccaaccttgttgaacacacaccacctgccagcgctccttgccttctccgccgccgcaagaaaccctagttcgccaactcaggcttgttttccggcgatcttggaacaacaatggatctcggtaagtcgtcttccaccagcgcgacgttgaagaacctttaggaggacggcgcccttcccggccgtggagacatggagagagaagtaggaggtactgatcctcagcccctcttaggtcgcatggttgtgatcgaagattacgttctctgcggttttcttcctccaccttccgagtttcttctcctggtgttgaatttctatggtctttctcttctccatttgaatcctaattccatcgcctttcttagtatctttgttcatctctgtgaggcctacattggggtagagccttttctcgatctcttccgtttctactatgaactgcgttggatggaatccaatagggtgtctggttgcgtcgggttccgacttcgtgatggcatgaagtcgcgttatatccccttccagtgtccttcttcccgcagtaagtggcggaacaggtggttctatcttgagatcaaggactcgaaccctgtcttcgttgttcccgaggatcaaccggacaagattccggcctggaccgccaagccccctttgagcccctctcttcagtcgtttatcgacatcatcgatgatctccgagaacagggcttgtcgggatatgaagtcgctgcagacttcgtcggtaggcggatccagccgctccaggctcgggcccatccagcctataactatttcgggtcggatgacgcgacccgggtttctcctcggggtatctttctcgtattcatcttggcgtgcttgtagtcgcgttcctcttgacttatcaaaagttggtttccgtttaacaggtctaagcagcgaagctatggagcggcgcgtcggtcaagtgatgatcagcggtccgaccacggctagcgacatccccgtgcccctttgtgaaaagggggcggcggaacgcgatgaagccatcaacgtaagtgtatttgataagcatctcgtattctcctttcgaaatcaccttatgacctgattaagcgtaggcccttcctttgactgacatcatcgggccgctcgcggaccatcaggtggcgacatctctaaaggagaaggttgtcaaggaggcatctgatgcggccaccactagcggtggcaaagtcccgaccaaggcgaggaaattctcgtctgtactcggacattgccgcaaggcagcgacccccctcggtatcatcttgtcgtcagatcgtgcagcaaggagggtttcttcttactctgtattgattgtctttcaggcttcagacgcgtcccctccacctccacgacgacagcgcattgtaacgatcggcgagaagtaagtaaatagattcttggattctcgtgcttttcgttcaaatggtgtttgattcgtggttgtccgtagggaggcgcgggcgaaggctgcacgggccaagtccgggggagcttctagcgcatcacctgccacggcctcgacagatgtcgtgcccatgaccgggagccgggaggcgacgcctagtggccccatcaacaatcccgctgcgggtcgtggtctgccagcggccgttctcacctgggaggagctccaagtcgagatggggcgtcttctcgaagctggtgctcgcggcatcggcagcgagatctcggaggcgaggtcggaagcggcgacggcgaatgcgcgtgctgagagattggtgcgcgagctagctgaagcccgtgaggacctcacgaagatgagggagttggtggccggcaacgagcatcaacggaaggggctcgaggactgaatgtcggaactcgggaacaatctctccgagatccatggctcgttgcgggtcacctacactggcctccatcagctcgccgaggagtgcggcgtcaagtccacgatcccggcgaatcccgacgagtttttgctgacttcctctcttgcggaactggcgacggcgatggggaaaatcccctccaagcatgcggccaggatcgcggaggagacgtcgaacggcatctacaccggagcgtgtcacgtcctcgcgtgtgtaagattgtcgcgtcctgaactcgatctgcgcgagatcttggatcagggggcggcaagcgacacgcgtaaggaggtgatggaagaagtcagtgatctgggggagtctgttctgcccctttttgaagagtaggacttcttgtatttgttatatattgtgtaaatcttgaactctggccgccttcgttcgtgcgattaccacccttgtccaattttgtatgttgatctcgggagtttttgtccattatagagatgttgatgatgaggatgtccagcagcgcgggcagcctgagtcactggcgatgattccggtactcgattttgaaccacatgtttcgtctgacaatgtggatcaaactcttgatgcgaaggccgggatggcaacggccacctcaagtgagtagccttttcacctcttagtgacctcttgattaggttatttatgttgtaaaggaggtatccaacttgtcttagtggtcatcacatttagcagatctcgagggtgcccttgcaaatcaagatcgtcgtatccaatactggaagacgaaatttgaagtggcggaacttgagagaaccatgctggccgtgaagaaagagcaggttgtggagacgctccgaggtcgcgaggtgtggttcaactcttacttgaggagttgctgtgcctccatggccagagtatgcagggaacttcgagtagtccgcgatgatcccgaggagtcggcggctgggtacatctcttggctaaacggggcctgtgcccaacttgatggcatcggcaagcatatcgacgaggccttgaagcaagagtgtcgtcgagtgagccgatacgccggagtgcacatgctggcttgcctacgagatcaccgcccgcgcttggacctcgagtttctccgccatggttttgctcgttctcggagaactccggcggagatagaccatctggcgaggtcgatgtcgccgctggccgagaagatcttccagtctatggactagcgttggccttcttggtagtactcatgccctgtcacagatatcttagggaaagatgtaatgtagtggaaaatttatgtaaaaactgtaagaattattttgtgaataaagaaatattccttaaacaaatgtatcttactctagatgtcgtgtgtaagagtgtgttctcagttaatgactttggtcagccgtttgagtcgtacactctccctagcccccagccttgtcgtcggaggaattttctcggaggataaggctcttggaccattgacctgccttggttgaataagctctgatcctagcccccagccgtgagtttggaaaattgatttccgatttcacggcttggttaatacgcacggtgagaactcttacacgaccagatcttacatggtcttttgtctctacaggatctgacaaggccttatcggctctgggcatccccagccgaagatcccttaggttcctcggaggccttgtcgagacggcgtaaagggacataaggacaggtttcaacgctaggtgtcatcagagtaagggatcatcgggtgaaaacactttgattgtgatatgggacctagaaataggctttattgatactataagggtacttacaggtacagtggtattgactcatacatagaatttacgtagttggtcaatgttccaagaatttgctaattcgcgaccatcaccgtctgcgattttgaatgcgcctggccgcaagacttgtgtgattgtgtaaggtccttcccattttggtgagagtttgttttgccctgcttgggtttgaactcgtcggaggacatagtcgccgatcgaaagtatgcgtgctcggatgcgcttctcgtgataacggcggagggactgttgatagctggctgctcggacggcaactcgctcatgatgctcctcgagaagatttacatcgatgtctcactgttcctcctggttctcgttggaatacttctgtactcgtgtactctgatgtcgtagctcgccggggagcatggcctcggagccgtacacgaggaagaagggtgtttccttattggacgttgtcggtgtggtgcgtacggcccatagtactgatgggagttcttcaacccactttttgtcttgtgacatgagcctgtcgtagacgcgggttttcatcccttgtagtactatgtcgtttgccctttcgacttattcgttgctttgagggtgagagaccgaggcgaaacatattttgactcccaacccgatgcagtaatcttggaagtcggtgctgatgaattgggagccgttgtcggttatgatgcggtgcagtagtccgtatctgcagaatatccctctgatgaatttgatggcgttgtcggccttgatttcccccgtgggcactgcttctatccatttggtgaatttgtcgatcgccacgaataggaatctgtagccgccctgtcctcgtgggaatggcccaagtatatctagcccccagcacgagaacggccaagtcagagggatagtctggagcgcttgcgcgggtagctttgtgtgtttactgtggaattgacaggcttcacatcgctggaccatgtcgaatgcatctttaagggcggttggccagaaaaagacttgtcgaaaagctttgccgaccaatgtccgaccggcggcgtgtgacccacatatgccttcatgtatgtcgaggaggaggtgtctgtcgtcgtcagtagagacgcatttgagaagtaccccgtttagcgcttttttgtataaatcgttaccgaccatacagtagatctttgctttacgggttattttctcggcctctgtatcgtcctcgggcaactcctcgctgctgatgaatttgattaatgggatgcgccagtcgtctgtggtttcgatgtcagcaacggcgcgttctgcctcggtgacctccgagctgatgtcgggggtgttcgggctaacttcgccgctaacttctttcaccgatggcttcgtcaggatatcgagaaaggtgccgggttcgagtggttctcgtctggctcgacgttgtccttgcgatagacgtgtcggacctcgatcccatcgaacctcttctctagcttcctgacttctacgagatacttggataactcggggttagagcatttatagtctttgtgcacctggttcgcgactagctcggagtcccctttgacgattagtcgcttggcgccaagtgcggctgcagctcgtatcctggcgagtagtccttcgtattctgcagtgttattggtcgccctgaagttgaggtggattgcgtgcttgaattgatctccggaaggagacgtcaagataaatcctgcccctgctccttggctgttgagtgcgccatcgaacgccattgtccatgtttcgttgtcgccttggttgtctgatttgttgtccggcatagtccaatcggcaacgaagtcggcgagtacctgggatttgatggctattcgcggcagaaagtggacatcaaattggcttagctcgactacccatttcgcaatgcggccgacaacgtctttgtttctcacaacttctccaagggggaaggaggatacaactgtgactctgtgagcttgaaagtagtggcgcagcttccttgatgtcatgatgactgcgtaaagcattttttggatatgtgggtatcttgtctttgcgtcatggagagcttcgctgatgtaataaactggtcgctgtactttctctctctcgacaacaatgacagtgctaacggaatatggcgtggcggcaatatagaggaataattcttcattaggttggggagcaacaagtacaggggggtttgataggtagcgcttgagtgcaataaatgcctctttggctttctgtgtccatataaatttgtcttgtttcttcaatagagcgaaggttgtgctcgttctcccatcctagcgacgaatctgcttagtgcttccatgcatccagttagcttttgtacctccttgagtctcgtgggcgacttcatgttctcgattgctttgatcttctcgggatttgcctctattcctctgccagagacaaggaatccgagtagcttgcccgacggtactccgaacgtgcacttctcaggattgagcatgaggcgatatcgtcggaggttgtcgaacatttcccgcagatcgtcaatcaatgagtcgcttgtcttggttttgacaacgatgttgtcaacgtaagcctcaacattgttgccaagctggttgctaagtgcgccctggaccgtgcgctggaaagtattcccgacggttatcagtccgaacggcatcttaacatagcaaaataccccgaacggcatgatgaatgctgtcttctcttcgtcctctattgccatgctgatttggtggtagccaaagtaagcgtcgaggaagctcaatagcttgcaaccggctgttgaatccaccaattgatctattcgagggagaggaaagtgatccttgggacacgccttgttgaggtcggtgaagtcgacacacattctccattttccattggccttccgcaccatgactggattggctagccactctggatgaagtacttctctgatgaagccagctttgagaagtttgtcgagctcttctcgtatggcttgtttccggtctggtgcaaatctccgcagtctttgctttactgacttggcatcgggtcgcaccattagtttgtgctcaatcacctccctagggacccccggcatgtcggacggttgccaaacgaacatgcaggcattatcgcggaggaaggtgatgagcgcgagttcctatttctcgtttagtgtcgccccgatcttgacagtcttgtcgggattggcactggagagtggaacgatcttgatggcgccgtccggcttcggcgtcttatttgtcttgctcactttcttgggtggctcagttgtggcgggtgggctgggcgtttgctcgactatgtcgaggctccgcttgtcgcactgcactgccagctttgtgttcccctgaatagtgattgttcccttcggtcccggcatcttgagcacttgatacgcgtagtgagatatggccatgaacttcgcaagtgcagttctcccgatgatggcgttgtaagctgtatcaaattcaacgacatcgaaggtgatctgctctgttcggaagttgttggcttggccgaaagtcacaggcaacgtaatcttgccaaaaggtctggatgatgattggggagtaattccatggaagggttgatcagttggtgtcaactcactttgcggaattcccattgcgtctagagtactagcgaaaagaagattgatcgagctgccaccgtcgatgagaactcgcgctactttgatgttccgaataatgggttcgaccacgatcggatatcgtcctgggataacggcggtcttggggtggtcttctttcgagaactctattttctgcttagaccacttcatcttgggtgcagccccccgccatgtcgaacagacttcacgttccactttcttgtattctcacttggaggagtacgttgtggagccgccgaaaatgtgtgagatgtggaggtcggagtctggatacgcataatccgattcgtgaggagccgtctcttcgttcttctcgacaatgcgtactcgcttgcctttttcaaacgccatgtgcttctcgagcgactttttgaaaacaaggcaatcttccagagaatgtctgtccgtcttgtgtatggggcaccaagatttctttgtgtcgctgccttgtgggtctgggcgcttgggagggttcgcgtattctgctgcgaggacttccgcttgagctttccttttcccatttttgcgatttttcttcttgcttgactcagatgcgtctgtggctgatttcttctctcccccggtcttcggcttgtcgttcttgcgtcttagcgcatcgtccacatgggcacatcgctcaacgatctcgaataacctccgagtggttgtgatgcgtcttgtcgccaattcctgggtagtgtagcgatctctgacaccggatttgaaggcgcggattacagaagcgtcggtgatttcaggaattgtgtttctgcattcgttgaagcgtcgaacatattccctcaatgattcacctgagttctgtgtcaacgcgtgtaggttgtcttcgatcgcgtggcgcttgtacgttccttggaaattggcaacgaattgttgccacaggtctgcccacgaagagattgagtagggaggaagatgcatcagccatgaacgtgcagaacccttcaacgcggttgataaatagttcgctagcgcgttgtcgtctgctccggcagcatagagtactgtggagtagacttgaaggaattcttctgggttggtgctcccatcatacttttcaattgctccgggtcggaatctctcaggccatcggacatcacgtagggaacgaccgaaagccctgcacccagcgttgggggcggtgggttgtcagcggtcgtgtgtccttcgtggatgtctgtctgacgatgaggaggacgcagatgatgatgatgacgatgggtcacttggttccggcgtacgattacgagtatgacggcctggatctcgggaatcctatcgttgtctctcgctgttgtctcggcgccgatctccattattgtcgtcgttacggcggcggccatgaccagtattgtctggcccccgtcattcgcgatcgttgcgattgcggtggttgtcgtgatcccggtcctcgtttgagcggtctcctcgatttccgttatcatggcgccgtgaagagacatgacgccgagagcgatttacattgtctcgtgtgcgtcgtgcttctcggcggccgttgatttgatctcggagatcgccagcgccgcgaggtggaggagtggctcgttgaggtgattccctccgttccggatcttcaccattggcgtcgctagttggcggctgatcttggtgcgctgcggtagcgacttcttcaaacgcgttgctaaggttggtcaccgattcccgtagtcgttctgtcaacgctcgaggtcatcattcagaacgggatcgtaaggagtttcccttagtaaggcttgaacggccctgatgtgttgggctggagtagtcgattgattcgccgcttctgcgttggcttgcgttgacgtgccaacgtcatcgatagccaatacctcctgcggcacgctcattgtcgatgacccatagtcttcgagaagatgtaagaccggtggttcatgaggatcgatatcgattacctcaacgaatcgatctgaggctggagtcgctccttgttccttgccgttatccctgacggggacgtatgactcaggagacggagctttcatggcgccgaggaagactttgtagctcgagaggttgtgattctttgtcttgtgaataggacaatagacatcccgagttggagaagtacgctgaattccacgttctttgcatgcgcgaatttcagcatggacgttgaggaaaacccagcaatcttgcagggtgtgtttcttggttttgtggataggacaccaagaccttgtggcttcggaagtcatctttgccggctcgtggttcatgtcagaagggcaaggtttggccgtatcagaatccttcccgagcttggatgtcgtcgatgatccgttctccgtttcgacaggtggatttttcgacatgaagtcgccttggtttgtagccactgcgttctcgtttccggtcattggaggaccggttgagatcagcgtcgtggtgtaaaacgggaagacgatttcgccgacttgagtccataccagcattgttgaagcagggagcgcttggctgaggctggtgttgacgttgttgtcgacgaagctggatgacatagtagtagaaccttgagtaccaaatccccctacctggcgcgccactgtcgacgggtgatacccgtagaccggatataaagggtattggggtacgttggtacaaggatctacgtagtacgacatcgaacaatcaaaatacaagaattatactggttcaggccccttggtaggtaatagccctaatccagttgatatgggattatatggtggaaaacacaggttacaaagggaacgatggaacttgtcggatccggcgagatcgtagtcgagtggattcgactagctctcgatgacttggctcctcgcagacttcggctttgtaggctgtgtgcgttgtgttggctctgagattcgatgatctatgccctccccgggggggtcccttttatatcacagatctggaggtctccaagtaggactcggagatatcagacccaatacgatacgtcgacgacctagttctgtccgagaaggactcttcccatcagtagatttcgtgaaaggtttccttaggatatgtagaaaacatccgcgtgcgcgtgggtatgccatgtcgatatgtaacgtatatcgaagggtagagggtatgcctgacccataaccctgacaacatgtcctttgttttagactagggcagtgttttgccacttaggacaagtgactttgagtcctagttaattagtgtctactaggtgtcattgtcaatctgtgtttgcacaacttctgctaaatatgttggtttttatgatgtgtagaacttgagatatcttatatcttgttgtatgcattgcatgtcactagttaaactcagttttaccaagaagaagcttcattctctagtgcatattgctggcttgatttagttgtgtcgacgttgttcaggtggtctcaactctcaacctttttcttggtttatgctttccatgccctgaacagtaagtagtaacataaatcatcagccaccaattaactgaaaaaagctttgttgttcactcgaaaaaaatatggcaaaaagggatcagccacgtgcccaggaagtgagtgttgccccgtcattgtcgccagaaagcgaagaaaagcaaagcaaatctaatcgtttctcttcactccaaaaatagcaaagcaaacacatccgtctctctctctctctctctctcccctactactatctcctcctgcccttccaatttatgttacaaacaaatcgttggttcctcttttttcttcagtttgtttcagtgcaactcagttcttggaaagaaaggttggatttttactctgaacaaagcgaaaggtaaaaccatctcttttgtaatgcagcaatttatgtatattttggcgtcctttcagttattttgtttgatcaggtgtggcaatgggcggcagcggaacgctgatctccatttaccctgaggatctcactttcctatgtaagttcagaggacttcttgagattatctaatgttgttaacatttacggatggttagccttaacccacttgtgtgggttcttcactccattaaattctcgtgtgtagttgagctggataagcggtgctattgcaatctcaaggtggtgaacaacagcgagcatcatgctgcattcaaggtccatggccttccatttcatgaccaatattttctaaaacttggcgagaaggcttgatgaaagtttgtttcatgtcaagacgacattaccgaggaagtattttgtccggccgaacacgagcattgtccagccatgggattcttgcacaataacaagtaaatagtaccttcgccgcataataagttaatctaatacgagatgtgacatatcccagtacttgtccaaattcatagtactagtatatatcacatcttgtattagattaatttattctgggacggagggaatacatgttcctaatttggccattttatggtatgccaagccatggctctcttcaggctccttgtttggtcttgatatttggatatctgcattgttcttgggtgatgtagttacgctccaggcacataaatagtgcccaccaaatatgcaatgcaaggataaattcttgatccagagcaccaagctagtagctaccagtactgacatggatgagattccccccaatactgtgagcataaaatgcaaatagatgatttgcaagctttattagtgatgcattattgttacaatgacatgactactgacccaccaactatatgccatttttgtatcggtccagttcaacaaggaagtcgataaggtgattgaggaaatgaagcttaaggttgtttatacagttcccagtggaagttttgatgattctagtattacatcttgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgaatgtcttattgattatatgatttggagaaaatcaacatctgccgctagaggcacccggaccccccttatatatgggaagaagtccgtgttacaaaagataatctatatccctaacggaatatgcagatacagataaaatacagtcgtagccgactaagtctcaaggtatttccttgatgtacaagttgagaaacaaacccgagacacaaataagatattctatctatatttggtatcctgtattcagtccaaataccatcgccgtgtagatatgggatatccataatctccacagtagcccccacgacctttgcagtcaaccatcatagccttctcaaagataatgatccgagtgcttcaaacatttcatgccaagatctgccgagtagcgaagacaaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacgcgacgcccaaagaggcattctagccgactgctttttagccataataaaaagaatccgagtggttaacactctaaaaggttcacgaatgaacacacttgacgggcatccgaatagaaaattctaagattacccaccaaaaattataaaaattatggtaatgaataagtctaatagcctaggctatgactatttaccataatgagaacaggcatataacataccaaagaaacgactatggtaaaaaacaagtcattccaagttaacccagacagcttttgtagcctaaaaaagcttacaaaaacagcataacacctttctgtcgggcaccttttaatttgcattgcaataattccaaagaattatatgaccacgtaaaaaggattttatcagcattgggcaacactattatgcgcatagattgccaaagcaaaaaatgcctaagtccctaaggagcacaatgggccacgctgtcaaaaatactgggctgaggtactgttcaggcctaagcccatttgcacctccgatacccttaacaagaaatcccgagatccaagcgtcacttcgtcttccccgccggaactctcgccattttccccactccctgctacagtacagagctgcgccggcaaactagggttcaccattccactcgaatccaccttcaaaaagttcatcaaaatccttcccgtgatccgccgcctcaatccctcacctctccctagccatccctcgaatcaaatcagcgcattcgggtaaaatcgatggcggaagagaaagaaagctttgaaggccaatgggcgccatccgacgtgacggaggagaacctgaaggagatggtggcgcacggcgttcttcctgccaaggagatcatcgggtggcggccagcgtgcggtgaggcttttccgtcccccgatacacacgaggttgtggtcttctctcatttcttctatggcggcttcgctcttccgacctcgaaatttttccgcgggatattaagcttctatggaatcagcttgcatcacctaaacccgaattccatagtccacatcgccaatttcgtccatgtttgtgaagccttcttgggaattaaaccccacttcgctctgtttcgccgaatcttctttctcaaaccccaaccgaacaagagtaagccatgtgtagtcggaggggccggatttcagctgagaggaactctgagccagaagtacttctcaatgcccatcaagacttcaaacaaagggtggcatgcgaactggttttatattcagaatcctgagcccgctcttcctgagtactcttgtcttcctccggtgtaccaagatacctggaactctcttcctattggggatgaagcagcccaagccttggaattgatggatcgcatgctaaaactcaaagaacaaggcttacaaggagagcagattactcggcacttcatcaaatgccgattggcaccaattaaagaaagatcccgtacggcattcgagtttgacggcaagcatgatcctaatcgtgaagaaccagactctctggattttaaaatcatgaaggagagaatgtataaaatcttctcaaatgctattgtcgtcagctactcacatcagctgccagttgtgccatataatgcattcaattcgcctccgcaggtatgtatctgaaaccttcaacccatgaccaaaacataatcttgtcttcatgttgagttaactaaccatggaggcatctcattcaggaatatgtattgatgaaatctgaccccccaattactcagcgccggtctcctcgccagcacaccgttaagggaggtggagggccgacaatcagatcggactcgcaacctcaaacctccaatccgactgggcaaacaggttctcgcaagagaaagctgatgcttaacgatgacgaaggcgacgacggcaacaaatctgggaacaaaagcctacccaataaactcccaaagcataccactcccaggaaaaaactggctggccgtccaacgccaaagatcagaacatcttccaggcataaacctcttggtaccatttcgctccggtatgcttctctcatgaaaataatactgaatattgaaaggacactttgcaggaaaccatccgacatagatccaactggaaaagatcctgatccggttgtgacagagccaagttcatccaaggattctgagccgactgccgagaaccagccgactggcgctcatacttcaggtgatacagccgatccgagtgaccagcctccgactggagaccagtcggcagcaactgaaactacaacaacccaagagcccccgactggaaaccagtcggacgtaggtccagaccaagaaattcccgaagttgaagcgcagacgacgacttctcaaggaccagaggctggtaacgacgctatgattgggtcttcaaataaagaacaagaatcgcctcacgctcagctaggaacatcctcgggtaactcatcttctcaagtgatgccgatttgaataactccagcttattcgtctaatatcttggaaatacatcaggaccaccaggcgatgacgaagaagaaatccctcgcataaaggcggctgacgactctcgtcctcctatcttgctcaaatggtgggacgagaactcacaagctgccggcatcgtcataaatcgtcaaaaagaagatgaggaagtgtgccagctgaagaaggcacttggagaagccactcgcattgtgaatgtaaatcctctgggtgactgcctttgatgactttgttttctctttagcagaactaaaccatgaaccatcatgcagagaatccatcttcgcaatgaggccaagacagcaactttagaaaagctggttcctcatttgggaactcttgaagcagtcagggaccagctacacgaggccaaggagcttgccaaaaagacagagaaggaattaagggaccgaattgcccagctccaggattcaaacttcgagctgagtggttcatcaaaaggtaatcttctagatctgtcccattaatttatgttgtcataactgtatcctcaaacatttggatttcaaacagcgcaagccaccaggatggctcagatggagaaacaaattgaagtcttgaaaagagacaaagtagaattggctgcgcaaagggactcggccttgaaggaggttgaaggtaccgccagctgacaatctgaacttctctctttttaaggcagtagattttgatcataaacgtgttttgtagaccgcaaaatcaaatctcaagctcaatttgacgtcctggttggtaagatcaaaaagcttgaaggagcaagagatgaagtcgctaatgtcgctacaccacttgtccaagctatgttcctcaataacagtggtccgagtgcactcgacgcaaccgaaatcttcgacaagctgagagttgctccagatgtatatttcaagaatatcaagaaagctggaagtatgggagctagcatggcattggcgatgaccaaatccttgtacccaaggattgaaattgacgccattgatggctttgcagacgggacaagcgaagaagctgctcttgatcttatcagcaatgctcaaaacgcggctgacaagattgcaagtgacgttgtagagcaattccgcaataccgaccttcagccgagtagtaataactctgatgatgaaaaaactgattctgactgagtatgaatgtaacaaatggaggttcaacttgtacaatactggtgtatttatgctgtgtttgataattctagccaagtctttgatttcttaaaagcttttatcaagctttgttgagcctagaacccaaagaagctattaaaaactttcagtcctcgcagacgaagtagaaaaaccaaacaaggcaatgatagaccaagtaagcaaattaaattgataaaaaatcacactccattattatgatgatagcccccgactgacaacgtcaagaagaaaacttgatgttgacagtcaagatagggaagtacaatgataagtttaagcgtagaaacgacgaagatgttcaatgttccaagagttgtcaacgagtgtaccgtcttcgcgcttgagtcgataggaacctggtcgggtgacgtcagagatgataaatggcccttcccatagaggagataacttgtgccgatctcgtgtagtttgaattttcctcaaaaccaggtcgccgactagaaaggcacgggatcgaacattgcgattatgataacgtcgcagcccttgtaagtatcgagccgactgaatcaaagctgcttcgcggacttcttctaatcggtgcaagtcatccactcggtcctcttcgtagcgttcttcacggtaatttcgaaagcgcaaagactcgaattcaacttcactcggcaacattgcttctgccccatagacaaggaaaaaaggtgactggcctgtggcccgactgggtgtagttcgcaaagaccaaagtactgatggcagctgtttcacccatttgccggcatagggttttagccggtcaaaaacacgcgctttaatcccttgaagtatcatgccattggctcgctccacctgtccattgctcatgggatgtgccactgaggcatagcaaatcttgattccaaagtcttcacaaaagtctttaaaaactccgccggtgaattgtctgccattgtcagtgatgatccgattgggcactccaaatctatgcacaatgttgatgaagaagtctcgagcgttatctgctgtgattgtgacaaccggtttagcttcaatccacttggagaatttgtcaatggccacaaaaaggtgcgtgtaaccgccgactgcctttttaaacgggccaaccatgtcgagcccccaaaccgcaaacggccaagacagtgggatggtctgcaactcttgagctggtagatgaatttgtctggcgaaaaattggcaaccttcgcacgtgcgcacaattttgtcggcgtcggacactgcggtgggccagaaaaaaccctgccggtaagctttgccgacaatggtgcgtgcggcagcatggtttccgcatatcccagaatgtatgtctttcagcaattgcctcccttcctctaaagatacgcagcgttgcagaatccctgaagggcttttcttgtacaactcagcttcatgcataacgtaaagtttgctccgccttgaaatccgctcggcttcatctttgtcttgtgggagttcttgagaagtcaaaaatcgtatgaggggctctcgccaatcggcttcaaccagagctacgtcatgagtgcccgcaatttgagtagtatccttgtgaggtacggtcggcgtataaaggtgttcgacgaaaacatcagagggcgccacctcgcgcttggatccaaagttggcaagtctgtcggcggcttcattgttgtgtcgaagaacgtgactaagctcgagtccatcgaacttgtcttccaatttgcgtacctcttgtcgatatgccatcatattgtcgtcaaggcaggaccactctttcataacctggttgacaaccagctgtgaatcgcctcgaactattagacgctttattcctagggaaattgcaatccgcagtccatgaaggagcgcctcatactcggcgacgttgtgggatgccgaaaaatgtatccaaagcacatagcttaatctttctccagttggggaaatcaagaccactcctgctccagtgcccgaaagtcgttttgatccgtcaaaatgcatggtccagtgctccatcttctccgcgggggtatcctcctggcactcggtccattcggcgacaaaatcagctaacgcttgggacttaattgaaattcggggcttgaatgatatgtccaaagacatcaactccaaagcccacttagcaatccgcccgtttgcttcgcggttatgcagtatatcaccgagtgaaaatgatgtgaccaccgttaccgagtgactttgaaagtagtgagatagcttcctggtagtaattagaataccatataacagcttctgaacctgagggtacctcgttttggagtcggctaggacttcgctgacaaagtaaatcggtcgttggactttctggacatggccttcttcctcgcgctcaacgaccaagactgtgctcacaacctgggaggcggctgctatatacaacaacaacggctcctgcgggtgtggtgaggctaagaccggtggctcggtgaggagtttcttgaaatcttcgaaggccttctgtgcatcgggtccccactggaagtcgtctgttttctttagtagcttaaagaagggcatcccccgctcgccaagtcttgaaacaaatcggctgagcgccgccatgcatccagtcagcttctgaacatctttctgggtacttggcggtttcatgttgaggatagcagtaattttctccgggttggcttggatgcccctatgagacaccataaaaccaagcagcttccctgacggtactccgaaggtgcacttttcagggtttaatttcatcctgaaagcgcggatgctcgcgaaggtttcttctagatccgagatcaaatcatccttttgcttggtcttgacaactacatcatccacataggcttcaacgttgcggccgatctgcgttgagaagcatctctggatcatacgttgataagttgctcctgcgttttttagtccaaacggcatggtgacatagcagtatgctccaaagggcgtgatgaatgaagtcttcaagcagtcggattccttcagtcggatctgatgataccccaagtagcagtccaaaaaactgagaagctcacagccggcggtcgagtcgactacctggtcaatgcgaggcaacccaaaaggatctttagggcaagatatgttgaggtcagtataatcaacacacatgcgccattgccccgttttcttccgaactagaaccgggtttgccagccagtcgggatgaaggacttctttaatgaagcctgctgctaacagcttggttaattcctccttgatcgcgtcttttctgtcttgtgcgaatcggcggagtcgttgtttgataggcttggcatcttctttgacatataaggagtgctcaatcacctctctaggaataccgggcatatcagatggtttccacgcaaagatatctttattgttctgaagaaaggtgatgagcgcgctttcctatttacaatctaactcggcgcctattacagcagttttagtagaatcagaaggatctaagggaatctttttagtcttggcttcgctttctccactttttgaaatcttggtagcgggcacttctccttcgctcgccgtggctgcagccagtcggatatcctctcgggctgacgccatctcgcgggtttgggccatgtcgcaactctccttgtcgcatgtgacggcttgcttgatgtcgctccgtagggataggactcctcggggaccaggcatcttcatcatcatgtaagtgtagtgcgggacggccataaacttggctaacgccgggcgtccgagtatggcatggtatgctgtctcgaaatcgtcgacttcaaagctgatattctctgtgcggaagttttcccgagtgccaaaagtgaccgggagggtgatctggccgagtggagttgcggataatcctggaattactccgtgaaaaggcgcattgcttggttttagctcggagcgaggaatctgcatatcatccaaggtcttggcgaagaggatattgagtgcactgccgccgtcgatgagggttctgcgaagcttgacattacggaccactgggtctagtaccagggggtaccgccccgggtggaccactcggtcaggatgatccgagcggtcaaacttgattgcaatttctgaccatcgaagatactggggcgtgtcgggctgaacagcattgatctcccgttcagtcaacttttgcttccttttagactcataagccagggggccgccgaagatatggttgagctccttgcggtggtcttgaaatcctgccggggtgtcgccgtcgtccttcttcctcgacgtactttgttcttcgtcggagttcttccgtgtagtcttggtgtattgctccgcaaactgcctgtagacgaaacaatctttggccacgtggttggagttaggatggtgcgggcattgggagttcatgatcttgtcgaacgtgttgacgcgcgaatgctgtcgagaagagtgagtggcggttgcaacaagttcctcaggcttacgcttgcggtccttatgattgttacttccacctcctcccttagccggcgtacccttgtttggcttccaactgggacctgactgctttgatgcggtgacggcgtcttcggccttggcgtactcgttggctttttcgaacataagcttgactgtcttgggaggcttacgcccgaacttgccgaccaattcttcgtggcgaatccctttggtgaatgcggcgatgataacgtcgtcggtgatgtcggagatcttgttacgttgttcggaaaatcgtcggatgtaatctcgaagggattctccagatttctgaataacgttgtagaggtcgtattgtgtgccgggatgctcgaaggtgccttgaaagttggcgatgaagtggtcgcgtaattcagcccaagatccaattgtaccacggggcaatccatggagccaagatcgggcggaatccgctaaagccactggtaaatagttcgccatggccttgctgtctcctcctgctgcgcggattgcgagaccgtagatggtaagccacgattctgggttagtggtaccgtcatacttctctattccagtcggcttgaagccggctggccaatccactcgacgcaggtcgtcggtgaaggctgctactccgtcaaggtcgtcgtcgtggcggtccggcgaatgatgatggcctcgagctgctcggcgctgtatgattgtgtcgcgaagatcgacggggcggcgacgaggtggtgagcgaggccgttccactcggcgctccctatgatggtcgggaggtgagtgaacggaccgctcgtcgtgacccctgctcctgcgattggatcctgcgccggtgatgctgaggcttggatgacggtagtcatgagatcggaagtgggggactcggctgccagtcggcgtgtggacgctttcggagttaactgggaccgaagccgcaatcatggtcttcgtctggttcaagatgttgacgacgtgatcagattgattgagctcgttctccttgaggagggtgtcgaggagggtgat

SEQ ID NO: 17436 - DNA, 8407 bp, Oryza sativa
tgtcgaggagggtgatcgcggcaaccgcattctgttgaggggtgcggaaaaccggtgtcccttcaacatcttgttggccgatgagatcacgcgctcggcgccctacttccaaagctcgctgccgtcgatcctcagcctccttcgcggtccgctcacactcctgctgctcacgccgtagccgttcttgttcttgtgcttgatgctcctcctccagtcggcgacgttcagtctcgcgacgtgcttcggtctcccgggcttggcgttgctcctccgtctcgttatcagccatgaagacgccgaagtagagaggggtgtagttgtcatctaggcttccgtcgaagtcgtcgagatccgggtcgttgtagcgagagctaaactcgtcgtactccacgatgtcggtggggcgcgagtcgacggtgggagaactgtagtagccatccagctgatccgtcgaaaccgtgccgagtggtaagaggatgacgccgacttccctgaagctaggcgaagtcggtgttgaagccgacttccgcctaggcctacgggatggagacgctgtcgtgatggagacggccgccaaatcgtcggggagcttcatcaggatcggtgggtaagccccatcatcttgatctggtgacgttggagaaggtgcgatctcacccgagtggtttgaagccaactcgattgagatggtcttgaagtaactttcagccgcgtttgggagtccaaacggggctgaaatccggttctctcccgactggtctgacaccgagtcaaggagagagatcttgccgttgttgttggtgacgaagtcgaggctgccgaaccgaaacgtctgcccgggtgggaagacgaggtcgtcgatgccgaagacggaacccattgcactgatcggcgaaaagcttgacgcagcccctacctggcgtgccaactgtcgaaactagatttcggcaataataaaagggggtggctatcaagctggaaaagtgtatgggtttggagacaaaggatttatacaggttcaggccttcttattgaagaagtaataccctactcctgtccggggatgaatccgccgaatgtcttattgattatatgatttggagaaaatcaacatctgccgctagaggcacccggaccccccttatatatgggaagaagtccgtgttacaaaagataatctatatccctaacagaatatgcagatacagataaaatacagtcgtagccgactaagtctcaaggtatttccttgatgtacaagttgagaaacaaacccgagacacaaataagatattctatctatatttggtatcctgtattcagtccaaataccatcgccgtgtagatatgggatatccataatctccacacatctttaggaagcatgagcttcaaattggggtctgacgatctcacggtgagaatactatgctggaatcttgtgtaatgttgagcaaacttctgtgcaaggggactcacgttttgcactacaactatatgcagatgttgaggaatgcaagcattgaagaggtaatgcgattgatcctaaaggcatttatcattttattgggaaactacacctagataatagtatgacaataaatctctcatgaattctgacaagaaattatcatgccatttcgggcattaccatgataatgcttttctagtgagaggagtaatgattcatctaaaattactccataagagttcttttattttattcacaccgttttctggcaggtggggcccgcgcaccttcgcactctctgttgttcgtggttgccgccgtgccgctggtatcgaaaggggaaaaaagaagtggtggcttgaagaataggctaacttagctttggctttggctagctcgctttcgccacgtcggatggcaattcttttttgtttttttcttggatatgatttatttctctctctgttttttttttgttttaggatttctaagtactgcttcctctattccaaaatgtagctatttatagcacagtagcttgtcctaaaatgaaactattttttttcatctacctccttcaaccaatcacaaccatttttcatttatttatttcatcaactttctattcttaaccaatcacaaccttcctttaatcatttctatcaactttcttgatacacatgcccatcttaaaaatgcctacaatttaggatagagatgtgctagtggttcttttgttattgacacgtcacctcactcttggcgttgtcatatggtcaatttcagcgacatatctgttgaagtcacaaaaatatatactccctctattccaaaatataaaggattttggatagatgtgatgcattttagtactatgaatctggtcaagaaggaatataagaacttttagtgttggacacgattattaaaaaagtaggtagaagtgagtggtagagggttgtgattggatgagtagtggaggtaggtgtgaaaagtgaatggttaagggttgtgattagttgggaagagaatgttggtggagaagttgttatattttgggacaaatcccgagggctaaaagttgttatattttgggacgaagggattatattttaggacggtgaggtatataagaagatgatgtgatacataggacaatcaaacaaatattataaattgatattaaaacataatgcattgggggtgttcagtctttcctgcaagctgcaattgccaccgtgaactactagcgaatacccccattgactaacgttgtggctgattgtctgtcctcatttgtctaacgtgtgatatcagtctatgtgtaatgctcttgacacaaacatcacaacgtttgcaatgctctatcagtagacacaaatagtcaaataggtataagagaagcgtatgctaattatgggaagaatgcttgatgtgtctatagacataagttgaagtatcctggagcacgattgcttgatttctaaaacaatattttcaacaaccacaggtgctagcttgcaacatatggattttcccacaacggcgtttggattgaattgtttttagctataggattgaattgttttcagctagggtgcccattatgttttcagctatttgatgatctccttttcatgaacgtgcaaaaggattacacgtcaatacattagaagaagcatatttttttaaaaaaaaagaaaatacacgtcacaatggctgaaggccattgtcaaggaacaaaaggaaaaaaaaggcttttcttggctcttcttgcattatgctctatcaatatacttgcaacatatgttcttttccacgacaacgtttggattgaatgcttttaggtattggtttgaattgttttcagctatttgatgctcttcttttcacgaacgtacaaaaggattgtacgtcaatatattagaagcagagtttttcaaaaatatgcatgacgcaacaactggatgccattgtcaagaggaacgggagaaaaaaaaggcttttctccagggacattgcgcaaaagaataaatttgatgctctcatgttctatcaatatataaggcaatcttcttgttttcttttcaaattttttttccaaactcaaactcgtgtctccactgctatccaatagaggtctttctctagtgctagccaagtgttgtccattaaaatttcaactacttaatcagcacgcacagacctatatcagtccctagtattggttccaaccgatcgagtgatgtgctctcatccattcattgccagattgtccgtgcaattgtttattttcattgtcaaatatatgaaacttaagtgataaaaatgttttttttgtttgtgtcaatcgcattgtttcttggttaattctctaaaagtgataaaagttttttttttttgaaagtgcaacctaatgaaatactagattttgacatgcatcttgtgtttctcgtgactgcaagaatatcaacctgtcactagagaaggagaatagagaagattaaaaagatatgcaaaatgaggtgtaccattagcgtatgataaattgagtattaatcattttaaacctgaaaaatggattaatatgatttttaaaacaactttcctatagattttttcttaaaaaacacaccgtttagcagtttggaaagcgtacacatgataaacgaggatattttcttttcaatgtgcttgaaacgaccaaggattgttgacatgtcctttgttttagactgggcagtgttttgccactaaggacaagtggctttgagtactaaagttaactagatgatgttagatattgtgaaatggttaaatgatttgggttgaaatattatgaaaatgatttgagaatgatgatttagtatgtgtatgtttagttttagaatgaaataaattgtagatataattagtatatgcttacatgttgagccttgtgtgtttagtgtgttgatgtgatatgcttgcatgttagattttaggagtgctaataaatactatgcttgtatgttgagctttaggtatttaatgggtattagctttatagaaagaataagggattagtgtctactaggtgtcattgtcaatctgtcattgcacaacttctgctaaatatgctagtttttataatgtgtagaacttgagatatcttgttctatgcattgcatatcactagttaaactcagttttaccaagaagaagcatcgttctctagtgcatattgctggcttgatttagttgtctcgacgttgttcaggtggtctcaacctttttcttggtttattagtcatgccctaaacaataaacagtaacatagatcatcagccaccaattaattaaaaacagctttgttgttcactcgaaaaaatataggggaaaggaaactgccacgtgcccaagaagtgagtgttgccccgtcattgtcgccagaaagccaagaaaagaaaagcaaacacatttgtttctctctctttctcttcactccaaaaatagcaaagcaaacacattcgtttctctctttctcttccctgctactcgctcctcctgtcctaccaatttatcctcgaaagaaatcgttgattcctcttttttcttcaatttgtttacgtgcaattcagttcttggaaataaaaggttggatttttactctgaacaaagcgaaaggtaaaaccatctcttttgtaatgcagcaatttatgtatattttggcatcctttcagttaatttgtttgattaggtgtggcaatgggtgccagcggaaggctgatctccatttacccagaggatctcactttcctatgtaagttcataggactttttaaaaatatctaaagttattaacatttacaaatggttagccttaactccgttaaattttcctgtgtagttgagctagataagccatgctattgcaatctcaaggtggtgaacaacagcgagcatcatgttgcatttaaggtccatggccttccatttcatgaccaatattttctgaaacttggcaagaaggtttgatgaaatttttttttcaggtcaagacgacatcaccgaggaagtattttgtccggccgaacgcgagcatcatccagccatgggattcttgcacaataacaagtaaatacatgtttccagtttggctattttatggcgtgccaagccatggctctctttaggctcattatttggtcttgatgtttggatatatatatctgcattgttgttcggtgatgtagttacgctccaggcgcagaaagagtacccaccagatatgcaatgcaaggataaattcttgatccagagcaccaaggtagctgccagtactgacatggacgagatcccccctaacacggtgagcatacaatgcaaatatagatgatttgcaagctttattagtaatgtattattgttacaatgacattgactactgatgcaccaactatattccatgcatttttgtggttcagttcaacaaggaagtcgataaggtgattgaggaaatgaagcttaaggttgtttatacagttcccagtggaagttctgacgactctggtattacatctttaggcagcaggagcttcaaattggggtctgacgatctcacggtgagaatactatgctgaaaacttgtgtcacgctgatcaaacttctgtgcaaggggactcatgttttgcactgcaactatatgcagatgctgaagaatgcaagcattgaaaaggtaatgcaattgatcctaaaggcagtaccattttattgggaaactacaccaaaataatatgacagtaaatatctctctaatgaattctgacaagaaattatcatgattcatggcttcctaatatcatcttatgcatggatactctgctgcctctacatgtgtataatgcttttctagtgagaaaagtaatgatcatctgaaatttctccataagagttcaaatgcaagacacgcttgtgaagtgatattgagatgctggcattgattagaaagttcatgtctgagaattaggaagataatgaagcaacgatatagatggttgaaatgatcataaagtagtttcctttatcttgactgacatattccaaataagcaatttggataaattttttgtttcctaaatctggataaagagtttgccttattaaatgtgccttgtcttatggcaattctctacaattttaaccaagcttgtctgagcaaagaaacatcttttgtgatatgttctgttatcctttttgtttcttacttagttccttgttttcttctatccagatacagacaatacaacgcctaaaagacgaacgagacaccaccctgcagcaaaatcagcaaatgcaacgtgaattggtcagccttttttttttcttttttgcacttcattttgttttgtgatcatcactttatttcattgtagcttttatgtttctcaatattgacacctgaactgtgaaccttatactgctcttgctcatttgttatcatttgaattcgcgatgaaaaatgtttagcatggagaaaaaacaattggttttgattaaatatatatgtctgactttgagaaaaatgcaaaagaaattattggtccttggtggataacaatttttatatttctacaattgtgatcgatcaacttttcattcataatgcaactttagtttgctcaacatttatttctttaatgggtcgctgaaacaaatgtgtcaagggaaacaaaagcaaatcaataaacgtttcctactattttacagttgaaactgaataattgtaggaatgcagatgtgaaaaaaatcccattgctccaagcatttcatggatgtaaaatatccttgttagcagtaaagaattcaagatgaatcgtttgtgtaccccctttctcccttatattgtattttctatttattatttgcattatatatatttttttcaggatgtgatcaggaggcgtagaagccgcaaaagcgatgcgggtttctccttaacgtttgctgcttttgctgggctcataggtgtcctgattgggctcttgatgagcctcatcttccctcgcccacaggctgctgcttaataaaatgccaatttcacaaccaagtgatacatgttcagcttaatgcccaacaatgtggccattatcgatcaaacaatcatagctaggttaataatcgagtcagctgctctggggaggaaaaatatatggaaaattctactttagtctcaattattcttttgttctttgcattgtagttaatatgcgtcacatcagaaaagggtcacaatgtttcatcaacccaactcccccttcctttttttattaaaaaaattgtattttcccttcttatgtaatctttttgtacaatttagtttgacataaacatatatcagggagaagctgtatgcattcaccgattggatataaggtcatgctcagtgaaggacaacttcatgagctctcctcatgtccctatatgttcgattcgataaactaggataggtttgtacgtgttcgatatgataaactggtcctctcatgaaaaaatattctctagaagagtggtaagagggctgcctgggccaccatcgttagcacggaccggcgatcatttgccacgtcaaaaaaaagatctcttggaacccaaggatgagggttataaatctgtaatgctcctatagtttcttctgtacataatcagccgttgccaagatttgagttttaaaacttatttaaagttgatttgaaagtttttatccgaagtttatttttcagcaatggcacttaaatagttaagaataaatatataaaaatttgattgacaaattattaatttagccaaatattaacaatgcgccaaatgacatattagcaacaacaataataataaaatacttttgtaaatatgaaaaaaataaatgtaaaatttaaaaaaagttcccctcatccc

SEQ ID NO: 17437 - DNA, 4007 bp, Oryza sativa
  unsure (1)..(4007): unsure at all n locations
acgagctctcccccgaagaggtcatcgacctcgacgagattcggaggctgcagggactcagtgtcgtgtccctggccgacgaggaggacgaggaggcgaacgccgccggtggcggggtggattacggcgacgacggggtgcccctcgacgacgacggcgaggtgttcgatgtggccgatgaggtcggcctcgagggggcgagggtgcggtacccggccttccgcatgacgctggccgagctcctggacgagagcaagctcgtgcccgtggcggtgaccggcgaccaggatgtcgcgctcgccggggtgcagcgtgacgccagcctcgtcgcggcgggggacctctacgtgtgcgttggggaggaagggcttgctgggctcaccgaagctgacaagcgcggggcggtcgccgtcgtcgccgaccagaccgtcgacatcgagggcacccttgcttgccgcgcgctggtcatcgtcgatgacatcacggcagctctccgcatgctccccgcctgcctctacaggcggccttcgaaagacatggcggtgatcggtgtcgctggcacggatggggtcaccaccacggcgcacctcgtcagggcaatgtatgaagccatgggtgtgaggactggcatggtaggcgttctcggggcctatgcgtttggcaacaacaaactggacgcacaacctgatgcctctggtgaccccattgccgtgcagaggctgatggcgacgatgttgtacaatggcgctgaggcggctttgttggaggcaaccaccgatggtatgccgtcatctggtgtggacagcgagatagattatgacattgctgtgctgactaatgttaggcatgccggcgatgaggctggcatgacctacgaggagtacatgaacagcatggcctctctgttttctagaatggttgaccctgagcgccatcgtaaggtggtgaacattgatgatccaagtgctccattctttgctgcacagggagggcaagatgttcctgtggtgacatattcatttgagaacaagaaggctgatgtgcacactctgaagtatcagctttccctgtttgaaacggaggtcctggtacagacaccacatgggatcctcgagatttcgtcaggccttcttgggagggacaacatctataacatccttgcatctgtagcagttggtgttgctgtcggtgcaccactggaagacatagtgaagggcatcgaagaggtggatgcaattccaggccggtgtgagctaattgatgaggagcaagcatttggggtgatcgttgatcatgcaaggactccagagtctctttcgaggcttttggatggtgtaaaggaactgggcccacgtcgaattgtcacaggtattgtactttcgtccatagcttcattaagattgtgaatatgttggacatcttctctattttgttgtagtatancgcattgaagttcctgctatgatgtttgatgtagttattggatgttgtggtgagcgagaaagagggaagaggccagtgatgacaaaagttgcagctgagaaaagtgatgttgttatgtgacatccgacaacccagcaaatgaagatccatgtacggttctttctatttgattatgatatcatattgtgatgtaaatgcattgggggagctgaagttttacacaaattctgtgtcctatttcttagcagtggatatcctggatgatatgctggcgggagtagggtggaccatggaagaatacttgaagcatggcacaaatgattattacccaccactgccgaatggacataggatattcctacatgatattagaagagttgctgtacgagctgctgtcgcgatgggtgaacaaggagatgtagttgtaagttttctatgaagttcttattgtcaagtaaccttcttacaatcttactatatataaccctgtagattgatgaaacatgctacacttgagtcaccatgcatatactcctgtatagaaatgcttaatagaggctggacttaaaatttcaagaatgaagtagttcaagtacctaatcccattagatgaggaataaaaacttgcaaaataggctattgtgttgcaatctatctgtttttgggcaattctatctagtaataagctgctctagtttttgtatatttgcactctctttccattggaattgctagttaagagtgagttggtagcattgatcttctgagataacaggcttggtagttgaagtaattaattatatggttttagcattcaccatctgccccgctctccagttgggaagtaagggttggagaagggcaaatgctcattcttcaaaccaacatttaagatcaaagagacaggtggagcacttcttgttcatcatgctgacagttctgcttctccttcaggttatcactgggaaagggaatgatacttatcagattgaagtcgataaaaaggagttctttgatgatagggaagaatgccgagaagccttacaatatgttgatcaattgcatcgagctggaatagacacctcagaatttccatggaggtgtgtttccttttaaaccgctaattgttagggcttgttcactttctaatactttaggctttgcctttgttttaccaaaagaaatccagaaaattttccagacaatcaccaccttttcatctaatgcacactttgtgttttagtttagcataatttcttgtttttaagaaaaagtttggtataacttgctcagagttcttttatgaaaaagtttacttcaaaccagaccctctgttatactgattccgtcgctcgatttcttttgtttcatgtgaaaaccaccaaatcgcttattttgcttcgttgtgatttccacaggttacctgaaagccactgattctgatgtattcaatatagccgggcttcttctttgcttgctcaaggagcagcattttagattctccctttttgctatggtaggatgtacttcagaccagcgggtgctcaaggttgactacttgacccccagtactaactgctaacttctcagtgatactcagtaggtacaaaatatatgcaatgcagcttccccttaatttctgctgccattttctatgttctttagtctaagtttttcatgtcccatagtcacaatccagtaactcacacacaaatacgtacaatgaaatcctgattgtggaatatgtgccaaacatcattcaactaattctgattcatcagaatggaagattggcaggacataccgaggaaagcgaatacttgtatggataaactaaaggtgcaaaacgtcatgatcagaaccagaggccccattggcatttatcaatcaccatattatagtccagcaccaaaaggtcacctgggggatcaggcatttggatatgcaagatgccaaatcccttatcttattcttctcttacaacagccaaattcagagatcacataaattttaatatccacttgagcggtcagcacacaaagacattgaacttggctgtaactggatcctctacatgatttttaatataaacaggggcatctttttaatccaaagaaaaaggcagagagacatggtatgaatgattatgaaattgcccacgttttggtctgattctgaatttcctgataggattgcgacaagttcagaattccggaggaaagtcgcctccttcgtgtcccactttgtccatgtatatcactgttccccgtgttgctgctgctgcctggggcttcaattcctctctctctctcccctcccatggcgtcactgtcgccttctcctacgcgaattgagaggacagcttagctcgatggatccggcgacgcgggcggcggcggcggcggtggagaaggtgttcgtggcgctgccggctgagaaggggaagacgacgctgtcgtgggcgctcggacatttccgcggcagcggagccaagctcgtcgtcacgcatgtgcatgtgccgccgcagacgatccccgtcagtacgtgccctgcccccccccccc

SEQ ID NO: 17438 - DNA, 14072 bp, Oryza sativa
catgttgtcatcttttgcaaaatacattctctaaatattaactaagattatcttcttcttttaatctcagtgggagttcagtttcatgttagtaacgtgagtccggagcaagtaagcttgttcagaagaactgagcgtgaaagggtgaataagcttttagacgaatacgtccatcaatgctggaaaatgaaggtgctatccattttccccatcttcctccatttctcctgcagtttcatgcacctggcatcagatttttgtgcagtagttatcattaagatgaccttttggttggttgctgccacattagtagtagtacttttttttttcgcgaacacgcaaaggattgcacgtcaatatattaaaagaatagagtttttgttacacgacgcactcagccagaccggcctatgccaaggaaggaagaaaacaaagataaaaaacaaggaggaaaaggaaaaaaaactcgatacgacggtaactctactccaaacagcgggagggagcagaagtagtagtactaattacattaaccgttgaaactttgcacagaatcaaaatgttttcgaaggtgaagattcatgcttaaccttgatttacaatggttcgtatatttcaggtcaaatgtgagaaactagtcattgagaaagaagatgttgtagctggtcttcttgaacttattgcctctcatggcatcaccaagttagtaattgcagctgctgcagacaagcactactcaaggtacatctagcattacaaaattgtttcggtgtaaagattcaattgtgctatgtatttggtagaattaggaagttcagattatatttatccttctcggtttcagaaagatggacaaaccaaagtccaagatagcaacagaaatcatgcagagagctgacgcatcatgccagatttggtttgtgtgtaaggaacagctaatctgtaccaggtataatctgatgtgttgcacacttttcgatttctgatgactattgaacatcgaaccctcagaatctctgattcagttctccatgacagggacaagaaagtagaaaccacacaatcagttacacctctcagccaacttttcaagattgatactcctcccagccctgatattggtcagaccattctgcaaccgtcagctgaacaggaacaggtttcatcagattatgcagtagatattctgatttttaaaattgtatcttcaaagcatgagtataacatgatagcggtgcttttgttttcagaatgacaatgagatggaattggggttttctgatgagctcaatgatgcacgcgtagcagctgagaacttgatggagagagctttaagcgaatctttgaggcgccagagagcagatgaacaagtggtttcatctcttcagaaagtaattatgctacccatttgactgatttcttcataaatgctaaactaaaagttggcaatactatttattttaaaagattttgataataactctgaacctcccaggtcaaacaattcgaggagttgtacttggaggaggtgaaaaggaggaaagaattggaaggagctcttgtcaaagcaaacttagaacttacacggttaaaacaagaaatggacatacctaggaatcaccagagcacaatcttgggggatcgacaagaagtgattaccgataaatttatcttgagacaacaaactgtcgacatgaagagtgatttcggagccacaggacaactaatcaagccacagcaggagtatcttcagttacatcctgaccatgacaatggtgtcagacaaccggaaacgttgctacaccgaaggagcctgactgcattttctccagcatcaactgtaccatcacagtttgataaagactccattccttcccacttcatctgcccgatttctcaggttttcatatcctcagacaaacaaaatctcaaaattctgtacttttctttacagtaatataaatacttttgacaaattatgttgcttcagaagagacgtttgagttgaccatgttttgatttgcatgtaattgcaggagatcatgagggaaccctgcattgcagcagacgggttcacctatgaagctgaagcgatcatcaattggtttgatgaagggcacgaagtgtctcccatgaccaagcagcctcttgtgcaccgcgacctgatcccaaactttgctcttcgttctgtaatccaagattatacaaggagaaaacagtattcattttcctgatgctatttgctccttttccccttctctgactcactcaattttttttgtgaatattgttgtgggtgacatcgcactgacaaatggattcagctgaaagcaacagcatttttaaacagttgtcatgtgttgtttgttttgagctgtcagctagtgcagcaacagagatgctgtgttgatgacctttttttgcctctttgatttataaccaatcaggtcagacaagattatgtgctggcataaatcataatatccctgaatgtcacattttgcacgatgaagcctaaacaatcacatgaaaacatgatggaaatgcagcccatcgttgatggcaaatatagtggaaagctgatactttctctccatcgttgccagagcacaggaagatatttgaaataataataataataataataataattaaaaatcagattgagaattgtagaatcagttgatggttcagaaaggaacacaacaatttcaaggcagcgaaacaactctgttagcatacgtggcacctcattagccaagaaatacagctcttaatgctgaacctagaaggtcaatttccatgtttgttgacaaacttaatacccaaattgttgtatctgagacgctaatttatatcagaattattcaaccaaatcagagtactctcacaagcatttcagcgcactaaattaagggcctgtttgattcagcttaagattattataatctggattattatgagcaagctgaaacaaacaaataacttattataatagattattataatctataagccagattactataatctggtaatccactctaaagatgttttttttaattattgggtggctaacaactaataatccagagaatcaaacaggtaacagcttattttttattggcttattataattcagtttatagtaatctaatttaataatttatattatataattatcttaagctgaaacaaatagatcgtaaggtctctacgggaagaaatggaggaaacgaatttttgggaagaccaaacatgtgttcctccctacatggccatgatcatgagactccaatacaagttctcttcctcttcgttgctccctcttttctgcttacacgtaggccgtgtcattgagttatgtgcttgcgatcacctcgattgaaggagaggaatggatgggtgctttgttctgtactccatgcctcagcctcttcttttcctccttgttgttttctccttttgctttggttcttcttttgttcctttctctttttctctcatgtaaatcttgatgacaggtatcagaggatgcctttgtgtcgtttctcttaatttatttcgtgtaaaccttctgctggtttaccttctgattttctgaatgagaaaatacacccactgaaatagtgagtgatttcatgcactgaataagcttatcacttaaaagaaaactttaattttggaacctaactgtggagtttctttttgtcatactctgtttttcagctttagcttttaaaccgtaaataatatagatataaaagatttacttataagctatttttattatttcatttatgttttcatgacttatcaactaaagctcaaacgatcaaagcctaaaggcacaacaaatcacttcagcttggccgcgttcttttcagtggttgggtttggacgattagccaaatgtaaaacgagaaacacgaataacatataattagttaagtattaattattaaaaaaattaaaaaataagtttatttgttctttaaaacatcttttataaaaaaagtttcgcacaaaatacaccgtttagtaatttgaaaaacgtgctaacgaaaaacgagaaatatctaagcggaactagctgtttagaatgtggaccctttttatatcacgtgtcgtttgtcaatggcacgtatttctcatgtgattacacagctccaacctttcacagcgatgatataaaactttcactcactgacagcatatatatttgtagtcattgtttttttgagcggtatatttttagtcattagccaataagaaaaacaacttttatcctggagtaaatagtaattagctggtaatcacatgggcaaagttgtaaaattacctaacagcgggccccataggtcaggccccatcccatcaggggtttaatccagccgaaacggcgagtagttctcgttcccctgaggcctgatcaccaccctctctcctcccctttccctgaccccgcgaccgcgccgcgcgaggcgaactcgccactccgatctctctctccggcgacgccgccgccgccgcacaggttggtagtcaccggagccctcccttccgatcaacccttgcgcgcaatctacccatgcatgttcatggacatgacctgctgcgtttgtttttcactgttcattctgatgtctctctctttttttttaatttaattttatttatgttgtttgatccgtttttgtttgtgatggttggggagttagggttttgctctctctcgcgcggaatggagagcggcggggtcgacggcgagaggcccctgctgcgcgaggcgggggatttgggtggcgaggacggcggcgcaggcggagtccccgaggagggggatgcgaagggcgatgtgatggcggcggcggcggcgcaggggggcgatggcgatgagggtgtggaggcggtagatggggacgggagtaacgaggaggaggaggttgtgcagacgcccgatgtgaagcagacgcccggcgccgcggccgcggcggcctggcgggaggcggcgtgggaggaggctgacggcgaggagttcgtggatgtcttggaaggggacgtggatgagaagcgtgaggatggatcggccttggagaatggggaggatttgttggcctcccgttctctcgctgtcgagggtgacgaagaagggtatggttcttgtgctgatattggtatagaagaagacgctgagggtgatgcgagtcgggagcgcttggaggaggaagccatgacggaatcaatcagggagtatgtgacagaagctgttttggctgaccatatccaggagcaaccggacaaatcgaagagtgaatctgaacatgtgaaggttgctcagcacaagtcgcagattgcgaagagcagggaagagggacccaaacaatctggaggcgaaccgtccgttgttgtcgaggaattgaatggatcaagctcgtctgatgatgagagtaaagctacctccgctcctcctgcacgatccattagtggtgctgcaggtcgttctaatggcccctctttgccatctcgtcctgctgggcttggagcatcgacttccttgtcgcagccctcagctcgacctgttcagcagacccgcgctaatggtccagtcgctgtggacagagaaactcggcaggatgttgaatctcctgaggatggagacgaaaatgatgaaatccgtgagaaactccagatgatccgggttaagtttctgcgtcttgctaacaggtttgggcaaacacctaataatatggtggtttctcaggttctttaccgacttgggctggcagaacagcttagaagaaatacaggccagggtgtttttagttttgaccgggcacaagatatggcagaacgtcttgaagctgctggaaacgagccccttgatttttcttgcaccatcttggttcttggtaaaactggggttggcaagagtgctaccatcaattctatttttgatgatgtccggttggaaacaaatgcttttgataccagcactagaaaggttcaagaagtagttggtgcagttgagggaatcaaagtaaaagttatcgatactcctggcctgtcatgctcatcttcagaccagcaccacaaccagaagattctcaattctgtcaagcgacttatcagcagaaaccctcctgatattgttctttattttgatagactggatatgcagaccagggactatggtgatgtgcctcttctgcaaaccattacaagagtctttggagcatcaatctggttcaatgccatagttgtgctaactcatgctgcatctgcaccacctgatggtctgaatggaattcccctgagctatgagatgtttgtaacccaaaggtctcatgtagtccagcaagctataaggcaagccgctggtgatgtccgtcttatgaatccagtgtccctggttgaaaaccactcagcgtgcaggaccaatagggcaggccagagggtgttgccaaatgggcatgtctggaaaccacagttgctattgctttgttttgcctcaaaggttttagcagaggccaacgcgcttctcaagctgcaggacaatcctgctggtaaacctcgtatgaggattcctccacttcctttcctattgtcttcgcttcttcagtctcgagccccactgaagttaccagaggagcagtttggtgatgatgatgatattgaagacgatttggctgatgattcggattcagatgatggttcagactatgatgacttgcctccttttaaacgcctcacaaaagctcagcttgcaaagctaaaccatgctcagaggaaggcatatcttgaggagctggattacagagagaagttattctacaaaaaacagctaaaggaggaaaggatgcgccgtaaaataatgaagaaaatggcagcagaggccagtgcaagaacagatgacttcagtaacagcaatcttgaagatgatggcagtgctccaacaaatgttgcagtgcctatgcccgacatggtattgccctcatcgtttgattctgaccatcctagccatcgctatcgtttcctggacacaccaagtgaatggcttgtcaggccagtgctggagacccagggatgggatcatgatgttggttatgaaggtctaaatgttgaaaggttgtttgctgtgaaaggtaaagttcctttatcagtgtctggtcaactttcaaaagacaagaaggattgctccctccaaatggaggtcgcaagttcacttaagcacggtgaggggaaaaccacttcactggggcttgatttgcagtctgttggcaaggacatggcatacactcttcgtggcgagtcgaggtttaaaaacttcaggcgcaataacacggctgctgggatatccgccacactccttggagattctgtatccgctggtgtgaaggttgaagacaagcttgttgtgaacaagcagctcagggttctggttagtggaggcgctatgagcgggaggggagatgtggcttacggagggcggcttgaagcaacattgaaagacaaagattacccaattggccgcatgctttctaccatagcgctctctgttgttgattggcatggggatcttgctgttggctgcaacatccagtctcagattcctgctggaagagctagcaatttgattggtcatgcgaatctaagcaacaagggaactggtcaagttggcattcgcctcaacagctcggagcatcttgagatcgcccttattgccctcgtgccaatataccaaaacatcaagaagttattgcagagttaatccgtatcaaccagtatttatgtaagcgagaaaaggcagcaagataaatccattagagttaatgcaagcataaattagaactagagttaatgcaagcataaattagaactatctatttattttcttcttcccttacctacacgtaatagtgttttcttccaagtttttttttttttgatgaagttggatttgcagaacacatccttttcaggatttttgttgttatccttgtactctcaatagctgataagaaaaaaaaatgcactgctgttttgaaggctgcaaccgccgagtatcagatcgttttgctatatttgttaagatcgttttgctatatttgttactcatattaaattgtataaccatatattcttgtcccaatcgacttggaaaatactaatactccacattctattgtgtatagatattgtttggtcttatgattcttgtgttgtcattattgcctctagtggaatggttttcaagagtgatgtgataagttacaagaataatttgtcttcagtcagcttgactgcttcaagtgtgaaagcaatgaattagccccatcatttagcagtttggttgtttgaaggcaaaggcaaaacaacatatttacaataaaaaataatttataaataaaacttttatatacgtgttctcgacgatctagaaataaagattaaaaaacaaacaacaatgaaaaaaactctaaaattaactctaaattaatattaaaaatttaaattttagctgataaatataaacgaaaagagatggtgccaaatatgtatattttcacaagtcttcccatacaaaaccaattaacgtctcaattgggtcccactgccttaggcagttgactacttgactttgattcccgccaagtcttcgagggccccacctgtcagccgtggacccgcgcttctcccccgaacaaaatgaaaacgactaatctttataacgagcagagtagcatcatatctccagtttgttagacaagttaggatccttaaataacgtcctaaactaacccaatctgcgacataatctcgtttagttcgtggacttaatccgcgtctccgttggttaatatagttacagctctagctctggatcatcgcgagggagttagtttagttagttaatcagttgggaacacacacgtcggccgtctcgtctcgcgccattttttttgatgggctcgaggggcggcgacgccgacgcgtgggagacggcgagcgcgcggagcggcgtctcctcctcctcctccggccgcgcgacggccgcggcggcggcgccggcgccggagaacaaggtgttcgtggctctcccggcgcagcacaagagcggcaggtccacgctcgcgtgggcgctccggcacgtcgccgaactggctccggcggcgatcggcggcggcggcgaggtggtggtggtggcggcgcacgtccactcgccggcgcagatgattccgatgagcagtacgtgtgtcctcccgcttcttcgccttctctcgtcgtcgctctgcaaacccccacgccacaagctgcagggcttatatcagccgttcgattagctatgtacggtcaggattcagacggccctgattggctgatgcattttttgtgaggaagcccctgtagtttttacgtattccattctgatgcatttttgtgaggaagcccctgtatttttttcgtattctattctgaactcctttttagttcactactgagtcccagtcctgaatcccccaatgcggcgccccctgcctcgccggggacggcggcgaggggtgtcgcgacgggagctcactccggcgacggcgagcatcttcgcgcgcacaattatcccgaggatgtggctgggctaggatcgtgcagagattcccgcttccttttggtccaaatgcgactgggttttagccttttagggcaaaggggaagtattatttcctactgagttgttcatcgattcgcttgtctgaattgccaaaattgtttagtgtctaggtgattgtattcggttttttttttcaaactcttaatgcgaactgataatttctagtattggtgcccatggatgcacgctgagtcagttcagaatagaactgaagtagtggtcagtctcagtccacagttcacagtaaatattcattttagaagaacaaatcgcgtgaaggttgattagatgttgacctcatgtgttaaatttcagctaaatctgctattgcaacttcaaatgacatactttgttcgcgtggtgtactaattactaaacaactcatctaattacatggtagtgggaggcaagttccatgcaagtaaattgagaccggaacaggtcagtacttacagaaaatatgaaagggagcaggtggagaagaatttggatgaatacctcgagcaatgcacaaaaatgaaggttcaggcaatcttctcattcattcttagtaatgaagtctgaattgctatggggaacaagttaagtgtattatatttttcaggtcaaatgtgagaaaattgttattgagaatgaagacattgctaatgggattacagagcttattttgctgcatggggtaagtaaactcgtcatgggagcagctgctgacaagcaatactccaggtgtgtcttcatttctgctaccgatttgtacttttgttgcatcatatatctagctaagtgatgcctcaaaactctaatttcaggaaaatgaaattgcccaagtccaaaacagcactctcagtcacggttaaagcaaatccttcatgcaagatttggtttgtttgcaaggagcatctgatatacactaggtattaagaatatgatcatgagcagtatgcatgccatacctctggaccgaccagtcatctgtatattcatttcataccgacttcatatattgtttcctagatactagccattctgttagtgttctcccttttccaaaatcattttgagtaattctctctttaaactgtgttcagagattttgttgctcctatttctccaaattcacaatcacctgacactatcagaggctcaatatccaatctagctgcacggggaggaactacaaaccaatatgcaaacaatgcagttaacggttacgtacagaggtccatgtctgaaatggttgtccctgcatctagcagggtatcattgcaactgcattctcgatcatcgttacaggagtcccttagcaggctaaacatggagggcacctctgttgattcctgggatagcttccgcagaggaagctttccaagttcataccgagcttcttctactgtgactgaagaagtgttgagcgattctagttcatctggaatacctagagatggcatctcaacacttgcaggttgtgactttccaaactcagcactgcaccatgaacaggtaagctctaataccaaatttaagctttggatgattagctaggaatcttattccattacatggtgctgtatccagggtgacgcaggttcaaatgctaacctatttgataaacttgaagaagccttcgcagaggctgagaagtataggaagcaagcatatgatgagtcactgagaagacaaaagacagaagaagaattgatttcatatcaccaaaaggtaaacccttcactaagttagcataaaaaattgcaggtttttttacacaaagatctaatggacctggttacaggccaggaaatctgaggatttgttcttaaatgaggccaagcaaaggaaagaggttgaggaaaccctagcaaaggcaaatgtggagatacaattattgaaggaagaaatggatgcactgaaacacaaccgagatgacctcagcagtaagctttccgacgtgagtgaacagaaagtgacactagagcaacaggccgtggaatatggaagcattatcattgatctcaaggatacagttgcagcaagccaagccctcattgattcaatgcaaatggagtttgaacaattgaagcatgaaagagacaatgcactcaaacatgcagaagagctgcacagagagaaacaaaacatggtatcgagctcagacttggaatggagcactgaattctctttgttggagctgcagcaggcaacacaaaatttcagtgatgcaatgaaaattggagaaggtgggtttgggtgtgtctacaggggtcagcttcgtaacaccactgttgcaattaagatgcttcgctctcagaacttgcaagggcagtcacagtttcagcaagaggtaatagattaatagcaactctgaaaccataattgcaaattgattttgtattgctttagttgtactaaactaatgttactgggcaggttgctgttcttagtagagtaaggcatccaaaccttgtaactcttgtaggttattgctcagaagcttcaggtcttgtgtatgaattcttaccaaatggaagccttgaagaccatctagcctgtgaaagcaacacgtctccgcttacatggcagatccgtacacggatcatcggtgagatatgttcggcgctcatcttccttcactctgacaagcctcacgcagtcatccatggtgatctcaagccagcaaacattcttcttgatgcaaatttggtcagtaagcttggtgactttggaatctctcgcctcctaaataggtctagcacagtgtccacgagcttctaccaaacaacaaatccaaggggaacttttgcttacatggaccctgaatttcttacaactggggaactaacagcacggtctgacatatactcatttggcattatcatactgcgactggtgactgggaagccagctttaggcattgcaagggaggtggaggttgcacttgataagggtgagttggagttgcttgttgaccgatctgctggagactggccgtttgtgcaggctgagaagctgatgcttcttggcctgcagtgtgcagagcttagcagaaggaagcgccctgatcgtatgaatcatgtgtggagcgtggtcgaaccccttgtaaagtctgcttcgctgccagtagaaccagaatccattggacattgggtgaataagaaccgcacgccattctacttcatatgcccaatttctcaggtatgcatgtccaacctctccgcggtgcagtaaataacatgtcatagactcatagttgcattcacgataactgggattacaaatgtggtaagcaaaagctgtggatgttttgcttctttattgcaatcgagtatgatggaagcacaacaccatccatgtttctcagtacttggctgtgaacatccgtttggatgtagaggccggtttaatccattatctaaaagcaaatgtttctcagaactatccaaaagttattgtgttggcggttctgtgtatagtacgactgaatttaactttgatatttttagacttatggcatgttagtttagaaatacagcatctcgtgcttaaaaatcacccatgttcaaggcttaaagatactaggagctatctctgttctaaaacaagttctggttttaccgagagttgcttccttgagaactgttgccacacttaatgagggacagagatcggaacttctttctgagggaaaatatgaatgttaacaagtgtgcatgctttgatctctcagattttattgttgttctggaactattttttttttctgatataactttctgaataattatattatgcttgctgaagtagaatattaaagttccttgcagcattttttggtggggaataataatatgctactaacagtctaacagctgctgagcttggttgaaacaatattgtaggaggtcatgagggatcctcacattgcagcagatgggttcagttacgaagaggaggccatcaaaggatggctcggcagcgggcacaacacctccccgatgacaaaatcaactctggaacatcttcagctgatcccgaatctcgctcttcgttctgccattgaggaatttatgcagcagaagcagcagcagattccatcatagtaattagttcagtgaacttgattattcttagcttcataagttgtaaagttgatagctcattctttgttcagaagtctgctcgtgtagtgtagctgttttgttttgtgagcagcaacttacaataaatcgtgcatgctcatatgagcaggtgatgatcagctagcaaatgtttgatgtcagattgtgcttgaacataattgtttcaggccacttagaatcatgggacttatcagtttactgttgttggaaattggtaaaaatgaatatggagatgattttttccccctcgaggtgatgtctcctagtgg

SEQ ID NO: 17439 - DNA, 6667 bp, Oryza sativa
caccggatacttccccgtctcctagtgagaatatttttagcaagtgcatctagggtatgcatgtggtataaatagttaaataaaaatataaaataaaattagcaagatatattgtgataatataatttggtacacaaacatgcaactacaaattcgatcttcaagtaaataaaaataacaagttgtgtttgtatttttttgttcaaattttgttatttttgtttctcaaaggagatcatatttaactatacatgtatatatacttctagcatcacatcaatctaaacctttttttaaaaaaaaatgcacgactatttagatgacatgcaaacgtttgcataggtgcgattccacctagctaggagtagaaaatccatgtccgtcttctcttagcgtacgtgtaatattataggaacaaatattaccgtataatatttttttcaacttgtatgtattgaatttgagttttcgcaaagtgacacatatttatcaaaacttttcataagtattaggatagcatacaataaacaaggggacacacatagtaaatcaaactgttgtttatcatagtaaatcttcccggagaatcagatgctcagaattcatagtgttcttcagcatcttacaacttacaagatggcgcagatatacaagcgcaactatcttaaagtaagctgtaggaggaaatggaaccatttctaacaacgggaaaaatataggttatagaaggaaaccatttgaacaaattaatagggaaataaattaggaggatcgtttccgtccgatctcaatagaactggacgtttgatacgtagatggcgtctggcatccagttgaccgggatgacgtctttggcgatgaggctcttgccggactcggtggtgacgcgaatggagaagggtgccttgagtggcgtggcggtgtccatcctccagatggcgccccacgacagcttcatgggcctccacgctggcaatccggcctcctggaggtccatctggatgacgtcaccgtcgtcggcgacgaacttgacgagcacggcgaggtagttggggttggagcccttctcgacgtggaaggtgaccttctggccgccggggtacttgcagcgcaccctcctgaactgcatgtcgatgatgccggccttgcggagctcggtctccttccccgggcaagccatggcgccgaacgccttgccggagaagtcgaagtggtacgccgagatgggctcgtagttcatgtccgtgatgaacaccgtcaccggctgcttcgagcacgccgccggctgctcacacttcacctgtactcaaaatgtactcggccaaattaatgcccaaatcaaaatgtacctaacgtaaatcgatgtccattaatttagcaaaattccatatatatattgcattgaatgtttgtgaaatataaactgccaaaaatgtttgtgaaatagcaatgtattaaacattgacttgttgataagatcaggccgccttaatttgaaacacaagagttttactggatatattttcattatataatcactatagttctaaattaacccttatgaaattctaaaatgaaattcctttgtttcgaaggagatgtacgaatgcatgtcctcgggacaatgattgggagagtacgagacgatgaggttgtgttaattaattggtgaggttacctcgtagcatgagccgcatcccctgccgtccttgaagattgggacgttgccgcaggagatcatgccgttgtagggaggcaggttgacgttcttgatcccgcacgcgccacctggaaaaaaacaaaactcaaccaattaatcgatcgatcgccatagatcatggatgagcttcacagttactccatcgccatggatttagacactgttcagattcgttattctatcgtactatcttgagacaaagatagtaacactacatgatgagccagtaaactaatattttgaagaggagatagtaacattacacgataagatagtaactttaccgttgtcggcggaactaatattttgaggcggagagaataacattacacgataagatagtaacattaccattgtcggtggagccggagccgtagggctggccgtaccaggtggccctggcggggagccacggggcgttgtagttggtcgtgatgttcgggccgggtggcaccttgggcgggccgcacgacccgccgccgaccagcgctgccaccacggcgacggcgaggacgatgttggtggtgagcgatcccattgtcgcttttatttggcttggtgtgttttgtttttttttccttttttttttggtggtgagatggatgacaagatcaagcagatgcctacgtatttatagtcggcgaggtgagggcgcgggtggacggccggtgtcgccggcgtcgcgcgcgatcgtgtcgtggggttgggcgtgcgtgcgtgcgttcgtacgtgcgcgccgccgccgcgcgcgggagcgattcttctccggtggttttgatttggtcatgcgttttgtacgtaatttgtgcctgtgcgcgcgccgagttgacatgtacgatgggtggctgagaaagctagcctgagatggaaggccagtgtgcgacggtgagacgacagttaagctggctgctgcgtttatgcgtacactgtcagtgtgtacagtgatcaagatggagagatatatattctgctggagaaggcgaaatatttggtgattaatgttgagtcttttccagtcccgtatttcttattgctttccagttttgtagatttgctcatgaaatcaatactatatagtatgtagtactggtataagtaatgacaaggttacttcctaatggatgaacacgcttacacgcccgcatgcaggctgtcatgcatatatgcagcgcaattagtaagattttgcatgcggcagatacgatcttgcattaattctttcatgatcctgcatccatccatcgtaggtacttcgtccatttcacaattcacaatgtaagtcattctagcatttcctacattcatattgatgttaatgaatctaaatagatatatatgtctatattcattaacatcaatatgaatgtggaaaatagtagaatgatttacattgtgaaacggagagagtagtagctatctatcccgatgtatcgcgtgcaaggcggtgcaaacgcagagccgggtcggcggcggcggcgtgctcgcttccggcggaagctacggcggcacggccaccggccgccgccttgcgggaagccgaatcaaaccgcgggtgctacgcgaacgcggccgatcctgctgagtgatctggagatctggaccgtccaaacacatgcgacatgggccttatgtcctcccttcccaatcatgctccggaataagttcatctgaggtcccttaactttacaccgaatccgattttcgtccctcgatcggaaaaccagacacaacgggtccctcaactatcaaaaccggtgcagatcaggtccctcggtggttttgagggcggttttggctgacgtggcgcctaggtggctaatttgactcggtcttcgtccaacgtggcattgacgtggcgctttacgtgtcaattcgacccggaaaaataataaaaacctagggacccacatgtcagtctcacatagaagataataaaaaattgtgggacccacgtgggccccacatgtcagtcaaactcacccttcctcttcttcctcctctctccccatctccctctcttcatctttctcccctctcctctcctcttccagcgagagtggcgagctggagggggcggcgagaccggcgtccgccggcgagagtagcgagctggaggaggaagctggggcgataaaaggggatcagcgacggcgatgggcagaacagatcgacacgggcggcggcaggtccccccggagcagcgccggcaattgagatccagtagtggcgggcaggagaagggcggtggccggcagggagaaagggcggcgtgcagcgatggccgccggaggaggaggaggagatgcagccatgcggggaggcgtggcggtggcagctggaggaggaggacgtccgccgtgcgctgctcccctcggtagtggcggcggcacaggggccctaggagtcgccgaggatgccgaggtcgacgtcgacgtcgtccgcggcccggccatggcttccccgtccgcatccggcgtgcaccacagaagcggtggcatggggagcggcgccgcagctacggtggcggcggcgtcaatggggggaaggggaagcggaagctcctcgctccggtgggctgccgctgacgagctcggtggtggtgaaacgcgacggatcgagcaccatcatgggggctgggggccctcttcggacctatgttccagaccaccgcattcgtcctcttcacccatcgccggctgtcgtcctcctcgctccggtgggcggtcgctgacgagctcggtggtggagtcaaattagtcacgtaggcgccacgtcagccaaaaccgctctcagaaccgccgagggacctaatctgcaccggttttaatagttgagggacctgttgtgtctggttttccgatcgagggacgaaaatcggattcggtgtaaagttaagggacctcagatgaacttattccatcgtgctcctgctacctataatgggccgcacccccgttctggcccagctaattatgggccgcattttgctcgctgtcacgttccgggccgaaaatacgtgctcggacagaaaagccggcccatcaagatcgtttttcatgaaaaattctctaacattttttgcctgcacagaacgttgttcgactgatctctgagttttggatggccatcgcacttcgcaacggaatggaggatacacatttgcctcttactaccattttacgtgttgtaacccaagcgaataatgctatgcctgcatttaaacttcttcagaaagaggctgacaaactcgcgacataaagatctgaaaactacactcatcttttgcactgaacaaaagtcggtatgaatttggctagttctgaataaaagtcagtatgaatttgactagttctgaagaaaaatctgtatgaattcggctagttctgaagaaaagtgatcatatggatatgctgtgtttactgtttcctgtttttgtgctcaatttcttttcttttgtccgtaccttggaatgatcagtagatgttgaatgttaaatggacaataacatgctttgggggtagatgcttggccacgggatgctgtcatgcattttgggaaacttcaaaccatgcttggagaattttcctccgtgtagcggccatcaacagacctcttaaccaaactcgcttgagagaagttcagagaagaagaaagaaaaactgactcctatcttgtcctcccctattactatcagattctcttaagaaaacatgaaagatgctttttcagatagatagttcctttctcagtttttcctggcttctagcctgctatgtttttgctatgtttagctcagtaaacaactggtttagctaaattgaagctagtgtttagttgtcttgccaggaaaagctggtctagctcagcatgctctacaagacagagtgatttgctaattgctactagaaaatcacccattcaataggaccatttcctgtgaactactgatcaaagtggacctaaaataactgctgtttctatcagtgagcagctcatttagctcataataacacaatatggtattatagtcatttatatttctgatgctatgtcctatgaggctatgatgatggatcaaatccatctctgatacagtcagcttcaggtgtgtagagctgctcgtgtttggatcgttgcgccttacaaaatcatgcataaggaaacaccattttctcacagattgaggtgaattaatgcagcagcttcagttgatcatttccaaaatttcttgttatctccttacatctcttcatattccatttgaggaaactttgctgctaatgcttgtgatagagtatgagtgctcagagcaattttggtatagagcagtgaattactactatgatatcgacaataaaagaagagcatatgctacaaacattgaattgtttggccaaaattggcagctaattctaaaggcgcaaaaatgtacgatagagaattatatgaggaaactagtagctaataaccaatatcactttccagtataactgggtttcacaaaccatgagcaatctcccagagtttattatcacaaattgtgccttttgtggctgcttagttattcttcaataaaatgttgttcattaaaaaatcagaaggaaaagcattcacattgtggcggacgcaagattagcaaaacatccagagtaggtacttgaaagttgaaggaacttatacagttatatgctagttgagtagtatatatgaaattgttcattttttcctgggacctcaggtttactaccttaccttagtacgatgcacgaacattatgtgagcgagctacaaatcagaactaaaacctactggaaggaagtccgttacacaattagtcacttaacaaaagcaataggacaaaattaaatcagttactaagcgtgatctggccacgacactaaaaaaacggttaatttctcccaaattttaacatcagtaggcataaag

SEQ ID NO: 17440 - DNA, 21361 bp, Oryza sativa
cggatcgactcgacgagctcctccgcgtggtcgcaggcgacgcggaaaagctcccaccgctgcttgaacgcctcgagcgccgcgtccgtggccgcgttcttctctccccccgactgcccccgcgcctccaccaccgccgccgccgccgccacgaactcctggtacgcctcgctcagctcgtccaccgtcgcctccatctcccctcgccgccggcggcttctccccgacacgctccaccgcctccgccgcctagattccccaccaacttgacctctactcgtcacagtgtcaaactcccaaaccagtagcgtcaaaaaaaaaaaaattcctcgtgggccgcagattcgcggcccactttaaaatgggccgtctcgtgctgtatcttcttactgggccgcacgttaaaacttgggctgggacgcgaggcgagggtttttctcgagggataaatatgggcctcgccgctcgccggagcggcggtggcttccccctcgccgacggcgaggcgggcgaccccggtgggatcctgtgagccggcgacggcttcccccaactcccgcctcgccgcgcgccgatgttgccgtctccctgcgcgattccgccgccgccgcgatgtatttattcggtgttcgccatttctagtcaatcgtcaaaggtgatttgactgtaccacgatgatttaatttcatatgcagtactggtgatgatgagatgtttgcttgttgtcaattttgttcgcctcaaatttcatatgctattattgctgaatcgtcactacccgtaggttgtttctcccgttcatatggagtaactgaaatatgaggccgagatctttagattagatcaccagatagactgatggctctatcactggcacacaatcgatgcactacatcttttttttattagaaatgaaaggcagggaatttgtggtgagcaatgggggtgaaggatgtgagaaaggtagagtcttacattaattcataacatgtccctgttcccagcaaattttgccgtgttgtactggcatggcatgacagcgtaccaaatgactttcctcagataatccattcactgcgacttggtagttgagtgttgcgttgtcttccgatagtctcagtcaagagtcaacctttttacctggttaaactggaatcttattctttaatgctaatacgcagtgtgttccctcttttagttgtccaaagtgggaaacgcaaactggtagatagaagtatctcttagttccatcttcaaggccttaccagttgcatgcatgagtatgatgctcaggcagaaaactctgtttagagacaaggtttatgttgctctccctgagcaacccaccgatggcaagtccatactgtcttgggttatcgatcatgcatccagtagcacggagatcatcatcatccacataattactacatcgaactttggttagttatgtgcagtggctttatctaaagttatttttctcgatgtcaataaaggaggtgatatagtcatatagctatcttatgatgtttgtaccataatctttagcttctggctttctgccatattctggtttatttcctctaaccattacttcttgtttctattgtgttttcggttgcataatccttagcaaagttctattgtcttagttgattccttttttgctgaagaaagccggatgcaaaatgtggacaactatctggaccagtgctcaagaaaaaaggtgcaagataatgatattttattttgttttctgaaaagttcatgtaaaaaatatttttattcactctccccacaaagacttctatgagtaaataactaattatagaacataaggaaaaaaaaagtaacaccaagcaagagtgaaaatggttatttttttacttgatatgtccaaatactgattgttcatatattataactgaagatagttcttatagtagtattatcattgcacaaccaaagccacgtccaggtattttttttcgtctaaacaaaaacagttggtattgaagtagaattattttacaaaggtacaaaaatccactccgtgctaatgaaggttggggacatctcttccataaagaccattcgtaggaaatttatacagggtatcttgttttgggtagaagcaagttttggaagaactagggggattttctattttattttattttattttatttttgctgaagctttcaccatatctatttttgcattgattttttttttctgaatactataatgaaccctctggttccatttttttatgtgacaaaactgtaaaaaatccatatttcaaaccctggttaggtaataatccaaaattttgttttaaactgatcgagattaacagggcatcaaggctttctgccacttgtatgctgaatcatatgaatcactgaggtttacatattgaagtcaacttgtttgactatctatggatgcatgttctgcaattctgttctatctattttatccatgatgttgaaaacaaaaaatcgattgcaataagttaacatattttgtaaagaaagtttagggggaaaattaatgcaaaaagtaatatttacttcatcagagggcaaatttcttattcttccttgaccaggttaaagctgagaaagaagtgttcttttttaccaaaattgacgaaggacttcttcatctgatagaaatatatggggtcactaaacttgttatgggtgctgcatcagacagacactacaaaaggtttctctctcttctctttctctgagttctaacaatcgtggtacagtttcacgttatcagttcttattgattgtgacaaaaatatgactatttttgttgcccagaaaaatgaaagcaccacaatcacaaacagcaataagtgtgatgcaaagagcacattcatactgcaatatatggtttatttgcaacgggaagctaacatgtgtcaggtagggcttcaactaccaaatgggactcttatataaatctgactttattttattgtatttatcttaagccccagttttggcattatttcacagcaaggaatctcaacataacagtacaatatgcagcttaaaataatcacatgtaaatctttcagtatagggcctataggcagccatatgattgatacttcagttttgaaactccaaggcaccgaatcggtattaattggacaaataacagaagggatcacaatcttgactgtttaccaagcatgctgtatgtaactgaaggacgaatagttttccagaatcaaagatcacaagcctattgcagcagataaattctggcagaacttcacatatttagaatgagtagaactgagaaaaaaacatgtgtacatttatttttgccttgtatattctttctttgcgaatactttgtcctgtatatgttattaggacagtctaggttatggtcgagtttgtaccatatttagctgatctacaattcgacatgccttatcttataactatctgcattttgtcatgtaaagtatctgttatttttccataagagaatgattatcacaagtttattgaagcctaaataattcttaatttttcactactttgaatttttcttccactaaacgtctctgtttcttttcgcctagggaggccagttgttgccctgtaaaaaggtcaaaatcagcacgcctaccttcttctgtagacagttgcaaggtggatcttcaaagtttgcttgagcctaatatagaggtaaataccactttgtactacaattaacatgagcttttctagcgcggcttagtagatgttcacacaggaagaccattaagcatgtacttcagagataccaagaggtctctaaaactgttctgaagttaggaatgtggaaatgctataataaactcgaaacaaaatgaaacaaggtagtcttggctcagcaggaagaagttaaaatagttttactctgtgtttcagatcctttgcgcttggtatgccgtattatataatatccaaacttttacagtattttctgttaacaatcgctgattgcatttgcaggctaaaagattgggatgcatgtatattaatgaaatggaactaaggaaagagacagaggcaaaactctcacaagaaaaggaagagtcagaatctctcaaacatgccactatggtgctccaaaatgacctggactggctcaaatatcagttgaatgagaaagccaatagattacaagatctaaaccaacagaagcacctccttgaacaccgcatctcagagtcagactcagttgccacttatctagaagagagcatgaaggttacggaatctcgtgtccagtcactgaagttagagtacagtaaaatgaagcgagagcgagatgatgcagttaaagaggcaaggagcatgcgtatagagaaggagctgacgaattcttgtgcctatggagcaataagctctgagttctccttgatggagttggagcaggcaactcagaatttcagcaatgcacttaacatcggtcaaggtggatttggatctgtatacaaaggttctctgcgcaatacgacagtagctataaagatgcttagtactgacagcttgcatggccaatctcagttccatcaagaggtactattcaaaggcctatcatccatttgtataatattgcattgaaaaaacggaactaagataagctaatcattattaaaagttaagctaatgcattctgccgttccaatttgttttcacaggttgctatactcagtagagtaaggcatccaaacttagtcacccttattggagcctgcactgaagcttcagcgcttgtttatgagctcttaccaaatggaagcctggaggaccgactcaactgtgttgacaacaccccgccactcacttggcaagtgcgcatccagatcatcacggagatttgctctgcacttatcttccttcacaagcaccggcctcacccagtggtgcatggggacctcaagccaggcaacatccttcttgatgcgaatttgcagagcaaactcagtgattttgggatttcacgcctccttctggagtccagtgtcactggaagcgacgcacactacacctccaggcctatgggaacaccggcatacatggacccagagttcttcgccacaggggagctgacgccacagtctgatacttactcttttggtgttaccatcatgcgtctcttgaccggacgggcacctctacgcctgattaggacagtgcgggaggcgctgaacgactatgacctgcagtcagtgttggaccattctgcaggtgactggccattggtgcatgtggagcagctcgcacacattgcgctgcagtgcacagagctcagcaagcagaggcgccctgatcttgagcatgatgtgtgggaggtgattgaacctatgaagaaggaagctcattcgccattgtcccagtcttttcgatctatctgtagtgccattgaaactgccaccccgtcctacttcctttgcccaatctctcaggtactacaagttagaaaggtactccctctgtcccaaaatatagctacttttagcttacaaattcataagctaaaggtagctaaattctaggatggagggagtagaatttataagttgctgccgttgtttcgttagaaactgttaccgatgcttccagcattgcttctcgtctgaaactctaataacgatttactgcaattgcatatcttcaggtgaccatgagagatcctcagatggcagcggatggcttcacctatgaagctgatgctataagagattggctggataagggacatgacaggtctccagtgactaaccaaacacttgctaactgtgacactatccccaatatcgcactgcgttcggccattcaagaatatctcaagcagaacaacatgaacaagtcatttgcactatatgaacagcagcattagtggcctgtattgagtttcatctgtgcttcgactgtaatagatcgtttctgtgccagtaagaaactaaggaggtagtgttagaatagtgtttttcttttttcagttgagctgtaaacctaagttaaaacttaggaaccaattcttttcattttacctgagtttttgaaaattaagggttgggtcttctttgaactaattcatgtggaaatcctacaaaactgtgtgttaaattccagcattctaaatgagatcttaatggatatactgagttcatgttcatctttccttctggatttctgataatggaatgatgaaatcatgtatcatacccatttcattagttaaacagaaaaaaacgaactatttcaagatacagcagaaatgatttttctctatcaacttttatttgtttctgaattgagtattgctatagatatgacccatttgtacaactaaacacatgctaccaaaattgctatgcatacgactcagctgtccgactcatgtatgaatgaatttgatcgtacgtgagtcggacagttcacgtacagttaggtcgtatgtgtagcaattttcttttaatcgcgttcatggaggaacataaagggtttaacagactgacatgtgggtcccaccacatgtagtggtagggtcgatccaatctgctctacctggaattggaagggctaaatcgcaaaacctccctgccgcttcgtttcctttccccacacttcatcccccccacttccaccacgccgccgtcgtcgccgccgccgccgccgccggcggtcgcccgacctcgccggcgatatgcctgaaaaggtatcccactctgtccatctctcacttctccatctctctcctcacttcctctggcgctcaccctttttggttttctcctcttcaggcggcggaggccaacctccgcaagcagctggagcaaaccctcgccggcgagccatccagcccgctccaccactacaacctcgtaaccttcgtcatcccgttgcacgaatcctcgccgtggctgcggctctcgctcctccattgcgggcttatcacgcggtagtcgtgtgcgtgcagggcgtcttcctatgggaccgcgcggaggcggcggcgagggaggagggcgaggaggaggaggaggtgaggcggctccgtgcggcggcggccgagcgcttcctcgcggcggccaagctggaccccaacgacggcgtccccttccgcttcctcggccaccattatgcgcttgccggcgacgcgcagcgagcggccaagtgctatcagcgggcggcgacgctcaaccctgatgatgccgaggctggggtgggttggaatgcatatgagcgtgtgcctcgaaggtgtttgttcttttgcctgtgagggtgttttggtatgatatgctgtttgtgtggtttggtgcaggaggcggtctgtgatttgctagatttggagggcaaggaaagcttggagatcgctttgtgcaaggaggcagctggcaagtcaccccgggcattttgggcgttccggaggttggggtacttacaggtatctatctatccttggttggagttgcttgacagcttgagtatattgttgattgaagtaatcatgtccgtaatacttgtgatcaactctggctccacctaaaggggcaaatttgcaaaatattatggcttcattcgatggaatagatccatatggactggttttcaatcacaccatctcagacacacccaaacaaagcctacaggtattagttactgtgatcccaagtcccaacactgttgagataattaaattctgacccaatctagggctagtccaagcttaagtccccatatgcatgcctttcgatttaccaaaatgtaataccattcatatgccattaatatatccagtgccagtttctttcacgccatgaccaccagggtattcaccttccttcacgtcctttagcctcatactagcagatagtattggcgtattggcatgttcctgtcattttggattagttgatagagaatatgtggaaatctataggacaacatggctagtttaggcttgacatttcgcatctctgcaatacctagttttggagccttatctctaatcaaagctgtgactatatcagcctgtcaggcctgctttgatagggagaataggatccaaatccttaggatttgtatcatcccaaaggaaaaagaacaccccgttcttcttcaaaacaaaccctaaattaacaatgtccattgcccagctataatctccaacttttgcttgcttaggaaaatgtaggttttttcctggagcaaggaacaagtagactatgtgctttgcttaaagctaaagttatgcggttaacatctctagatttttcttcatagttttcttgtttatgcatgctaaattatgcactgatgtattttcaataagtattgacaattatggggcatttaggttcatcagaagaaatggtcagaggctatacagagccttcagtatgcaatacgaggttacccaacatgtgcagatttatgggaagtgggtattttttccccttgtttcctttattttgttaatgctggtgaaatctaagtcaggcatgctatttgtatgtaattaatattccatattatggtattaggcactcggtctggcataccaccgtttgggcatgtttactgcagcagtaaaggtgtgttacttttttttagcatcattagtgaatgctgcagtatactatattgaggcttctgaatatgcttaattcagtttatgctggcagtcgtatgggcgagctgttgaactggatggttccaaggtctttgcgttgatagaaagtggaaacatccagctaatgcttggttattttagaaaggtaggaatttttttcacttaatggaactattatattactagatatacacaattttatcagcactatgtataatttaccattgcaaattctatgccagccctttactgctgctaccgctaataatttccatgatcttatacgtgttgggaaatacgcaatgccagggtgttgaacagttccgctctgccttggagatggctcctcaaaatcattccgcgtactttggtcttgcttctgcattgcttgcttgggcaaggcagtgtgtaatgactggggcctttggctgggcagctagtctgttgaaggtatttggacactagtcttggtttcaattgaaacatatcctgctatattgtctcagtgtagtttgttctaggaagcatgcaaagctgccaaagtttgtacttctttgactggaaacctttcctgtgtttggaaactgcatggagatgctcaggtattctctattttactgttaattaatcatttaaatttcagtatcctataattttaagctttcttgctttatgtcagctcgcacttgcaagatgctttccatggggtgatggtaatatcaaggggggtatggatgatggtactttcaggactactgtacttgagtggagaaatacatgtttgttggctgcaaatggtgcaaaattctcataccaacgagctttgcatctcactccctgggaagctaatattcacaatgacactgctatatgtcttgatctcatttataccattgaggagaataatagtctagatcccataacttggtaagtcttttattccacattaatagcttagtagcatgtggcatctgttcttaacaagcgtacatgataaaattttatttctgtgtacaacagggaactgccagagaaaatgtcgttgggtgggttgatactggaaccagtcaataaggatttttgggttacattgggctcggtgtcaagtaatcaagctttaaaacagcattcttttatcagagcactgcatcttgatatgtctctctctgaagcttgggcataccttggaaaggtagtactccccccggacacaaaaacatgtcgttttagtcattgacatgaatacatctttggctgctaattttggttgcgaaacatttgacaaaccccccaaaatatataatattgtgaaattacttttcgaggtaaatctacacacatgattttcacacatggaatacaaatattaaaaataatgtttaaagtttttttaagtttaacttaaaaaaaaatccaaaatgacatgtttccataaccggtgttagtactatttatgcggcagctgactgttcttctattaattgagaggtaagtgatagttcgaccttcagatttacaggcattcaggtgataagcagttggcaagacaagcatttgatcgagctcgaagcattgatccttcactggccttgccatgggcaggaatgtcagctgaaaattaccaccagcctgggtatttctcccatagaatttcatagaagatttcatatattgttacagataatttcttattaagctgattatacgctttggcatgatcttcaagggatgggccagtaaatgaatgttttgaaagctgcttgcgggctgtgcagatacttcctgtaagatagttcatttgtatcatacttgttgtcagtataacattaatgatttggttagtttttctccttcaagtttgttttgatttcattatagcgatgtttttgtattagcttccagagttccagattggtcttggaacaattgctgctcgttctggtgaacttctatcacctcaggtatgctttcaaactcccccctcccctgcaaaaaagaacaaaaacattttaaaaaaagaaggtacttcatggttgaaataagtcctttctttcccgcagcggtgtgctttagtggcaattatcacatgctctattatcattaatgttctaattgctgatgctaaatgctactgttatggtcccagaccacaatagctacatattgcttcattatggtgtcatgtatgcgaagtgttactagctgtccgtgcattgtctgctactttagattgctcagtttttttggatattttagagtaccagactacatggttgacacttgtttcctgttcttttccctgtaacacataatccccttatacttagtcctattatttaggtattgatggctgtaaggcaagctgttcaacgggcacctcattaccctgagtcgcacaacataaatggcttggtttctgaagtgcgatcagacttccaatctgcaattgcatcgtaccgacaagcaaaatttgctttagatatgatgcgcaactccaaaacagactgcagatgtcatattgctgatatttccgtgaatcttgcccggtcactatgtaaggtaagagtattatcatccgctttgatgacaacaaaaaaaaatccatatcaggcagctgaaagatcatgttacttcaaatgttttatgcgcaataagtttgcattttctgtcacattatttacaaatgtttatggaacagttatcctttaaccgttgctttgactgtagactggtcttgcaactgaggcagtgcgggagtgcgaagaattgaaaagacaaggttttttttttatttcatgtagcaatggaaggatctttttttcctattttctcctgaattgccatgcatggcaaataaattcctttaagttattttcttatgctatccaacacacaggctaacaagttatctcaaatttctaggatttctgaatgatgacggattgcagatatatgctctttcattatggaaacttggtcggcatgatgaagctctttcagtatcaagaaacttggctgaaaacttatcgagtatgaagcaggagagtgcaactgcagctttaggattcatatgcacgttgacatacaacatctctgggaaggactctgcagctgcggtcattcataaactgcctggtcaactcaattacagcacacagctgaaatttattatctctgcattagatgctttacagccaaacaagcgttttcagttaccccagctgagtatgcctcctaggcttacatcgtatgaagtcatgagtgaagtccactcaaatattgctcttggaaatgctgtaagtatggttttctaaaattcttggcattctatgtgaaaaaatgcttcttttgggaatgtgctagagcataaatgtgctgatatagattaaaaataatccttgtagattggtggggaatcagacaagtttttaagggttgatggtggcctgtcttacctgaaaaaggttctacacatgtatcccgactgcagtttagtaaggtaatgatcttgcatgcactggtaatatctaggttctagacttgtggcttcaatcgaaatgttgtgcactatatttccttcgttgcatgctgtagaaaccaacttggatctctgctactgtcaagtgaagattggatggcttctcataaagcagtaagggttacttcattgtcccggggatatacatccaataggggcttaagatctccacaccaaattcaagcatgtgcagcagtttcttgctatgctacctgcacttcttacccaaagttctcttttccaacatgtgaagatcaatacctaagcggatacaatgcaatatgccgcctgcaaaggtacatcttctcttactatatttaccatgtatctaatattcttgtgtgtgacttgaccttaagcttgcggtttgactgtaacaatcttgcacatattttccaaagaacaatctatccaactaaacaagctcttatgcttattcccacaggagatgtaacaaccattcatgctttgtatttctaaaccttccattaataaataaaatggcatgagtcttaaaaaagaactaagtgtgtgactttctttgcaggtgggttcatctagaaccgtggaaccaagatgcacgtcgcctccttgtacttacccttttccaaaaagcacgtgaagaaaagtatccgaaacatatctgcaccattttgaagaggctgattttgcaagttctctccagtggtagcaattcacaagacaataaggtggttcagtatgggaactacttgttacttcttgtggcttcagaggttagtttgcaatctggtgaccatggcaactgtattgctcaagctactgaagctcttggagtaacttcttcgagcgtggattctttctttgcacacttgcaactgtgtcgggcctatgtgatgcaaggcaatcttttgaactctaggagtgagtacatgaaatgcctgcaaaaccgtacagatactgaaattggctgggtaatacttaagcaacttgcatctatatgttcactggagggtacccctgatgaaatagagatacatctcggaggatgcgttgaaaggaaaggtagcaatgcatccaaatggatgtctcttttttatctagcatgcgctcagtgttcagtatggaatgaggactttgcaagtgctgaaaaagctattgctcaggcatgtgctgaaggggatcctgacagctgtgtcttatttctcaacggtaattggcatgctacttatttactataatgactaactaaattgggatgttttattgttatttttcttagtagtttactctacactagcccggaataaattctaactaacaatcttgatgtttatttttgacaatgtgctgactgaaacattacccttgtaggcgcaatttgtatggacattgcttggaggttcgcggcccctcaatttatagcccgtgcagcttccagcctcagaaaggcacagcagaaatcacttgcttctttacctattgtgtccctcttactggcccaagcagaaggcagccttggctccaaagccaagtgggagaaaaaccttcgtctagagtggttctcatggcccccaggtctgagcatggcttcatacaaagcacactgttcttgaaatttcaccatttaatttacctttttccgattcgtcgtgcagaattgaggcctgctgagctctatttccagatgcatcttctggcaacgcagtcaagtgcagcaacttcccagcagaaccagctagtggaaaccatgcaaaccccagagaagtggcttctcagggcgatacacctgaacccgtcgtgctctaggtactggacggctctgatgcaactcgtgtacgtgtaacccttcgaaattggaagcactgatctttggtgaaaccaaccacaatgtagcgcatttcttgactcagctgtaagcatatggattggctggatgaactgccgacctgtctgtgataagtgaaaaacctgcatatgcttgcttaccgtgttgagggctgagacgtgagatgtttccggaattaccttttccctgatagactgcaggcatattgtcttcttgtaaactcttctcacaaaccaaccccccccccccccttctcagtttgtgttgtaaaccaattggtgacctttcaattagcagcaagcaagtcgtaactaacaaaaaaaaaagctaaggaatgtgaggcctaagcctgtctatcggtgaacccaaaagcacccaactcagcagcctaatggagattctcaaacaagtgtctagaaccttgttctcctacccatcctcaacacgtaccgttttaaccaccttttccctgtcagatttttttccattgattttgtgcccatcgtttgacaacaaacacagccaaggacgccaccacgtcacggcggcgtcgcgccgggagccgagctcctgccacctcctccacgctcgtaaaataaacccaaagcgcgacacgcggcgccgctcagagcgcgacgcgcccagagcgcgccacgccgcgcggcacctgtcgccttaaacctcgcacttgttgtccttacgcttcatcacccgcgctcactttactcccgctccgaccaagccaaccaacgcgacgtcgcagccagagcgcgaaggaatccgcaccgggcgcgcggcgcgccaccgctttgatcactctcgtcgcgcgcggggcgggccatgtcaggcggcgtagggccgacgtgcgggggcggcatcacgctgccgtcgacgggcgcgccggtccccccgctgcacccgacgccgacgtcgccgacggcgcggcctcaccaccactactacctcttctccatcaagcagctcaactcgttcggcgccgcggccgtgctcgccttctccaccaccgtgccactctccgacatcgccttcgccctcctcgtcatcccttacctcgtcgtcctctccgtcctcgccttcccgcagaggcccggcaagcccaacccgggcgcgccggtcttcctcggccgcgggcgcttcctcctcagggcccacgacgcgctcggcttcctcgtcggcgccgcgctcccggcgctctacatcctcgacggcctccgctcgggcgacacggcgggcgtcgccgcggcgtccccgcacgcgttcctcctcgccgcgcagatctttaccgagggcctcgccgcggcgtggcccgggaggttctccctccccgtgcgtgccgccgtggtggtgatgtacggcgcgcggaggatgttcgcggcgtcggagtggctccgccaggagatggagaagcgggaccagttcggcggcggcgtcggcggcgcgcccgccgtggcgcgccgcagggtggtggcggggagggtgctggcggtggcgaacctcgcctactgggggatcaacctcttcgccttcctgctgccgttctacctgcccaaggcgttcaacaggtactactgcggcagcgacagcaaggaggacgacgccaccgccgccgccggcgccattgacgccgacgacgccaagaagaaggattcctagagtgtgtttgatcgttcgtcgctgctttctcactcgcgtttgtgcagcttggtgtattagctcttcttcttaattttttttttcttttgaaaaattcacgcatgtattagctcttttttttctcgaaaatttcacgcatgtattagctcaacttgcgtttcgtttggtgaagacaaacttttgagtttgagggtgttcggtgtaaagagatttttctttaaaaacagtaaattttatagaaccatatatcctttaaccaagctatcacaaaacttaaacaaaatatttaagcgtttattagaaaactacagatttgacagtatcacaaaactactgatcattatctttagaaaaatcacaaaacgactgattctactgatttttgaggagaattgtgcagagttcaattctctgttttaccgttatgttggagatgtagttttgtgattaaaattgtcactaaacttaccattttgtgataaatttgctacttagttttatgataaattcgatgctaaatttgaagatctggtcttaataaatactagtatatagttctgcaatagtttgttcagttttactgagctaaattgtgcatcaaatccttgggcctaatttgaatgggccttagttctgggccaatccacttgtatatgcccggaaaactgaactagaaggccgacccattcacgtagatgggccggaatgaaggcccatacaaacgaggcatgctctgtttgctcttagatacggcccatatatgcagaatcgtttctccgcgagtccgacacggcgacacaatgagtgacgccatgacggcgacaacaggattagcgagctccacaagcgaagagagtcaagaaactactatccctttgcgtggatcttttgcaggagatgttggaagaagaagaggaagtggttgcgccgacgacgaggtgagcgggttgacggaggaggaggcagcgcgcgccggcttcgggtgtcgttgtccctgctcgccaggtgctcggtacaatgccccactgtgcgctttgtttcttcagaatattagtagaactctttgaaagaagttagaagttagtaccttgttctcttcggaatgtttgttttcctatgttcttagggtgcatggcatcatttgtgatgctgttagaaatggtcaaaccacttaaatcaccaattggcattggcacacttggaattaacttggaagtgatttgttcatgcatattgatatcagcgtctccatcgcctgcagttgctcctccagactgcagctagcgtgacgagaaacatcttcttgagacgatatcagaaggttttctctacaagcttcccttcgatcgtgtagccagcatctgtaggctatagctcgttagctgtaaaacttgtgctagctcgtttattggttctttcatttgtttcctgttagtcagtttctcctcccccagttttttagcttgttctcttctgttttccagtcgagtgcatgactgcgatttgctcggtcgtgcacatgtcgagcttgacgtgcgcttagtccgcacggagcgcgtcgcgcggcttgatcccacgtttttactttctgtactgaataaaaggaagaaaaaacagagaaaatgctggaacgtttctacgcagcgccaaaacacacctgagttcatcgtgttcttgtgttcattctctctcgcgttctctgctcgagtgactgtggttgcaggttgtcgctgacatactgctgagcagaaaaccagcacccatcggcttagtacctgtctgctctgctgtctcagcctctcaggtcagctgtctttatcttactaaataaattattctgcgaatttttgaagaaaaatcaaacttttagtactttggaagagtagcaaactagattgctttggccacatcacatgctatcactgtcagagccataccttagcaacagcatttagcctgtatatgtatatatcatcggagtaatctatgccgaactttactcaggttgcaaaccccatatcccagagctcgacgccacccatgtggtttttcaacttcaaccgaaatggcccctctggcttctccggcgcctccaccgccgaggaggtcaccgccggcgtcgacgcccggggcttggccgccgtcgtcacaggtacaatcattcaaccaatgttgctgccatgccatttaattaagctcgcaaccttggtcagagagattcagagtgaacttgacgacctggctgcaggcgcgtcgagcggcatcgggctggagacgacgcgcgtgttggcgctgcgcggcgtgcgcgtcgtcatggccgtgcgcaacgtcgccgccgggcacaaggcccgcgaggcgatccgggcggagatccacggcgccatagtccatgtgctggagatggacctcagctccatggattcggtgaggaggtttgcctccgagtttgactctctgaacctacctctcaacatactcatgtaagaacagaaacacgggtcaactcgaacagcgaatttaacctgtgctatactgattcaaacttacttttacgacagcaataacgctggaatcctgtccaaggactgcatacgctccattgacggcctagaattgcattttgcaactaatcacattggtatgcgaaattcatatggcattcctcgtgcatctcgatattgcttaattgtcgattgattgcttttatgacttgaatgacaggccattttcttctaacgaatcttttactggagaacatgaagagcacaagtaggacaactggtgtcgaaggaaggatcataaatgtgtcgtcttcggggcacattttgacctatcctgaagggatatgtttcgatagtgtaaaagatctttcgaggtaattaataaattccgagactctaaaaattaggactaactagctaggccatttttgcatttcaaggagcatagatatgatgtcgattctaacaatataactctgttttacattattcttaacaatataactctgttttacattacagacacaaggaggtaatttcctgtcatccattagagaattggatgaccaaaatcattcttcttttacatttaagaatcaatacattcaggagggccatctcggccatccttgagttaaaagaaaatatttcttccagcggtttatgttaatctgttccttttatttattggttaatgtaagaactttagcttttgtcattctaatgttaacatgaggaattaaggggcctccaattagtaaagataaatatatttattgtgcacttgatttatcttaccagattctccacttatattgcttacggccagtccaagcttgccaacattttgcactctaccgagcttgcacgaattctgaaggtagtgttcttatttgctaagcatgcctatgagtaaattttgtatgttgtctctgtttgcatatgattatagccaaatctatgaatcataagttggaaaccgttaagtatgaatagggagatggtgtgaacatttcagcaaatgcgatccatcccggttttgttggaaccaacctattcaagaactggactatggctaatggtaatccctagacctttcaatgcaaaattgttgaagatatttttggaataaattagtagtacttgaagaagcatactcttcaaaatattaatttgggatgattcccaaacattttgatccttgctgtctggcgtggaaaggttgcatctcctaaacacatgatgctatttgtgaatgcatctccttttataccattataccattttcaattgttcttctccattacagctgtggtgaacaccattggaagaatcgtatgtaaaactgtagaacaggtgaactttttttaaaaaaaatgaaaaatctcgtcttttatatatgttgttatgttgtagtgtggaacatctaggcgactctaacctcgtgatattattttttagggtgctgcaacgacatgttatgtggcattacatcctcaagttactggaataagtgggaagtacttcagcaactgcaatttagagaccccaagctcacaggcttcaaatgcagagttggccaagaaactatgggaatttagctccaacattgtgtcggctgccaaactgtagtttgagttattcatatatgcatgcgctacattttatttcgtgtaagccgaacataaaattttcatagaaagtctacaaataaagagagtgtagttcctcccaagaatcttctctgttatactccattaaaaaaagaagtctgttttgactttgagttgcctaacttcgcataaaaattgtattttaccaataatatcttatacatcatttactctgggtcaaaaccgatgagtatccgtgatggagggagtatattgcctagttagtgtggagattcatcccacctcaccacgcactccatctgttctaaaatataacgtattctgataatctgattggacagaacatactttaggctgcgtttggcaagactagttgagaacccactttatttttcccgcgtgaccgcttttcaaactgttaagcggtgcgtatttttgaaaattcaaactgttaagcagtgtgcttttttaaaaaaatttctatacgaaagttgtttaaaaaaacagttttaaaaaatcacattgatccatttttcaaaaaaaaactaatacttaattaatcatgcgctaatgaatcgctccttttttatgtgggagagattagttcccatcccttaccaccgaacgcactcttagtgttcaaattcgtaatactagaatatagcaccgtccaaattcatagtactatgtctcatcttatcaaaataccttatattttaggttggatggaggaagtccggtcacttcatgggccgacatcgaggctgttataccgaggtcaaacaagattttgacccaaccagatgagcagccccatagtttgaaataagtcaaatatcatatttgtaaataaaaataatttataaataaaacttttacgtacgtgttctaaatgatctaaatctaaagactagaaaataaactatgataaaaaaaccctctaaaattaactcttaatttaaggtgaaaaatttaaattttgattgataaggataagtgaaaagacgagggcgagacgtttgaagaaggcgaggcacacgtctcggcgttttcctccgttcggcagcacaaccagaaccgtctccggtctctccttcccggcgatgcccatggcgacgacgaagggtgctcgcgacggaagagagggttcgtaggatcagcgaactcctcaggcgaaaagagagaagaaaatagtactatcactcagcctcgacgcgtcgaggaccaccatctgttaacctgttggtggggtgggtggctctttgcaggagacgttggaacttggaagtccacggcaccgtcgacggcgaggcgatcgggcggacggaggaggaggcgcgccgctgcgccgggctccggcttcagagcgtatgacccgccggatccgttgtgttgtctgtccgtgcccgccaggtgttcgatacaatgccccagtgcgctttgcttcccttctggtaagaaaaaaagtttgcgacctaagacaaatgggtacgtcatttataatgctgtttcaaaggtttaggca

SEQ ID NO: 17441 - DNA, 7805 bp, Oryza sativa
tatgactttgaagaaaaaaatgatattttgatatactttgtccaccggttgacattggcacacctggaattggaagtggtttgtgatttgacaatcaatatcagcatctccattgccatcggctacagttgtaacttggaagcggtttctagtttgtcaatgcatatcagcatctccatcgccatcggctgcagtttttctccatactgtcgtctgtagcatgctgaagagcattattcttttgcacccagccacccacagagctgtagctgaacagaaaaccagcaccccacctcggctttacttctctgctctgctcatcggctgtgtgaggtgttcttatcttattgaagtcttctgggaatttatggtataaaaacaatatctttagtactttggtagagtaacaagctgaaactgctgtggccacatcacattctctcactgtcagagtctaaccatataatttcaggccatctggtgccgaagctgaactcagcttgcaaacaccagtacgccactattccctgagctcgacgtacgccagcttggtacggagtcggcgatgtgctggttcaaccgcaaaggcccctccggcttctccggcgcctccaccgccgaggaggtcaccgccggcgtcgacgctcggggcttggtcgccgtcatcacaggtacggatatgatttttttttgaacgactcgcgcaaagatggtgcgaagttctattatcacaggcaggggcggagctagaacaaaatgaaaggggttccactcgcttgctttactctggtttgaatcaaatttagcttgatatgagtgaaactgacggggtatatatatggtgaaaataaataagctatagttaaattttttttaaccagttcctgggcacccccttagctatactagctccgcccctgatcacaggtacgaatatgatgctgctgctggtctgctgccatgccatttagctcacggtttcgacgttggccagaaaaattcagagtgggctgatgagctgcaggtgcgtcgagcggcatcgggctggagacggcgcgcgtcatggcgctgcgcggcgtgcgcgtcgtcatggccgtgcgcaacgtcgccgccgggcacagggccagcgaggcgatccgggctgagatccccggcgccggtatccatgtgctggagatggacctcagctccatggattcggtgaggagatttgccaccgagtttgagctctgaacctacctctcaacatactcatgtaagagcaagaatctgaacgcttcttctatatgtactccctcctccgtttgttttagcagatgatgccgtttacatttgacatgacgcttgactatttatctatttaaaataccatttattttgttataacttgttttaccatcaaaataatttttttagggaaaacaacactagattgtgtcttttcattgagtatagcagaagaaaaaacaatccttagaagcaagaaaagtgaaaaactttgtacactttaaaataacttttaaggattgactcatattttttatatttgtactaaaattttttcaataagatgaacaaagtcaaatgtcatgtcaaaatttaacaccatcatctattaaaagccggatggagtattattattttgtcaacttaaataataaatttttaactgtggttataaacagtaataatgctggaatcatgacaaggaactgcacacgctccattgacggcctggaattgcaatttgcaacaaatcacatcggtacgagaaattacacagcatttcttcatgcatctcaatcttattaacggattagctgcttgagtgatttggttaattcttgagactttctgggttgtgagaggatgctcatagtgcactaactgttgacttgaatgacaggccactttcttctaacaaatctcttgctggagaacatgaagaggacaagtagcaaaactggtgttgaaggaaggatcgtaaatgtgtcgtcttcagcacattttgtgacctatcctaaagggatatgtttcgataaggtgaaggagccttcaaggtaattaattctgagattctaaaaattaggactggacaccccattttcgtatatgacacatactagatatcatatggataataacaaaaacaacccaattttacattagtgggtagtgcacaaggagatgatttcctgctgtctgtgggagaactggatgatctattctttttctttgaattaatgttaaatttttgactgtttaatataagaatttttggctttttatcatccaaaaattagcgtaaggtccccttatcaagggagctccaattagtaaagataagtatatttattacgcagtatgcactcaacttattagataatattaagcacttaacttttcttaccagattcatcagtcttattgcttatggccagtctaagcttgccaacattttgcactcaactgagctgtcacgagttctgaaggtagtagcttatgcctaaatttcgtatgtaatctctgatcatatatattatatgtcaaatcaatggagaataaccgggaaaccgttgagtatgaacaggaagatggtgtgaacatttcggctaatgcagtccatcctggtgttgttacaaccaacctgttcaggcacaggactattataaatggtaattcccaaaccattcagaacaaaattttggagtgtaattagaattttggaacaattagtacttgaagaagcacatactccataatgccaatttaggatgatccccaaccattttgattactggtaaacacaacgaacaatgctgcttataaatataatatttcttaactgttcttgtgcattggttctctcttgcagctctagtgaagtccattggaagattcgtacacaaaactgtagaacaggtgactttttttaaaaaaagtatatgttcgtgcgttgtaggtgtggaacatattatgtgtttctaacctcatggttttattgtatagggtgctgcaacgacatgttatgtggcactacattctcaattcaccgggataagtgggaagtacttcagcaactgcaatttagataccccaagctcacaggcttcaaatgcagagttggcaaataaactatgggaatttagctccaagattgtgtcctcttgatgtggctatcaaattatagtttgtgttatgcatcatgtgctacagtctattttctgcaagtttgaacataaaattttcacataaacaaacaaagagatccgtgcaattcctccaagactagttagaacaatctgaattgtaatatatccgcctcagtttagtttagaagttcttcctataatcatgggctggctctggctatgtatttcttaaactaatgtttggactttggaggcccacctcacctctttatgtaagccttacgcttcatggaccaacactccagtgcttctactttcctaaaatttacataaacactgagtagatgtaacgtgcttgtgctgaggtattggactagagatattcttttgaggtgccattgctagtatagtgctaggtgtgtcatgtgtgtggattcaatcctaggatctcatgtttgactcacattcacatgtcttattgattaattgacagataattttatcattcttaaccattcacaaggtacaggagatatcatattttctagtgtaaaatttaatatctctagatactaggtattttaatgtgtaaaatcttaatactctatgtactttctgaagtaccataaaatttcttttaatcgacaccaagcttctcctcttgtgtccaacttgtttttaaaatattattttacttaaaatgggcggtgaatagtgattgcttgccccttcccttgcttcagaatttgtgaagctcaggttggagcaacctaaccttaattgtgtgcatcaccattccctaagtcaaactagtttgcctgcaaattcattcagacaattattttaccaatcttggtgctaattacccttgacataagaactttccatccatagaagttaaattaatctattgctatgacgcacgtgctttgttacggatatatggaagaatctatatctacatccatctatctatacctaattaaaaaatacgtaagacttccggaattattttgtccatcgtcatcgtcatctgcacactaattgattttttttaagcaaaagtgtttgcttgtttagggtagggctcgattccgagctcgatacgaagcggatttgcttcgattcttaggaaaatggaaaaagaatgagataaggatcggaattccctcaatcggatttcatggaggagacggcttccggcggtgtcaagtagctgagagactctgaacgaaggtaagggataacactttagcaatgggcccacgcgacaatgagaggaggaaaaggggataccgattagactttcagttgtttgttgggccggatgcatgcttgtgagccaaggcggagggaaggagaagggaggaaagcaggctagcttggctgcgggctgagaaagaaaatgggctgaaaataacccagagataaagaatggttttttatttatatttttatttaaataaatgttgaaatgatatttgtattaataaaattagcacttgagctctaaaaattctaataaaatttcagatagtgtaattaatcacgaataatttaatcaaaattaaatccagccatgtcattttatttctcacacttactttacttgtaaattaattttattctacacctacctaattaaaaaatacctaagtattccagaaaatttgtattttagttaattacataatctaaatctttctcaacttttgctcaattttctcgtcttttcttcccgttgcaacacattggcacattttctactatatattaaatattatataaatgataggtggaattgagctaaaatgctatgaaaataatgtgagtaatgatgattcagaatgcttatatgttaagttttagatttaatatgctatatttccatattaaactttaagcacttagtgggttggtgtggtatgcttgtaaattaggctttaggatgtacatataattactatgcttttatatgttgagttttaggcgcttagcagattgtaagaaggtaaaatttggtaatttgactttttcaaaaacttattataaaaatgaaccatgccaaaaagaaatcaggaccttaacatcatcgggttcgacgcggagatccaacatcttagcgccactaattttgacgctaacatctcatccgagaggtgacacatatttgctatatttatcataggttagcgccatccctactagcgctagcctctatcatgttaaattgttgtgcaactttcagcctagatgatgttcaacctttatctaactcattttttgaataagttttttagcgcagttgactcttataatgagtttttaagaagggccggattgtcaattttcggtacatattggcgtctccatcgcctgcagttgctcatccatactgcaaacatcattattaatttctgagataacgtcgactgctattcttcttggtgacccatacctgcagcttagctgtagctaaacagaagcacccttacggaaaaaaaaacgaattccaaataccttgggcaaatccagagagaaaaaaaatccggctttaaaaagcattctgcaagcgaatttttggaagcaaaatggaatcattcctccctccatctaaaaaagataacctaatacatacactacgataaatctagatataaaatatgtccaaatttattatattagaatatatcacatcttaagatgatgctattttttttaatggagggaggtacggtatcgaactagagcttattcggaatggagaagaaacacaggaaaaataaaagattttggttcctatggattactttactgtgacgtcattcggatcacaggaaaacgttcgtagaaaatacatagggaaaattcctgcgctagccatatcagtggaagatcacaggaaaaaaaaatccacgctgacctcttttttctctccctccgcgtgggaacgaggcaaatcatgccatcaagcaactaaagcatactattaggttgattaatgttgtttaatttactagtagcatgtgataattttgtaatagtgcaccttttcttaaagattcctatgtttttactttactccatccaaacacatattcacatgaaattcctatgttttcaaatcctctgttttatacttacatttttatcatattctaatgtttttcctattcctatattttttcaatctgcattccgaaggagcctactgttggccggtcgttgtactacatcatatgctatgaatgtgactgtcagaggctcagaggcatgcattaacattagtagtatttttagccccaacttggattgcaaacgcctgattccaagagctcgccggaaccgcggatgtggtggtagctgaacagaaaaccagcacccccctcggctttacttctctgctctgttcatcggctgtgtgtggtgttcttatcttattgaagtcttctgggaatttttggcataaaaacaatatctttagtactttggtagagtaacaagctgaaactgctgtggccacatcacatggtatcactgtcagagtctgaccatataatttcaggccatctggtgccgaagctgaactcagcttgcaaacaccagtacgccatacggagtcggcgatgtggcggttcaaccgcaaagggccctccggcttctccggcgcctccaccgccgaggaggtcaccgccgggatcgatgcccggggattggtcgccgtcatcacaggtacgatcgatcatatgatgctgccgtttagcctcagtgcgtgtttcaaacagctaattgatatatcgattagtgccatgcttttaagctaatacggtttaagtaacttttttctagcctttttttttttctgaactacagtgtttgttagctgtatgatttttagtttagccatacagcatttcttagggactcaacttcaaaaaccgaatataactcaccctcaacttctaaaaccgctcaatttacatcgctaattccagaatgagaatgaggtggttttcatctgactgacgatatggtggcaatctagtcatcaaagtaaaaataaaaataaaaaaatgtcatgttcattgtgagtagcctctccctttcttttcggtctctccactgcatacttcttgagagaataagtcaaatggtatatttatataaaaaattaatttgtgaataaaacgtttatgtacgttttcttagtgacctaaaatcaaatgttgaaaaataaattttcatgaaaaatattttaaaatcaactttaaatttaaagtttaaagtttggttgataagtataagtgaaaagatgaggttgcacctctcttgagccgccgactaccgcgcctctctactcgtcggaggttggccaccgccgcgcctcttcttgacctctctacgcacatgaattttcccctaaattctcccaccgcccgcttcgcaggagagggcgcatgccgcgaagacgccagaacagacaagaaaacgaacaggagaagggcgaaaaaaaattgaaatcagatcacacgaagatcacaagaacaggtaagaacacggacaggttcatctcaaccgatatttcgtcgcaagtgggaatcagagaggaaaagtaaaaaaagaaacacacacacggccacgcggccactcggg

SEQ ID NO: 17442 - DNA, 5879 bp, Oryza sativa
  unsure (1)..(5879): unsure at all n locations
gatggggagggatcccgcgtggccgtgtgtgtgtttctaggtaccaataggtaccaaatttacaataaaaaaatggtacctcgtggtacctcctcaaggaccgtaaaattgctcttaatagtatagtcaactactagctccaaatcatctatagccaatataatagctaattcatataatagctgcttattatactactaatatctggtcccacctatcatacacacattatgtcttagagtcagtgctgcagctagctacagatttatagcctgatgctcttctctttctttctttatctctttaaaatatgtttacatctgacttataacttgctattgtacctgctctgggagaggggccggctgaggacaagccggcaaaggatatctcccaatatgtgaccacgtggtcaaaaccactctcatctcatcgccacataagttaaaaccacctcgatcttatacataaggtagctagagatcgtcccacaatttcttattctttatttcattattgagtgactcattggttgtttgttttatggaaaataatagcaaaatactcatagtctgttatgataaaatgtacatactcatgtgtgtgtgtatatatatatatattgttcacttgatttaaataaatattagattattacatagtattagaatatatcaagaactaacttgtaaggtggtggattggtggtagatatcagttaaatgcctatatgttccaacgggaattaataaagactttaaaacctcaaacactaaaataaaattatccccattgtaaaccatctataatatttttcaccattttgtatctcactttaaaataaattttccttgtttgatggcttctggttaaggaagggataaaagcctacctatctcactattcgggggaccaacatggtaatgatggtgggtagtgacatattcagatataaatatagatatagatatatataatgcatttctattactaaaagtttcaagcatatttttctgtcataataatatatctaatcgtcgagttagagtgtttccttgctcatctatatctatacctattataaaaattcaatgtgtttttgcatgaaaatttgatacatcatctatgttagaatcggttttaattaaatatgtttccgtatcagaatgtttgttttatctgtattttggtttttttccccttggcataaaaggggtgaaaaaaacgtccgtaaaaaaagaaaaaaaaagagcgaaaaaggtcccaaaagaaaagtccgattccctgcgaaaaaagtcgttcgtaaaaaaaataaaagaaagcaaaaataagatctgattctatgcaacgaaaaaaagaaaaaaaagaaaaatacgtaaaaaaaagcgaaaaaaaggccgtgaaaaaaattatatccaaaaggataaaaaaggctaaaaaaacaagaaaaataataagaaaggcaaaaaaatatgcctttcaaaaaagaacaaaacatttccatcataatctttacctattatataaattaaagataatttcatactcatcgtattttcggccgttgtcctttcattttaacgaaccgtcctattccgatttatatatgtttttagcgttgtgataatattcacgttttgctttttatctccacatccaatatgtttctgcacatatgggcctaaaattgtaaaagggtccaaaatattgcccatctgttgacgcgaggctgtctcggtgaaaaatattgcccatcttctaagcatatgtcacatactatttatttcagatttgtttgtgtttattttaataattttgcacacatgcaaatgcaaagcatactaaattttgtatgggcggctttcatgcatgtccgtttattttgtaaaagattcatctacgcatgattcttttcaacattattttttcaacatatgatttcgtacggctatttaggattaagtgatttattattaaaactgaagttgtttccgccggtagttttggtacgttgtgtgtatttaagttggttttaaaattcgttcgcttttaaaaatgcaatggtttaaacttggatatcaatctcaaaataaaaatcacatatacttttttagaaaaaaaaatatatctaacaataatacgattaaaattagtcttcatccgttgtaacgcacgagcttttttttctagtaaaagaaaaagaaaaaggacggttgcaacgttgatcagagcgagagctaattaattaacgagaagcgcgcaggtgcgtcgagtggcatcgggctggagacggcgcgcgtcctggcgctgcgcggcgtgcacgtcgtcatggccgtgcgcaacgtcgccgccgggcgaaatgccagcgaggcgatccgggcggagatccccggcgccatagtccatgtgctggagatggacctcagctccatggattcggtgaggaggtttgcctccgagtttgattctctgaacctgccgctcaacatactcatgtaagaacagaaatactccctccgtacttataaagaaagtcatttaagaaaacgacacggtcttcaaaacacaactttgatttattatttctataaaaatatttattaaaaaatgatatatgtatacttttataaaagtatttttcaagacaaatatattcatataatttttacattttcaaacttaacaacttgagagttattcatgatttatattctcaaggtttgatttaaacattgtcctaaacgacttcctttacgagtacggaggggtatactccatattaaagtattaattgttactgcccctgggcataaattcttcggcgtttaagacctaattgtgtatcaataacttctcaaatgcctcattgtaaaaaaaaagaatgtgtgttgttttgcctcaaagtattatcatagataatgaattttgttgtaaaattgatggttagagttttaaaagtttgacttgattttttcgcatatgtgagaatatttatggccgtagaaagtattatgattgtgtcaactctaacggcaaacattttactctgtttccaaacttcctgtgacgacagtaacaacgctggaatcaaggcatggggctgcacacggtccgttgacggcctggaattgcattttgcaactaactacattggtatgcgaaattacaatgcattaattcttcatgcatctcaatcttgtttgcctactaagtttcctgtgtgatgtggttaattagttcttgagatttaagggttgattatgagttatatgctcatagtgcagtactttaatgtcaggccattttctactgacaaatctcttgatggagaacatgaagagcacaagtagtgaaagcggtgttgaaggaaggatcgtaaatgtgtcgtcttggtggcactttgctatttatcctgaagggatatgtttcgataaagtgaagaatccttcgaggtaatttataaatatatactacaaattaggtcttatttgtttcagcttaagattattaaatataatctagattattgagccagattactataagttagattatgataagctaagttgttagctatttgtttttttattaatagttgttagccaccaaataatctaaaaaaaacaactttagagtgtattaccatattacagtaatctgacttatagattataataatctatcataataaactatctgtttgtttcagcccacttctaacgattcaggttataataataataaactgaatcatacaaggccttaaatacctccctccatttcccaacgaaaaataataataatcttccatgcccttatttgttcttaacagtataagtggcgtcccaattctaacaaaaataaccccttctacattagtcaccacccaagtgtttcacgtactactgctgttgctattataaatacttcttttgaaaaaaaaatattggcaatttttcaaattataatcacttaaactaaaggaagacatactccgcacgttagttacaacttgcaaactattcattttatattttggaattaaaatagtataatataaaatcgagggtccattatatttataactacatatttaatttgaattttaaattattaattttataaaactaaaactaaagagataatggtatttctctatgcatgttttatttcacatgaactctgaaaacaatttatgattttggagatcttaattttaatatggatgctctctcatagtgctcaaataatataaaataatatagatatagagatgaaaaatattttgaattgtttcatatatcccgcagcaaagcgtagagcttcatctaggatactccattcgttttacactataaatcgttttaactttggtcaaaatcaaaatgctctaagtttgaccaagtttgtagaaaaaaatattgacattttaaccctaatacaaatatattatgaaaatatgttccattatagatttaatgaaacttattttcaatgactcttttttcccaacgtgtaagcatgtgtttggtttggggacaaagtgggatgtgttagacctatccttgttttgtgggatgggatgatttcagtagtttgtttggtttacggtatgtgatggttatagtttttatttggtagaagggattgaggtgggattggatgaacgaatttgtactgaccgttaatgccgtttgggggtggaggagctcggcggcgcgagcagaggagaggtggtggcgggtgcggacgagcaacggcagtcgaggaggcgaggcggctcctggatctgagaggagcggcggcggtcgcggaggtggcggcggtcgcagacgagcggtagcggtcgcggtcgcggaggtggcgaaggacgtgaacgaggcggcagcgctcacggacgagcgacggtgcttgcgaaggtggcgaaaagcgcgaactaggcggtggcgctcgaggacgaggtggcggttgtggacgagcggccgtggtcgcggacgaggcgggggagggtgcggacgaggcggcggcgctcgcggagatggcggatggcacagtgacgccgttcgctcgtcccaggtgggacgagttcgtccgcgagatttttacggatcggttggtcccggatctgagagaaatatttctctccagagactaacccatcccactcacttctaaaccaaacattcctaaaaataggttcactccatctcatccaatccttcattgcaaccaaacactacctatcctaatggttcacttatggtcaactgcaatattttgaccatccaaattttctttgtttgatttggcgtccggcgtatgtgtagttgtgcctacatagaaaaggagatgctttcttgcaatcgtttagagaattggatgaccaaaatacttttgttttagcctttgagatctaatatatgggccatttcggctatcaggagttaaaaaaaaatcatggtctttcacttgttaatgatgaaatttgtaactgtatttttattttgagtgtaatgcaggaattttaactttttaccattgtagtattaacgtgaggactttaaggggcctccaattagtaaagataaatatatttattgtgctgatttatcttaccagattcagcggtatttttgcttaccctcagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17443 - DNA, 685 bp, Oryza sativa
agaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagacttactcgtggctgcaaccctactagctcaaaatttattcacacatggttacgctttggggaaattatgaggggatctctcagagctcagcagctg

SEQ ID NO: 17444 - DNA, 6817 bp, Oryza sativa
attcctgcagcccgacataaacagtgtaaaactccacttattttaggacggagggactactactaaagagaatcccataaaaaatgttatacaaatttacaagctcaaaaaactaaattaaacaaaaaaaagtcaaaataattcatcgtgtcacattcacgtacaaaataaggcgctgaaaattttggtgagcagaaaattaaataactagaccaaaaaaggcaacatatggcacacaaaaagagaagagaactaaattagacaaaaatttagaagaaaattagaggaacacatagctaaattagaaaagaatttagaagagcacaaaattaaattagacaaaagaaaaggagaagagaactaaaatagacaaaaacttagaagaaaataagaggaacacatagctaaattagacaagaatttagaagagcacaaaattaaattagacaaaataaaaagaaagagaaataaaatagacaaaaatttagaagaaaattagaggaacacatagctaaattagactagaatttagaagagcacaaaattaaattagacaaaagaaaaggagaagagaactaaaatagacaaatttagagtggagatgcgggggatcgaaccccgtgcctctcgcatgcaaagcgagcgctctaccatttgagctacatcccctttgatgtttgaaatgaaactaagaaaatcattatgaatagatgtttacttgagcaacagcaaactgtttagtcgcattcggatattcatcaaaaattgctgttctcgttcagaataaagggaacattcaacaaaaatgtttctgctttaacgcaacacaaatggccaagtgaaagtgcatctcatgtttaggctgagtccatcaatcgtgtgtttctaggctcgtggatcaccaatagttctctaggctggccggagtattctagattcgaatttaaacatcaaatttaaatttttacagttgttttactacttcctccatttcacaatgtaagtcattctaacatttcttacattcatatttatgttaatgaatctagacatcaatatgaatatgaaaaatgttagaataacttacattgtgaaacggagggagtaatatattgtagctgcattttctttttttgtaattgtagccggtggtttcggaaaaaaataaccggttattggcaggtaaccatcattgatctgaactcaaatatttagtttgaaagtttgtccgataaaggtttggataaatgatgttcccaaacgccaaatacttattactccctccgtttcaggttctaggacgttttgactttagttaaagtcaaattgctttaagtttgaccaagtttgtagaaaaaaacaatactctctctatttctaaatatttgacgccattgacttttttaaatatgtttaaccgttcgtcttatttaaaaaatttaagtaattattaattcttttcatatcatttgattcattgttaaatatacttatatgtatgcatatagttttacatatttcacaaaaattttgaataaaacgaatggtcaaacatgtgctaaaaagttgacggtgtcaaatatttagaaacggagggagtaacattttcaatccaagaaaaaattattatgaaaatatattcaagtttagtattataaatattactatatttgtctataaacttagtcaaacttatttcaaatttgactttgaccaaagtcaaaacgtattataacctgaaacggagggagtaattattattaaaaaatagttattaccaaatggaaagtatacagatcatatgccatcacaggaagtcaaatcttgatcacacctaaacgcaatgaagtgtgaggttgggcctacacatgtgtccgtgctgggcttgaggtccagcaagcaacacgacggcccaaacaagtcgctgacacctcacgctgtggagtggatccactcaatctgggccacacaagccttatccgacggtagcccagagacccaagggggctcggagtctaaaactccgaaccccctttgtgttttgaggcgcagcggattagcttatctctggctgaatatcatcaaaatttgtatattttccaagactaaagtatctttgtttctagacatgaacacgaaaacaccatgtatgcattagttacaggaatcatgtaaaagaaacatatttgtttgatatttattccctgaaccttcctaaatgataggtgtttcatcatattccagtattccacttgtacaagattggcctatttctaaccacatgcgcatgatctgtgagactgagaccgtatgaacttactgtcggttgcttttctgcatataaattcagtacgtctcctgccgaatgtctagcgttttttcttctagcttgtcaagactctgatgacatatattgttcttatcagtcttcagcttgtctcaaaaacgattcttgccacaaaatgtgtatccatggtgcaaattgtgtaggtaatcataaagctccttgctgacctttagaacattccaattttaagttcagagaccgcagatggttctattcatttcagaaggcccttttgcagtcatacaatgagcatgtgacacaattagaaatgtagacaagttgatttccactcttctaatgtcccatgttccatatgccatctactatggaagtccaagaatgttagaatgattgacaggggctagaaccaacttggaagttaaacctgacaaatggctgatcaaatctgtggacttacgtggattgaagagaggagttggtagtggctgaactttgctagtcaaaaaacgaaaaaacaaaaaagatagtatttgaacatatttaaaacattaacaatagttgctacctcattgtcaaagtttgtggtacagttgcctgtgggaaactttgaaactatgaaaactgcaatgacataataataatagtcatgtactcaagctgtcttcagattcaggtatttggtatgcattgatgtttttttggaatatgaagaaatgcattatccatgtgattccatattgccatctacaatcacagtcaagtagaagcggccatgaacttcgcaatgattgaagagggagcaatgcaaaggctcagcacttcacttggcaattagtttatggtcaaacatgtttacttaggagacagatggtccatggccagcctcttccatgtggacaggcatttttatgtagtactggatgcatcatggcatttccacttggtatgattaaccttggtctgtcctgcactacaccgtcggctgatctttcctcctggtggcgctccgcgcggaaatcaatttctaaacaagaccgtaagacttttgatgctggagttatcttggtgacctggcttatatggaaggaacgcaatgctagaattttcgacaacaaggccattctggcggcgcacttatgtgcagcgatggaagatgagtggaccacttggggtgcagcagggctgctgtgtccactgcaagccggaagcaacctgatggcgagagagcaacattaagccggtggtggtagctccctgctctgtagtacagacgtgctttaatgtctggcaggcagcatcctctgtagcctgaatctgcagcttgcacctttgtaatttgtttcttgtgacttttttcccctatcttaataaacttcggctggcttccgccagcccggcgaaaaaaatgattaactagggcatcccattagtaagaattattcttaacatagtattcaacattgtttcagttttgcaaatatagacctacaattcgaatgtttcagacaaaatgtagattcaatactgaattggataattttattctgaaataagcattgagctgaatatatactatccaaaatcaaaattcaaagaggaaggaaggaaggaaggaattctgaatttctgatgtttttgttaggcttgcccgggtctaaaaacttgattctgaaactgtggacagtgctatctgtgtacgatatgtttgtagccgatcggccgtactctccacgacgaagttagctgctatgctagccgatctgaatctgaagcatgcatcattattgagattcttatacatcctgaatgtactcttgaaaaaaatgaatgtccgatctgctcacatgaccgaacgtattgtatttggttgtttgtatacggccggcctgactgcaactctgcaagagatgctattagtcaaatagaagcatctctcacatggtcggcactcacgcatatatccctagaaagaattatggatcatatgcttaatgtgaagcattttaatggattagatcatctgagacgctcaaggaaaaggagatttttcagtcaaagagaaacagcactattattagcttgtcaatttgaggtctgcaaaacaaaactgaggtctcagggtggcatgttccagacccacttgatgcatggctcctgtcttcttaacaaaatattccacagaagctaaaatttacagggaaatgtgtggcatgttctctgcatgttcccaagtagtggatgcagcgtgcctgcacattgcatctgcatgttactactacaaacaagctagtctgtgtaacacaagttacaagaacaatatatataagccagcattgctcccccttgatgcccaactgccatacacgcacacagtactgcaactaccaccacatcacagttgatcaacaaagcatcatcaccatgaagaagaaggctttgcaccgcatgttcgctgccatcttcttgctccatattctcctcgctgtaactgctgctgcatcaccaaagaccagcaccggcttgttgcgtgacggcaacaacaatgcagtagctgctgttgctgctaggagtagcaggagattgctgctgcagcaacagcagcccagggcagcggcgccgacggcggcaatggctaccaacaccttccgagtcaatggcgttcatcaggcgaacggcgagcccaaggtggagttcgacgccagcatgaagcacaaccccgggaccaacttcaatcccaggcacaattagaagcatccggcccggctaccttctgcttctttctggattctgctctacatttttagttagcaaaagttttgcagatgagttttatcaacttgtagatagttttaacccagctttctttagtacaattaagatcgtgtcgctagttttatcattagttccactacactgctagcttagtagcttgtagcttaatcagctggatgactcacgttctggccgttaggtaagctagcttaatcagttaatctgctgtatccttcaattcaccgagaagaagcaattggagaattaacagcaatttattgtccgtcgttcaaatcagtatgtgaatgatacttgtgggctcttttcggcttcctttttctccccatctgtttcacaggctaatgggctatttcctgtgaccatgctgcctagactggaacaagaatcaacagaaacagcagtctgtaactctgtattcctgatccacaattgctcaggatgcccatatcaaagactcaaagttgtgtgttcatatacctgaagcacccagcaaatatatgttccaactggcttacttttactttgttaagctaggagatttttttttttcaggatttctgaacaaacaataatcttgccacagaggacatggtgtacttgtattcacaatgcagggtacagacttcacctcccctgaattatccactctgagtctgagctaacaacgcagccacatcctcagaatgaatgaaggaaaggaaaacagcaaacttgcatagcaatcattttgaataaaaaattaagtaaacaaataaacttgaatatgacaaatatttgcagttcacaacttcaagtaaggatctatggatatatggcttctctagcaaactaacagagccacaggtaagttctaccattgaggagcccaaaaaagttctttcacttgggcacctctttaagtaacaaatgtaatgccgacatttgtttgcctcaggactaacaataagatctggctatgcaaacaaaagtaaagtctaactaacttcacataatcaagaagagttgaacaaactcctcagaccaaaaggaacagttgtacatcacataagccgcaagcctatcctacaaatcctcccaattcataagcattaatcctgcttcacgatgcaggactcgccaactatcagatcaatcctcagggattattgtttaatatacaaagttagcacaaggtgcttcctttatagcccaacaattgttgtagaatcatcattgccgttgggcagatggagattgctgaacctgcactggtgggaagaacccagcacctggtggttgaaaaaatccagtcgaggtcggcgattgctgtggtgcctgtggagactgctgctgctggggctggctctggttctgagattgtgtaggcagaggcagaggtggaggcacacttagtcttggaaaacctgctgacataatgttgggcaatgggggtggaggtggcgcagagccactcaccatcccaaaaggtcccattccaaacattcctccagtattttgaacaaattgtggcataagtggtaatggaggtggaggtggtggaaatgaaccagctgcttggtttgcttgggttggtggctgtgtgcctccaagagcagctgttgctccaatctgtggttgcacctgcggcagttgcccaaagaatgggggagcactcatgtcactagcatgaatggggttgtcaagcctaggcttcttattgctctcaaagcctggagg

SEQ ID NO: 17445 - DNA, 1965 bp, Oryza sativa
agcaagggagtattgtattgagtaacaactaatctggcgagcaatatttagaagatggagagtcaagagagatcgaacggggagaaaaggactcacggcttaaatatatatttgtgatataatattcatatttggtgttatgaacaggaggaccacgtactgtcgtgtgggaacaaagtattaaagggttgaaaggagttatatgtatatatacctattaatcttgtgataagtcgacatgacacaattatgtcaaaattaaatccataatttgcacgtttcgttttctattttttaggtttagacgcataaccttgaagatccttgatgagttagaaacttcacaccgtaccttataattcgagcatccacaaaatggtcctttataactcttcgtcataccttcactaccactcatatgaaataaaatacgctctctttctctttcttcttttctatgttattttgatgtgatttttataggatgcagacactaacttaggcgctgtttgtttcagattaagattattgtaatataaatctagattactataagctggattataataagttaacatagaataagctgtgagttgtttgtttttttaattattagagacatctaggggtagtgggtctttagccacccagtaatcaaaaaaagctcctctagaggagattattagattatagtaatctgacttatagattataataatctatcataataatttacttgtttgtttcagtttactcctaataattcaaattataataatcctaaacagggccttaatgtcaattattatctttatacattgtgaataggtagtttaaaattttggtacatttaccaaagaatcattttgattacaaaatatttaaacatcacttaattaattcaactaattaaacacggcaataataaagatctaaaaacgaaccgataagatcaactcaccaagcaatcgaccgactcagttgcgggttcacgatcttgataccaaatagagagttacttcctccttctaaagaaaccaaacctaatgtatgatggaaaataatacagtacaacgaaaacagaatagattatgttctaccctatactactttaagttttttttggatagggagtagtacacgaaatttgacaatttgacccttcaaaaactattttacaaataaaccgcggccaaaaacttatttcaaaaatgattattttgttccacgccaagtcgtacggcactaaacttagacatatcagcgctaaatagtacggcgctgaatgcacgttggcacgtcgactcagcctcccatccacggtgacacagcatttagcgccagttgatgtgatgctgatgtgtctaaactcagtgtcatacgatttgacgctgaaaaaaatatcatttttaaaataagttttggccgcggttcatttgcgaaattagttttcggaaatggtcaaattttcaaattttgtggggagtagtaggcggctaccaaaattcagatgggccgaatggatcaaatcatttatccgagaattgaacccgggtggtattctttttttgcccgtattaaagcctaaacataatccaacggtgctagtgcccgggtttggagagtgtttagacctaaacaaaatccaacggctgagatcatctgtcgcacaggccgacgaattaattacctctctctccttcgtcttcctccggaaacactcccctatctcgagctcttcccatggcgaccgatgcttacccagtccagctcctccaccgccaagcaaccgccgccaccggcggcggccaatggcacaacctcggcgccgcctacgccgccgtcagattcctccgcccgcagggccgatccctcgtcctgtactccggccccgacggcggcgcccagcagcgcatcgtgttcgcctacccgatcctcccgggcgacgccttcgagaggatggac

SEQ ID NO: 17446 - DNA, 8426 bp, Oryza sativa
aatattttctttcatacttaccttgatccttggtaggatgggattaacaaattaattaatcaatcatgggtatgtaatggtatccagacctgtagttatcatcaaccagctgaagaacaacaattgaaagtagggagaaatgtttattacagactaaatggaaacaattacaacaggagattggtttcaatatgcagagattgcagctcactaacaccatgaatcacacagcagtggaacaaacaatataggaaaatataatcatatttaagcagcagttaacccaataccgcattcagattggatgatgctagcaaaaatacactctggaggaaattctagagatcaattacatccgcaacaacatcaacagcgggaaaaaggaattctcatttaagtgatacagcaaaacaactcagggcatcaaaagtaagatacatttgcaattcaaggagatagtgctcatttaccaagagtataaatcagcaaactaatgcccatttgctacacttcaaattttatcagggaaatatgaatcagataaagctttgagaattgtaatttcaataactcatgtaaatattcactagacacaacagctgtgcatcaaaggattcaacaaaaaaaaccaagctcttcttatcatcaagaatgcaccaatatactacatagcacttcatttcatattctgacatcttgggaaccttacctcactctcaaggagtgagtgagagggtaaaggaaaactcttctgtcaaaagagttattctgttccatttaagcactagtcttagaagtccagtggcattccgaacatgtcattgatctcagccatcacatcgcgggtagtaatagtgggctcaaagagaccactctgacattcaaatttggaagcattgcttggtttaacttgggctgctggattttcgcctggttcatcatcagctaatatggagaaaccactgagcagtgccgcttttctctctgacaatgcagtggttttcttgtttttaggtttatcacctttgaagttcagtggtatcccaaacatgttatttatatcatccatagcctcctttaaattgacagttggttcgaccaacccatggtggcaagcattttccactttaggctctccaacaacagctgatccaacaaatctatgaaagacagtgtcttctcgaagtccagatattgcaggacgtaagtcatcacatcttatttttgaatcagtttgtctcgaacagagtgaagtgtccttatcatcagttagttgcacagttccagaattgatcttaacaccattatcatttttctcaagctgttcatcttcatcatcaggcagtattgcaaaccctcccacgaatggtttctggaagtcaaaattggcttgctgctttgaatcacgcgatggctttggaggacatccactactcttatggctcatggcattacgaccattgccatgagcctcattttcatcaacaaagatttcaaatccacttgcattctgatttacctgtgtgttctccttattaaagtgcctatgctgcaccatattttggttgttgcagtaaggatcatcttcatctacaaagatctcaaatgcgcttgcctgctgacttaactttggattatcctgcttcatgtttttgtcctggagtttgctgggtccactcttgttaggttcatcttcatcgacaaagatctcaaatgcacttgcttcctgattaaaacttggtttatcacgatttgagcgcctcttgagcttagtttctggttccaatggctccaaaaacatgctactgatagcatccattgcctctttagtgtttatagtgggttcaacaaggccatgatggcatgcatcttcagtttctgatttcccaaccaatgcagagcctacaaaccttacaactacagtatcatcactattatgacgagacaaactcattgtttctcctgaagtgcctctagatagtggacgccctaagggatgcggaaaacccaaatgaggattagaaccacttcctgatctttgcactggattggacttcggttttgtacaacttctgctttgacctgcaacatattccaacatcaagaaccattccatgaaacaaccaacaaatatgcaaaaagacagttcaaaagtatggatcttgaataatgatagtttaagtgctgccaagaaggtatttttctttcatagtcttgatcagtaagcttcgaacagtaagaagcttgataaaggtaacactggtcacataagaaaatattgatttgcatagcctgatacatgtttttttccacttagaagtaccttcaacttcgttctttgatatagcaatggactgaaccttgttaggcattcgttcctgctgcactctagatttcctcctcttgtatagttccacgcgccgaataaattgttcatgtgctttctgcagctccccaacaggctctgcaaggctattgaatacattgataaatggtaagtacctacctttaatttgcaaggtacttcgtattgatattaattttattgtgaggtttcacttgcaaactgcaatccaaggatttgttactccattggtttgcagtaggcggatctaagatacgtccattgacaattgaattgagtacatgaaattttttttatgtgtccttacatatcagatgtttcctttaggacatatgagatgtagctgttgaactaaattttaagcaatgataaccgcaaaatatggtaccagcaactaaaatggtggtaaaaatcttacttctgggttcccaagcggtacatgttctcagcatcctcaaacctcttgtgcttctcataatacactgcataagccatataaaatgctgatctcttaaggcctattctgttcttttccatcttctttagcaatggctttgcatctttcacatagtccatctacaccattgaaaaaaaatgcaaagatcacattaggacctttcagtccaagaaaatattcatatcaaaagatctctgttgtgcgtaacaaagcctagataataagataagaaaatattcttatcaaaagattcatgctgtgagtaacatgcaagttatagtatgagcaagcaaacaatagtatgaaatgaggacatcggattgaaatcactatcgaactactgtagattcaattggcacagggcaaagctcgagccccaaacaaattgattttggtatggaactgcagccaatgaacctctcaggctatctcaacagatccccaacgaaatgaaatccactatatatgacaacatcagtaaaaaggaaaggaagcatatggcggatggctggatgtagaagaaggtggctgaccagctggatccagacgcggaggtagcgggaatcgtcgcggtagcgggcgtcgtcctggaactcctgggcgcacttctgcaggaacctgggcagcttcgcccgcagcgtcgcgggcggcagcgccgcctccatcttcctcatgcccctagcaaacaacgaatcgatccatcaagcaacatgcatcgagaaggaggagaaggggaagcgattcggagtggtagagagagagagagagagtgtaccggagccatgggcggagggggtcggagccggaataggagcggatgtcgcccaccaccgccgacaggaggtctttctccttgtcgccgccgccgccgccgcagtgctgctcggtggccgccgccatgggaggggtggtggattggagcggcggcccgccggtcggggtgagcaacaccgagagggggggtttttccgggtttgaaatgcaagggtggctagtttgaaatctccttcactcgtgcggatgatgacaggtgggcccactaccatccttgacatatgccccacctgtcagcaagacaactcttgtcgccgcattgccaaaatccagtaatgataaattttaaaaggcagttcaagcatgggcattgcagatcacaaatttacaatcaaggtaagataaatgagcagccccatcgtttcactcatgttaatacttataattcaaaatttaaaattaaaatttaattttaaaattgattatatgatttttttattatagtttattttatagcatttgcttttgaatcgctaagaatatgtatataaaagttttacttataaattaaattttagttgctaataagccatacagataagcataaccataagcaaaaggatgacactgctcattggttccaacttccaaatttgttcaaaaaccttctgcgtacagtacaaaaattgatatctgctcaagatttatttaagtaatactgtgaccaaaacaaccccacaagtcacaagactcataatcaactctgcggttcgacctagaagacataggtttcaagccgttttgtggaagagatcctggagatcaagtatgtcagcaagaactccagctgcagtggtatcattgccagctccagcgccctgaatcaccagaggggcgctctcgtagcatctgctgtatatctccacctgcccaagaacaaagcagcgtcacttttacgtttcacatcactcactaccaacagtaaaaaatcacatatcaaacattctttaatcctctcaaaacagaaaaatggatttcatcaatctacttctaacgtgttataggccaacacaaacaatgtctttggtagttttagtgttccaacttccaagctcgtttgaacaacgcaaagaagaaatggggaatggtatgccaatacagaccctgctcacactcgtaggctcttttgttttcacctgaaaataaccagcccttaaggctaccaactgcacagtgccgcttgacattgaataaaatagaaatagagaaaggaaaaaaaaggattagcataccacattgtcacttcctctcaaccttcccagtgcagagtttttcgggagttcttcaaggcccacttggcacctacaaaatggggatgttactctacagtctacactaccattaaaagtacctttacaaaatgcacagaataggcctacgtgtctctgacaatagtatgctttgagtatcaaaacactacttagtgattcagatgggcatagcacaataaaaggatacgtaccctgtgctttcaatcttacagacatagcgaagaacatttcctttcaaagatgctgcctttactctttcttcaatgcttttatcaagctgtactaaaccactttcaaggaagtcctttgtggacattgcatcaggtccaaattcactggggtataaactctcaacctgaagataattacaaaaacttagcagacctgatcttttttctatgaacagggatgtacaacagaacatgtgcataaataggctatgcatgattagaaaatttctgaataagtgatttaggggttaaaatatctcaaaatcaaagttcttgtatcatagaaaacaactgaactagcggccactcaacaaagctaatggctacataaactaaataacaacttccaagatttggaggacattcatttcattttcagactataagatacataaggtgtataattcatcgggatccccaataatcctgaacacaaatctatggtgatatccagtgacctgatattgtagaagagtgtctgtccttatccatagaatccatgtgccaagatattatagaagtagaactaaagagaaaaggatggttccaagtaatgcttgcaaactatcaccaagaatggtatcaacaagaaatgtatcattttaaaccaactaggttttttttgaacagccagaataacaggaaaacacttgctaccagcctcatttatgttagtgaaaacataagcccgtgcacaccaagctatgtttacacaaaacattagaacaaataccatcaagattaattatatgcatacattaatattctccatgctgatccgttgccccagaagcctagctaagatcaatgcctgcattcaaagatgaacttgttagacctcatcacctaattgacaaagaatgaaataatcaaataaaacatctgaacctgaacataaacctcccttatgccaatgtctatttgcaaggttattattgaaattccaaatagggtcagtgcatgatataggccttcctgaactgtagtatttatgatattgatgtggtactgaatatattttggatcaaatcatagtatgatacaattaagcacaaaaaatagatacacagcagcagctcatgatatattagttcatggacttaggagtagaataaaattgtggcaatggttaacaaaggcacagataaagtgaattatgtagagtagcatgtaattcatcagatgaaaaattaacctttctagctacgtccatcccactgagatcatcacgtggatctaccaaaattaaacaactgagtaagtgcacttatcacaagcatcagtagactttctgtaaacatgaaatctgtaattacagataaggaatgaatactgagtacacattgatgttataatgtcaaatgaatgaataaatttttagacctggttctgtatagccaagagacttggcagttttcacaacttcactaaatctctttccatcctccagctcactcatcacataaccaagtgtacctgcagaatcatagaatggaagtggtacattgctctgctatttggaaaacaaacaccttttacaaacaaataagataataactgtgtaccactcagactgccaacaatacgagaaactggatctccagaggcaataatacgggtcacagaagctattacaggcaaaccggctccaacctaagagtaggaatagtaaatatcagcagagaccctcaactcctttgcaataataaaagaaacttccaaaaaaaggctgtgcttaatcatatggccagagtcatatcatacaatcccagatcaaataaaggaaagaatttccatgaaaaacaaatataataacattcaatagtgaaacgaaggaattactagtggcgtatgcatacagtagattcaaatctcatgcgacggaagttggaaaccaacttttcgaaatcctcctgcatgaaaaaaaaaacacatttggtaagcatgtcaaaatgacaaaaacataccagacggaagacttaaggaggacattacataagcacaagtaagcggtttcttgtttgccaatacaacacaacatccacgatccacggcatcctttagcatgccaacagtatcataagttgcagaacaatcaactagtacaagacctgcaaaaaggattgtaagataagaaccgaagaagatattaatactccttttttttaaaaaaacaaagaactaatcaacaatcatacagcatatcaaagattccatctttttccccactggtttctatcccatagaaaattttaaaaaacttaaccggcaatgtattctgcttagggagaaggatcacagaccagttgttttcccaagaacgctggcagtgtcaatgactttcctcctagcctcagggttgttgaatagctgacattgccctgaaaattgcacaatccaaccatccattactttacatgtcacgtgtacaaatgcaaattcatgacaaagtaagctatggagaattctaaaaaagaaaaaaaaggaataacgaaatagaatggggatacctcgagagagcagagaagataagggcgagccggcggacttggcggcgcagagatcagcgaggagcgcgtcgtcgaagccgttggagtggaggtcgtcggcgacgagcagagaggagctgtcggcgacgccgagcacccggatggcgacgccctatacaagtatcggcgatgagagcatccaatcggagaggagggggagagggaggggcggtcagacgaggtacgtacctggttggcgtggagagggcggcaggagaggatgtggcggaggaggtggcggccgacgccgccgcagccgaggagcacgacggggagcaccgacctcaccggcgccgccatttgttggggcactggtgcttcacagcttcaccatttttggtttcttcggccgtctattcggcccagcccacgcagctttttttttttcagatgacggcagagaagggttaagcattggccaatgtccctatgctttagatttgatttagagaatatctccatataacattgtaataaagaggcaaattgtgtagcacataaattatctagatcatgctttcattttgaagaattcttgtaactgggttgaaccccctagcttctaaacgttgttgtgaacgttataactgtgtgttttgatatcaataaagcgcgtcaaatggctaaaaaaaatcttggttgcaggagaggagaagaattgtggaatatacttcaattgcatcaaatcatatcttctgcaatttaaactggaatcatttt

SEQ ID NO: 17447 - DNA, 21465 bp, Oryza sativa
  unsure (1)..(21465): unsure at all n locations
cttcgggggaaaaaaacatcatccatgccttgtgattaacatttggttcattgatgatggatgatgtgatcgtgaaggatcttgaactcttacaattccattatgaatgtgcaaaagtttcatatcatggatttcctctcgaattttgtgatcttccattatcatccgtataccatctatttagtctctctcgagcaatctctacctaaaaaaccaatagagcacaccattaaaatctaaaaaagtgtgctctttcaatggcccacatgtttttctagatagacccttatattatgtgaaaaagatatttaattaaatacaagataagaaaaaatatgagcaaaaagataataaagccaacctgtttttcccaatcagtcctaagtgtgatgaataaaagcacaagagtctgcactagtgttccaacaagcatgccaatccaaatgccctatagagccaattaataaaagtgagaaacacagcttagacctaagatttcctaatgaaatttacaatggcaaccaggaccttacctttacttcaaatcctagagcatagcctagtattgccccaatagggataccgatcaagtagtacgatgcaacattaacataggcaactatagtttgccaaccagatccaatagcgacacctataaatagttagaaaacgttgtaatttcaaagtgaaagtttaaattattttgatatattcatctgtcaaataaaataacatacctgagagcacaggttgaacactatttaataaaatggagaaagctagaaggggggcaagatcagcaactgcatctactacctcttgactttcagtaaatatgtatgcaaggcttccacgaaagaaaaggaagagcacaaaaaacacaaatcctatcaagaaagaagtggtgaccacattgaaaatggcaaacatagcccttcttgcactcccagctccaagttcatttgccacccgcactctaaaaatgtatatgtattaagtataagtcaaatttataggacataatggaatagtcagatgaaccacttaatgagtaacaagtaagatcatgaagttacccagttgcagccaaaaatccaatagaaatcatcatctcccaaccattgatattaaggctacaaattttgtaagtgaaaacaatagtgctcaataagcaagttcttcaagcactaaaggatagacacaaaacaataaattgatgtacatgatacaacatgcatgctttggctattattttctaaactactatgcaacaatagtatattaacatattaccatatagaaagagcatcaagagcaacctctgcattcttcatataaccagtgaggagcaccaatatggtgttgtaccataattctacactgaaaggcaaaggaacaacaagaacaaatcaatgagctaccaaattagctataggaaagaacttggttaacactagcttgatataacatattgccttttgtttgctatcatcaaaattatccagaatttcatatgtatacataaacataacagttacttaccaaagcatcactccggatgatatcgaaagcttgataatagcaccgagatcagtaaaagcagaggacgagaaccctgtccatgtttgaggacaaccaccaaaaaagacatatgcgagctgaccaaatatagggatccaacaggcaatgaccgtggagcccatcaccccagcaaggccaaggtgaaacttgaccaccatgagccatgataggaagagatggagtccaaagttgagcaaggagaggtaggtaacgatcatgttcttgctttgtgattgtagatacatttggattgttaagccccagacgtaggagaacatgatgggaatgtaccatagtgagatggtgccagccacaacagagatatcgggatcctgaccaagcgcaattaggagcggggtggtgaagaggtagattgggagaaggattactgcacaacagaagagaactatccatgagcgttgtagatatatgcctaacatgtggtattgcttagcaccatatgattgcccacacaaagtttccaatgcgcttgccatgcctatctgcagttacaataatgtatatgtatggttaactatcaattaattgttaatagtgaattgtttatgtatgcattttgtacaagatgatttgtaacaaaaaatgattgttagtaaaagataaacatttttataacttaaagtaaggtatgtttatgttttatttgtatattttgtaccataaagagtttgttattgttgcagtgctggttgtcagaggtagcacgaagaagataggatatggaagatccaagaagaataaagaaagagcacactatatagttattgcatgaagaaaatgccatgattaaggggtggatgactagatgaagagcctgcttcaaatattaattagtgttttgaaagttgaataatttgatgatccccttctcaagaagaaaaaaaaatgtgaggaggcaagtatcccatataattttcttccttcggtacgtttcatgtctttttttttacatcgagcctaactcttatctatagtacaatggtggaaaaaaacactttgaaagtataaaggcaaaccaaacatacatgatttgtacgaattaatcgatgncctacttncctgctngnnnnnnnnncttagtgacgctattagtatcgatagacataattaagttcatgactccaacattattaaagttatgtttttaaaattggcaaaatttctcagagggggaaaaaattttnaaaatttncccccccccaaaaaaaaaaaaggggaaaaagggnccggggnaanttntttntattaagggnatactcccaaaacgtggcttgaccagaggacacctaaaagaacgtgttaatttgctagaaaatatcatatctattattttatcatttttagcatatttgaaaacgaccagaatagcccagccctctcaggtgtgaaaaccagaccgtatccctatctcctagtctctctgctctctcgctgttgaaccctagcaagagtgaagactagagggaataatcgacattttgtatgtcttctcttttcttagctgagtacttcctcggtcaaaaaagaaaaaaaactaatcctgggtaggattaggttatttttgggatggagggagtagatcgatgttttaaggtgtattcgtacaaagccatgttttgatggtgcgtattagtaaataagggttaattactaccataatttgtgaatatcatgtatcaaattttgtctttaaatgttgctagttgcagaaagactaatcatgtgaaaaaaaatcgagttgaactgttacacgtactaacgaaaactaacttgtacctgtaattaaattaagtagtactacgtactaccgtataagcaagaataatcagcgttcatcaggcataccaggatgccgacgctcaagcgcatgaggacggtggagacgagggcatacgcggcgagctcggtggcgccgatgtgcccgatgaaggcctggctgacgacggtggcgccgaaggaggtggcgcgcgcgcagatggacggacccgccaccacccacagcttcttgttctcctccaccaggcgccgccccagcgacccaacctcttcttcctcctcgttgctgcctccgccgccgccgttgatcgccggcttaggctccaggagaggatccgtcagcctctcatcatcctccgtcgtcctctccattgctactctgctagctagctagctctccagtgcacaacaatggagatcgatggagttaacaggagtacgaatactttgagttgcagatattagtagctgtctgaattgaagaaggctgcagggagggaaaagaaagcatccatcgatgatgctcaggtctccccatctaccgtttaatggcggggccagagacgatcgagcgaggaagtacatgattggccctgtggttgctgcagatggtgggtaggtagggagggcagtgtgggaagaaattaataaacaattattcaagtcccgttctttttctccaataaaaaattagataaaattttggatactcgtgacacgcttttttgcgaaaattttatatataaaagttactctaaaatatcaaattaattatttttttaataattaaaactcaattaattatatattaatatcaacttattttacacttgatcatcatcatcttttatctttatcttgtgtgggaatactatcatcgattcaggcaggggttgtgtgtaaacataatgcatgtcagcatgtggcgaggagggcaatcacgtgtactttctcttttaaaagtcatacgtattctgtttccgacggatactgtaggtaatctccaccacgtacctccaccaccatcatgaagcacggccgggcgtacggaggaggaggagcgatcaagtctataataattaaaattaaaacttaattaactatatactactctctccgtattttaatgtatgacgtcgttgactttttaatcaacgtttgaccattcgtcttatttaaaattttatgcaaatataaaaatacttatatcatgcttaaagaacatttgatgataaattaaatcacaataaaataaatcataattatataattttttaataagacgaaagatcaaatatttgtcaaaaagttaacgacgtcatacattaaaatacggagtgagtaataactttttcgttttatatacatcaacgtaacttttatcttcatcagttttaagtccaattagaatttaactttttttttcttggatgaatggagtaatataagtagtactactagcagcgatgtggcctaccggtatcaacgtcatcgataaatggtatgtttgtccggcctcgctgctgtgctgcatcagtgcatcctcatgtatctgcgtcacggtcactggctcactgccaaattaattaaagtggttgctacaaaaaatgattcatcatccaacgatgccaacgaatgcatcccggaaaaaggagatcacgggaagggaaacattacatcattgcatggagacaccatcgacatcgagtcgccgtctcgtgtcggccatcgatgaactttttttcgaacctttttattttttttgaattttaaaaatgaactcttacaaaatttaatttcaaaactactccctccgtcccacaaaatcacaaaccctagaatcccaatgcaactttaggacaagtgacaaaagacaacaatgccctcaatacaagtacatccaatcattagttacaaataaaataataatacaagttgaatatctgcagccaacttgagtagagtagtacaagtagtacaccaatcatgggcaccaaatatctgtacaggccactaatccagcgcgccaactaatttgaatcaaacaacaccattgcttggcggcaagaaatacaaatttgagcacaccccagcacaagataccctataaaagctcaaaatgaaccattctcacaagtttccctcccaacttatcacttcatgagtctgcaaaaacaccaccttcatggctttagatctaaatgaactagcagatgagggagatgagcaagctgtgcctgaccttaatgaaccagtggcagatgagggagatgagcatgatgtgcctgaccttaatgaaccagtggctacagaagttgaaatgcatgttggtcaagaggaggatcaacttggaggtgatgtacagggaggtgccaaccataaccatccaggtgaccttgcaagcaagaatagtaaacgatcgatctttgtacatatgacttgcataaatcactctaaatctttggcatttttttttaaaaaagataccatgtgcattgatggaactgctatgttcttggttttttttctctttgttctttaccagctcgattctgtgaatgagttgggcatattgaagttcattcccttccataatatcacaagttatacatgtatctagctataactaatcaaatagtgctcacatgatgcttatcttctgtctacgatcaatcctcatatgctagattctacatgtataatttcctttacagtaccactgatattgagctagtattagtatatatcaaagttagattgcaccttcaatacagatcacaaaaatccctgaacttcagcaccaaagtttgtacaatgtagaaaagtcattcaagtatggccataatataactagagcagcaaaatacccaatggttctcctgactacagcacaagcaccttttgataaaatcacaatcatgaatagcacaagttagggaaaaagaaacatgagcacttccatgagtttatttacagctgacatggacctctattgaaaaacaaggtgaagagtacaataacaaaataggtagacaacaaaactaaatttgagatggatataaaattggtaccttgattgtggttttcagatatgataatctcctttgctgatgttgtactgcacaaagtaacctatattaatcattggttccattatatatatagcataacagatcagttattcatagaagtatttggctacattggaagagtagtataagcattattacttttagtcacacatatccagttagccaatatgcatggcatgtcaaatagcaagtatcagcactaatgattggttgtaataatgcaatgtgtgagctatctgagtataatggcccataattattttattgtagaatgtaataaaatagctgcaatagtattgtacctaacaaaatattgatattagacttggtactcacatggtaattgttattgtagacggtgccgatgccatggatgaaattctgcaaatttatggaggtcacaaccaacatggctttccttttgatgttaactctgatgcctatgaggaacatctacaaatgcaagcaggtaaagcacttttagctgacatggataacaaacttagtaaaattaataaaatgtggttgtacataaagcaccactgaagaataagattaattaactgaaaccatgtttttaattagaagatactaatatgacatcatgcgaactacctagaataatctaaacataacattggatgcattagttgcaaattatggactgtcaatttgacatttcagcacataaagtaaattgtgtcaatgtttctatgtccttctgaaatctaaaatcagccataagtttacaaccatgttgatccatgataataaaatatccaccatctaaattggtacagacgactcaccttgtaattgttgttgtagacatgcaggagtacggtgtgtatgctggtgatgtggaaattgtttttgaacaagaggagttggatgattcagatgaggaagatgaacatccaaacaaaaatcttaccaacatacaaaggcaagagatatatgatgcattggttaagaaaactatcaatggaagactaagaaaaaaagcaacaactgaagttgctgaaatgttcaatatcaaaaggggtagagtgcaagatatttggcgaagagcaaagcagtgccgtgcacagggaattccagtcaatgtaagttctagaaagaaaactaattctggtcgcaagaagaatgaaattgacttgtcagatgttgctaatgcccccctgcaactaaggggcacattacggtcatttgcatcagctgcgggtataccaaaaagcacgcttcataggatgttgaaagaagggctgataagacgtcactcaaacacattaaagccattgttgaaggaagagaacaaacgatcaaggctgcaatggtgtatttccatgttagattggcatactttgccaaatgaaccgaagtttgttgatatgcgcaacattgtgcacatcgatgaaaaatggttcaataccactaaaaagacaagaactttttacctggtccattgggaggatgatccgtacagacccgtgcaaaacaagaattctattgataaagtgatgttcttggcagcagttgctaggcctagatacaatgaagaaggtatctgcacttttgacggcaagataggcttgtggcctttcaccaaaaaggtattataacctcttaatatatgcatttttacttagtgatgtgatgtgaaacttaattgcttatctaacttacttaatgttatatacataggaaccagcacaaaggacaagtcaaaacaggccaaggggaactctagtcaccaagacaatcaaggttgatcgagacaccgtaaggtcgtttctgattgctaaagtactaccagctattatatcaagttggcctcgagacgatgcacacagcactatatggattcagcaagacaatgctcctgctcatgtgccagtggatgattatcaatttgcctatgcagtatcccaaacagggtttgacatccgccttatgcatcagcctcctaattccccagatatgaatgcattagatcttgggttctttgcatcgctacaatcattaacatatagaaggatatctaggaatatggatgagctaatacataatgttgagcaggaatttcaggcctatgatgacaacaagctaaatagggtgttcctaacactacaatcttgcttgttagaggttatggaagctgatggtggaaatggatacagaatacctcatatgggtaaagagaggctagagcgtctggacattctccctaatacccttagttgtggtcgtgaactgtatgaaaaggtcatatcagcattagccaatcaagtgcagtaaattatgcaaaatgggaaggtctatcgtagtttcagcttttggttaaatgtgatgttgtatatatgataaagtaatatcagtattactcaagtaaatgcaactaatcatgcaatgtggcaagttctatgatggtttcagcttttgtaatatgtaatatgaagttttatgatggtttcagcttttgttggctacatttcagattgtatatatgacaatgcagtatcagcatttgagtatcatgtcatgtggaaagttttatcatggtttgagcttttgcctaaatttcatcctccctccgttcccttttgatcgacgtattgcaatcgtgcagcgagaccaaggtgaagtaaatttctcccattatcatttaaagcccacctcataaaaggcacaattagcacttcagttacttgcatgcaaaacggaagagagagagagaccccgtttttttattaaaactagtgcctagtatgcgaaatgaatggctagcgtctccttgcatgcatgcaaaaattaaatcagcatgcaaatctaagagtcatggccaccgtcctaggctaatgcgttgatcaaattggaacattttagttttacttatgcgctgatcaaaagggaacgagggagttttatatatatgtcacaatgtaaaatcaacattacatgcatcatcataatcccctaatctcatccagtaccacaattacacatgctttcatacaataccaaaagggtgcctactttaacataccttgttaggttgctattcataaccacctaatctaaagtactaccacaattacacataatttcatacaataccaaaagggtgcctactttaacataccttcttaggctgctatcaataaccacctaatctaaagtactaccacaattacacataatttcatacaataccaaaagggtgcctactttaacataccttcttaggctgctatcaataaccacctaatctaaagtactaccacaattacacataatttcatacaataccaaaagggtgcctactttaacataccttcttaggctgctatcaataaccacctaatctaaagtactaccataattacacataatttcatacaataccaaaagggtacctacttcgaggtactttgttaggccaccattcataatcaccaaacaggcacacaatcaacacataattgaagcattcatctaaattttttactatgaaaacactctagaaatttttttaccgatttttccagtgcgtcttggtcttgtaggagttcttctaggccgctatcatcgtatggatcttgcgcatatcccccaatgaccatatcaacatcatcatcgcttgacttgtcctcgtcgatgctaacatctttagcttttcccctcttctccttcatgtcagtttgcgtgacgcttgccttcttctcgaacatggccatgtggtcgctatcatctcccaacatagtcctgtaacggataaaacacagtgacagttaatacaagatgggatgtaaagatgaatctatcatggaatcaaactgaaatgtacttcgattacattatatattcgatacatttttttaaaaagatagtgctgacccatgtaaataagcaatgtctaaattgaagtatagaccaaatggactactgaacgcaatgaaagccaaaagtagagtacatcagtttatatatgcgtggcctagttaaaggatcaaatccagtgaataatagaagtataacaatcgaaaaagatttgcagaaatcaaagtatagcatccacggtaattctcgtagaacaacatcaaggttacctagttaatttaattagctatgaatgacagcctaactatctgtgggtgcagttgtactattggagcaagttgaagcttctcaacgataggtttcagtgttaaaatgaacaagtcaagcaagcaacatacgctggctaggtagctgcagccaacaaagcgagtacgacgagctgcattcaggagtaagtttctttactgatattgaaacaagtcagaacaaaataattaaccatatatacttagtttttttaaacaagatgatcaatcaagcatcatgtcctacacgtcaataatgttttatatttaaaaacagaggtattaatattcatgcattacagtgtcaccacaattttggatttttcatcagcctcttgattgagcaataaagcagtcaaaaaaaactttgagaaataaaattcgcatgttcagtatcaaatttcttacagtttataattgtttcctatactcaataaaaatttctaatttcagaatatacctatgggcaacaaaacagaaaggaatgctttggttaggtttaaaactgcttggatttttgttaacactaatttattttatttgaaacatgtcatcataacccccttctcactccatgccaaattttgcacaaaacaaaatgtaaaacccagctaacccgcattacttcaacattggtaacactgaccgacatataacagctggatgattataaagatacaaaacaccgaataacattaacctaggatattctatgcagtacaatcaaaaaaattttgggatgcaaccgcacccagtgcatctgatctacacacgtcattgaaagcatctctcattgcataaggggaacagattggttgtagggaaaacaaggtgaagatacctttgagtcaatccacgcatactgccgccaaagtccctagctgttgccaccggaatcagaacaggaggtcggtaagcctcctcctccgccgacccctcctgtatcagatccgcgcgcgccgccacctccttgaccatcacatctgccgccttgcaaatctccgatgtcgctgccgcatctgaactggctccacccgccgccgttgcctccgccgccttcttgcaaacctccaaggccgctgccacatctgagccccctcccgccgccgccttttggatcaaaaccgcaagctgatacgcctcctccgccttggctttcgtctcttgaatgaaaaccctaaactgttccgccgctgcctcgaactctgccatcgaggcaaatccttcgaaaggagccgcctccggcatcggatctaaccgctcgcaaccctcccccgctgtatcgaagcgcccgcatcctggtggatggggaactccgcagggagttgcggaagtgagggggagcggcgtggagcggggagagatgtgtggggaggagcacgacggcagtagggagggagtcggaagcttcgaagggtcgctcatctggacgccgccgcttcgacggaatcgatccgggagggggtgagggagcgatggagagaaacgcgagagagagaggcgacggggcgatggaatcgatccaggaggaacgagagagagagagagagacgcgacagaaaaaaaactgggatgcgataaggtttgcgtggtgtgaacgagaggatacgcggtccacctatggcccacacaggatgagatagatgggaagtttctcgttttctgtccagaaatcggtttttttcgggacaaagctctccccccaggattcgtctctttctgggacggagggagtagaccttttaattgtattggctgatctgatgtggtgaaatactattgtcaagtcaaatgaggatgaacatgatagtttagtttcgttatgccaggcgggatggcgtggttaaaagttttaaattttaaaaataagttttaggatgtttatttaaaatttaaacacaaaaaaggttaataataaaaaaaatggccatcctattcatcaattcatgccctgttaccttgttctcgtcaacccatcggcagcacaccaccactacgtaccagctaactcacgatttaattcaacatcgtggaatatagttcaattgcatcaaatcatatcttctgctatctagtagctgtctgaattgaagaagggaaggctgcagcgaaaggaaagcatgatgctcacgttttatatccacacgtcttctaaactgctagtatgtattcataaaaaaagttattttaaaaattatattaatttattttttaaatttaaaataattaatactcaattaattatgtgttagcgacttgttttgttttgcgcatattttcagccttctctaatactcttctctctaacacaacctgctgtgagagattgcccttaaattatatggttctgcagatggcgggtaggtagggatggcagagggggaaattagctgtactatgtaagtaactcctgatcaggattctcggacaacgagggatcaaattaacaggaattaacagttggatcgtgtggcaaggagggcaagcacgtgttcttttctccaacaaaaagttggatgaagattaagatttttgtgacacgtttttcaaactgctaaacggtgcatttcgtgcgaaaactttctatacgaaagttactctaaaatatcatattaatctatttttcaagtttttaataattaaaactcaatcaatcatacgttaataccgcctcgttttacgtaaaaaacttaatcttcatcttcatcttcagaagttttggtcctacgtggcacacacgtggcagtccagtcagcataaaaaataaaaaatggtagggcacttgtcagttctgcttcttttctcggtcaccacatgcgggctctaccttatatatatatattttaatgctgactagactgctacatgtgcgccacgtaggaccaaaaccgctagcattccggagtctgtcaggggataattcgtccgtataaaaagttgagggtgaagaatatctaatttttaaatagagatggataattcgtactgccacaatagttcaagcgtaattcaaactttttcctaaaaaataggcccgaaaatcatgcctctctagcaatagcagtgccctttgcaaaatgttagaaatttgtcatgtcatcttaggtgggctctccttcaattatttgtttctagcgatctgtttcgtttttgtcacgttgcaaacgacctgcgagcgctaggttttgggcgatcgcgcatcactgggccatcgcgtcagcaaggtggacgcgagtgcgcgccagctgtcggggcaaggaagggtatcgtgagggttccattagctgccaggtcaatcagtcacgccagagcattgatagaattgggcgtgtcggaatattagggccatgattgggtatatgttggaggctgtgttttagacataatttccaaagtaatatagctttaggtaacatgatcggttatctcttggagatgctctaaaattgaaacattattacaaaacactatgccagaatggcccgtttgatatagctttttgctggattaaccgatttgcttataggagccgatactcaattagcgcatggtcttttttgagattgaaaatgatcatttttgagttttctataaaacttttatataatattttgttttaaaaaaaaacaaagtgtttaatggtttgaaaagtgtgatcgctatggtctagtagctagaatttgaaaagaacacgaatggccagtttctctctgttttgttttggtgaaatttgactgtttctcatatttgatagttcaatcaataaatttagtcacgatagataataaagcatagtgaatacaatcgacttacatggaagcatacaaatgctctttctaattaatacaaaaattcatgtaaagctcacattgtgcaagggcttggtgaaataataggataaggggtatatatacaataacttttcccggcggaaaagccatcatcccaagccatatgattaaaattgttctttggtggatacgtgaccttgatgaattttttgaaagttcaaaccttgaaaatcttaaatccgagcacaatcccattttgacaggttgattcataaatcatcaaaattctttacaagtgtgcagaagttttagatcatgcatttcctattgaattctgtgatcgcccgttctcatccatataccatctgtttaatctctctcgagtaatctctacctgaaaaaaaattaaacatcaagcacatcattaaatgagaaaaatatgctcttctaatgacccatgaattttctagagagacccttatattatttgaaaaaagatatttaatcagaaaagaggataagaaagaaaatatgagcagaggtaaaaaaaaggcaacctgttttttccaatcggtcctaagtgtgatgaatagaagcacaagagtctggactagtgttccaagaagcatgccgatccaaataccctacataaagaatgaacataagtgagggacacaacttaaatccagattaactagtgaaattctatcatacaaaaattccttacctttacttgaaatcctagcacatagcctagtattgcaccaagagggataccaatcaagtagtacgatgtaacattaacataggcaactatactttgccaacccgatccgatagcgacacctatatataattagaaaattagtaatttcattgttaaattttgaattactttgatatatacttgtccttcaaatggagtaacatacctgagagcactggttgaacactattcaacaaaatggagaaagctagaaggggagcaagatcagcgacttcatctgctaccgccttactttcagtaaatatgtatgcaaggcttccacggaagaaaaggaagagcacaaacaacacaaatcctatcaagaaagaagtggtgaccacattgaaaatggcaaacttagcccttcttgcactcccggctccaagttcatttgccacccgcactctaaaaatgtacatgcattaagtatatgtcaaatttatggttcatgttgcatcagttagatgaaccacgtagtgagtgacagctgagatcgtgaagttaccctattgcagacaaaaatccgatagaaatcatcatctcccaaccgttgatattaaggctacaaattttgcaagtgaaaacaacaatgttcaataagcaaccttttcaattactagaggagacacacaaaacaatacaatgatatacatgatacaatatgatctggttgttgttttctaaactaatatgcaacagattggagtggaatatattaccatatagaaagagcatcaagagcaacctctgcattcttcatataactagtgaggagcaccaatatggtgttgtaccacaattctaaactgaaaaggtaaaagaaaaatgagaataaattaatgagcttctaattatttgtataaaagaacttgattaacaattagcatctaaaatattaactttctatttgctatcatcaattttttttgtcaaaaatttcatatatacatataaacataaccatgttacttaccaaagcatcactccagacgatagcgaaagcttcataatagcaccaagatcagtaaaagcagaggatgagaaccctgtccatgttagagggcaaccaccaaagaagacaaaagcgagctggccaaacacagggatccaaaaggagatgaccatggatcccatgaccccagcaagaccaagttggaacttgactgttaggagtcatgacaagaagaggtgaatcccaagattgaggaaggcaaggtaagtgacaatcatgttcttgctctgcgcttgtaggtacatttggagcgtgaatgcccatatgtaagagaacattacggggatgtaccatagagagatggtgccagcgacagcagagatctcagggtcttgaccaagagcgattaggagtggagttgtgaagatatagaccgggagaaggatgactgcacaacagaagagaactagccatgagcgttgtagatagatgcccaacatgtgatattgcttggcgccatatgattgtccacacaacgtttctaatgcgctcgccatgccaagctgcaatttacaacaatgtgcatatacggttaatttgtagtatatactgtttttatatgcatatcaatagatgacttatagtgcaaattaatatttagtaaaaagaagttttcataggagtgacttgtagtatggtctggttatgttttatttgtatattccgttcaaaaaatctaggtaaagacttttgctattgttgcacagctagtagacagaggtagtacaaactactttaattactgaagaaaaaaaatatatatcagaagatccaacaagaatacacatgaaaaaagacccggcaaaaagaatacatgaggtagatgctatatactccttccgtccctaaatatttaatgccgttgacttttttaaacatgtttgaccattcgtcttgtttaaaaacttttgtgaatattattaagaaatttgagtagtagtagtatatttaacaatgaatcaaatgagaggaaaataattaataattactcattttttaaaataacataaacggtcaaacatatttaaaaaagtcaacggcgtcaagtatttagagacggaggaagtactaattaatgtctggagagaaagccgtgcaagggaaggatggctaggtcaagagtctacttcaaagttttactagtactttgaaaatccaaggaggcaaggtctcacatgattaattttcttcctgcagtatgtactatatccattttttttaaaaaaaaaatcgagcctatagcttcttagctatagtacaacaatgctggacaagatcgaacactctgttttgaacctataaagacagcaactgaacatccattgtttgtctcaattaatcgatgggcaaattaaagcacaacaaaaaacttccagcgcgcgcggcgctgttagtctctgaatcggcacaattaagtcaaaacttaacgtcatcaaagtcagcttttagaaataaaaaacagctagttgccgaaaacacgaaacaggtaaaaagaaagatcaatttgaattgttacaacgtagtaataataatttaaacccaaaactgtgtaatgataactctgtaataataagtaaaaagggaatcagcggcatgacttaccaggatgccattgctgaagcgcatgaggacggtggagacgagggcgtaggcggcgagctcggtggcgccgatgtgtccgatgaacgcctggctgatgacggtgacgccgaaggaggagaagcgggcgcagatggaaggacccgccaccacccacagcttcttgttctcctccaccactcgccgcctcaccgatccaacctcatcctcctctgcatcatcatcttcctgatgcttgtaggtagccggcttaggctccaacagaggaaccgtcagcttctcatcatcacccggcttctccattttgctaattaattagtggcggcttgtagtttgcagcaatggagatggagtggtggtgcttcagattcagtagcaatggcgctgctggaggaaagggaagcatcaaggatgctcaagtatggagctactgatgatatatataaagggagtcgaatggaagtacaggagaagccgtgggttggtaacttggtatggcggagggcagaatcgggaattaacaggacttaattaatcgatgattattaattaatagtgactctagtctagttgatcagatcaatgtatatatccagttgagaatattcaggatcatccatatacatgttgagaattaattagcaatagtaagtggagtaagaaggaagggtgagattcgatctggggttttgtgtacattgtactatgtggcaatgagggcaagaacgtgtactgtatatagctttgctgcctgtagttgtagactgtaaagacgcgaggttatacgtacgcgtacgcggtacgacggcttagggcctgtttggtacagctccagctccaactccatctcttctggagctggagctcagccaaacagtttcagctccactaaaattgagagtggagttgggtggagctctctcacaaaatatattagagttgtggagataggtttaggcaactccataaatccactccagactcaactcctagagttatatttatatttaggagttgtagctgtaacaaacaggcccttatttgcgaatgcggggcgtcggaagaggccacatagagatgctaggtacccgtacctacagggcaccaccagcaggctgcatcgtgaagcacaggaggccacgcacggcggacgtaggcggccggaatagtagctggcccgccgccgtcagcttaattcgtcaataaaatataatggacgtttgtccggcctgcaatcggccactgcatgcgtgatgcatgcgtcgtggtcggtcaatgtccgccgaaattaaacatttattcctttcttcacaaaataagccaacacgtaccaaacgagaatggtttattttataacagaaaaataaaccaacttgtattggatgagggtggtttatcttgtgacagagattgtattttatacaaaggttttttaaacctggcaaaacggtgtgtattttaattttttttaataaagacattgtttaaaaaattatattaatttactttttaaagtcattttaatcatcacttgtgataagggttactctgttttttttatagggacaaagtgttccgaaccgtgtggttcgaacacagcagagcgtcgtggtcggtcactgtctgccaaataagctcccgtctcggtcattcaactcttctcgtcgagccacactagcagtaacaccagtctagcacgcctgcagctaaccatacttatatcctttggtaggttggtcacgtgccgtctatttaggttggtcacgttcttttctcgtgaagctactccctccattctcgagaatatagagattttaacatctccattctcgagagattttaacattttacttgcactgtttgactattcgtcttatttaaaaattttaaaattattatttattttatttgtgacttactttattatccaaagtactttaagcacaactttttgttttttatatttgtacaaattttttaataagacgagcggtcaaacagtgtaggtaaaatgtcaaaattccttatattaggggatggagggagtaacaaatactagtactaagcagtacttggatatacactaaacagcaaattcatgattttttaatatttatataaggatatggatgaatgaattaattataaagttaaaataaatttaaaacaatattaccataaaaaattaaaacaatatcagaagaatttttatatagaaagttttaaaagccgcacaatttaaaagcttgacaacgtgccaccgttaatccgttcatcaattactcgaaaatactggagcagtattatttatttgtttacaatgtaaaattttaatcacaacaatcgtatgtattttgctactcaaattccctatgccattgtgttcagtggtttggatgcgtggcacattttactcttgcttcgttgtgtattacgagaaaaaatactttgtcgtgcattataagagagaaaatatcaaaattggtggtctttatcgacaaactcgggctacttgggcttgggccatgaagaccagccatatatcgcacctaattccatatttacatatatatactatacagtatataaagagaggagaagcttggcttagcttacattaaaaagaacattaaacgagaaaaagatcatgaactctgtttcatggaaatatttttgcttgggacttgaaatatttgaaagcggaatggttttatttttgataataagctcccttctttgttatcctgaaggcagctccttaagcatgtgtttggtttagggatgggttaggatgggatggttttatccctgatttttggaatgggatggttctgtttttgtttggttgaagggatagaaccacccctattttttgtttggtttgagggatacgataggttggaatgatcctatattttgtttggatggagggatgaacatgggatgcttggatacaattacctccacacattagttggtgaggttacctctctcatagtctacaaactacaaaataatatttctacatgatgaccacactatatcaaaaaaatgaaataccatccatatcactatatttgaaaataagctccagcaacttcatttcagcatactggacaagctaccaaataatgaacaatactagcagttccataatcaacccctcaaaaaacaatcacacataattagctcacatctgatcccatttcaatccatacatagagtccaagccaaacataataagaagtttcaagtcgtgcacataatagcaaattaaggtcttacacataatagcaaatttaagtcttgcacctaagagttcactgcctacaacatattggcagtacaagtcatacatgaccatgggcccaccggcaacacataataccaaaagaactacccaactcatctaacaacgctacattgatccaggaaacttctcattaatgaacaaatggacccaatgtatcttgttttcgaaaggaagtccatcaaaagctctaacaatgtgagggttagcaaccaaatgagcatagtaaacagatacgtggatctcctcaaacccaggaaggcttttcaaggtttcaaataaaccatctggcagtttattgtctggctcagcgacctttagtatagcagaagctaacttgtcaccaacactggtgaatgcaccaatcagccc

SEQ ID NO: 17448 - DNA, 13824 bp, Oryza sativa
  unsure (1)..(13824): unsure at all n locations
cgacagtatgagagtatgtaaaaaggcaaaaaaaaatataactaaaatcttttatatttatgtatacacatgattagcatcgctcttcagctcttgcgttgtatgttttagagagtgagcgtgagcatatactccctctgattttaatatatagacgatgacattaatttttggtttgacgtttgatcattcgtctcatctaaatatagaagtgtccttttttattgtaagatactttactaattaataaaactttaagcatgacttatacttttattttttatatattaacagtaaatattttgaataagacacatgatcaaactttatatcaaaagataataacagcatctatttaaaaacggggtgatatctagacttctataaaaaggtagtggtaaggaaaaaggcaatgggctagatgacctacatgttaaccaccgtcaccaccaactcattatttttttttgttagtatcaaatatacgcagaaatcatgatgattttctttaactttaatcccattgtaatatacacacagtatacaagtaagtgggatattgtaggaagcacgtgggatattgtaaatatgagaaaaatgatgtgattgatcgactccattaaagtgggagcggggctgagacaacgtggaactacaaacgcccacaagatgcaagatacacgatcatctatcattcacatcattattatgatcgatggtgcataaatatggcactaataatataattcctcgtgacctgccgtgtgatgcactgataatatactagtgatgaactcctgtatatctgcacaatttctacaggagccctggattgcatgatctgtcattatatgttttgctaccaaactatatatatcataataaataaatgcaatttggaatatttttcattcttatattaaaaggtcatgtacatctatatatggattttatttcatcatttacaatattttaaactacacatggagttataggctgcacgtacaaacattgctgacctttggccgatcaattggggtctcgatcactctcactgtgcctatatatgcatgtgggcattctggcaaatagcttttggatgaagctagtggacctaccatcatatatactgggtgataccccgcgcttttctgcgggatttatggatgagtatatgttaaatattgtcgaaatgatgaaagttaaaatattaagaaaataatacgaggaacatgatttgacacatacatgtcgatctctataatataataaaataggctagaatagtaattgctagtgagtgaagatgtgacatacttgcataggattttaaattaatgagctaaaatagtaattgctagtgggtgatgatgtgacatacttgcatgttgagctttagcttgtaataattgttagtgggtactatgtagaaagtatatatatgcacagtatgagaacatatactccatccgtcctgcacagactccagttttgggtttctatatctaacgtttgaccatctctatttttttaaaaaaaataaaaaaatagttacacataaaatactatttatgttttatcatctaattacaatgaaaataataattatagataagacgaaaaatcaaacgttatattaaaaactaaaaaaatggagtttgtgagacggagggagtatatctcaaacacgttgttccattttagaccacgtacagaggggatcattgagacaatgtaacgttctgaaagtgctgacactgcttttacacaacaaaatgcgcatgttgaggtaacttttaaattctgagaaacgagtggtaggaatcttgagaagctaagaaaattagcttatggtattactttattttctttctagattctacatctactttttaaattttcgatcaaagttatggtttggaaagcttcagattttagaataatccgtaactgtcagaaactcccaaatagactcaatatatcatttgagcttcacgtaaaatgactaacctgattatatatggccttggggttttatatctctctgaaccttaatcagctagctataggtgtcttcaaccataatttgctattcagcttaattatcatccgtagctaaaatttaaatgttaatttaaattttattttaaagttgattgtgatgttttttaccatagtttattcaacgtatattggttttttaagttgctaagagcacatatataaaagttttactcataaattattttttaagccgctaataagtgttatggcttataatcaatcatctttagacaaaaatgatgggagtgcatccttccttagaatcggttccgatttttatatatctttacatagatattgcgtgtacaataaatttcccattttatgtaattcagaaatatatttttatttttggattaatatgtctgaaattcaaaagtcatatttaccaagttgtatgtggaacaaaatcttaaaaatttactgtttatatgttaaaaattcccaaagtctgaatttccaaatatcaactactagtaatttgcaatagatttaaaaaataactagctaataattatgttattgtgggaatgagctcatacaaatcgaattgctaattcattttttgttgttccatgttttatttgtttatcacggtaattggacttatagcatattctttaattaaatcccaaatttaaaaaattgatagaatagattaatatatgatatatcgatcactacacaaatatgcaagtttgaaattgacttctaggagctgaaaaaaatataattgtgaccacacgtatacttaggaagattgaatttaaacttgtatattcgtgatatataatatatcaatctatcttactatttttataaaaaaaatcataactattggatggtatgcaataactaggggacatatcctcacgagggattaaaaatccatttcccaagagtgcccaagtttttaccttttccgttttgtttttttaatgtaaacctgttgtaaatatcccaatgcttacactgctgaagaatgcctcatcagtcccggtttgtaaccccttttagttccgggttatgcgtatgcgtattctcgaaactcaggtgaatggttgaagctttttttttctacttttctggttaacacacaaattttgtatgtagtaagagttatatatagttggacagataaattgcttacggtaagaaatgcctagagaaattaagtctgcgtttaaatccacgggtgtaaaattttagcgtatcatatcaaatatacggacacacatttgaagtattaaacgtagtctaataacaaaacaaattacagaatccgcatgtaaaccacaagatgaatttattaagcctaattaatccgtcattagcaaatgtttattgtagcaccacgttgtcaaatcatggcgcaattagacttaaaagattcgtctcgcaatttacacgcaatctgccatttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccgggccgatccccagctgacgtggcagctacctcagcgccaacaggactggcgctgaggtgggacttggccgcaacccccaaggcccagaccagcaaggcttctggatggcttgcgggtttggacctcagcgccagccataatggcgctgaccgtgggacactcagcgccagcccacaaggcccagaccagcaagcctgctggatggcttgcgggctgggacctcagcgccagccataatggcgctgaccgtgggacactcagcgccagtccacctggcgctgaggtgggccttggccgtttcgagccttctggatggcttgcgggctgggacctcagcgccatccataatggcgctgactgtgggaaactcagcgccagcccacctggcgctgaggttggacttggccgtttcggccgtggcccagcccagcaagccttctggacacaacacaggccatttagacatgtcagcgctgagtttggacatgtcagcgccatttagcatggcgctgacgtcccagccctgctaaactttagcaaaactttgcacacaacacaggcaaacatcaaatcacagaaatttacaggcagtaatatatccagagaaccatacaaaacatacatccatccatcaatcccaacatcattccatacatccatagaatccatcaatacatccatatatgaagtccatatatataagaaataaaaacatcccatcgatcctcgtctatacatccagtcgagtccatacatccagtccatacatccatcgaaccatgcatcaagtccatccacccatccattgaccaatgcactcacttcctcctacctttagtgcgaggacaaggcacgtcgggggtgtacctccagtcttggaaagaggcccgccggcgtcgtggtcaagacgggccgggctgcgagatatccggctgtgacgactctggtgcgtcctctagctgcgagggaccgagctcatccgcctccttttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagcaatgtaccttggtatttaccggttaagaaagtgccatcaattgctagcaccggcctcaagtgcttgaatgcttctatggactggccaaatatccaatatgcatgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccgatagtgccatatttgctcaactgcctcgacaatcgctgctggagataaagttggttcagctcgcacaaatgcatgtaacctgtttccaataaaccttgaagtaagttgcaaatgcttgccggttacttccgcactacatcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatattttcagatcatccatcaatcgaaactccaaccccttccttggttcatcacacattggttcgaaggcaccgtcatattgtggatccccatcagcaattgctagcccagatctggtaagatcctcgaattgtgttatttccggatttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcntacctcccgaccatcctcaacatctccttcctctcttaccggcacattctcctccacattaacttcctcccttaacggcacattgtcctctgcatgtacttcttcccttaacggcacattctcctctgcatgtacttcctcccttaccgggtcattctcttccctgacctccacatccgccatatcatttactccctcgcccccctccacgtcttcctcaatcaattcttccttcctactacacctctccgacagttcgtgacagctaatgggtgattctatgagtgaactttcattaaggtctacaagttctttctttcctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttatcttctcttccgatcccaaactcaatgccgcacaaatcaccttcgattagagaggtttttgggggagattgggcgaggagaacgcggtggcgaccgaaccctaggcgggcggctggggaaaaaacggaggaataactggctggggcggcctcggccgggctctaagtagccaaggtcagcgccaacttacttggcgctgaggttgggcacctcagcgccgaagcggttggcgctgagttagctgccacgtcagctaggggatcggcccggccaccacggtggcacaatgtcagcgccagtcccgttggcgctgacacggccaacctcagcgccaatgcgcttggcgctgagccgacggcctagttttggttgaagtttttggcaggggttagtttcgaattaagtttttgaaaagggtcaatttgtcaaaaaaacggcgcaatctgtgtaattagttattttttcgtctatatttaatactccgtatatgtgtctaaatatttgatgtgataggatgtaaaattttaccaaggaatctaaacacggcctaagttagtcatatccatgggtggtttgcatgggagaagtcagtgccttttaaattagacacagtgagaccaagcagtagtacgtacaggttggagctagctatacagacatacaacagtctttcttgctagctttaaggtgtggccgtgtcattgtcactgattcatgtgatgctgttgacagaaagagaaagcatcctacatacagacagatcgatcgatcgatcgataaccagatcaactgacttgctagaaagtgaaagtaaatcatctcatcgatcgatcagaaagtggcttacatcagagatagcaagtgaaaaggagctcactcactcccaaagtccccagtctcctagctatatatatctctacactcaagcacactgtcggaagctcaggtagcacagagagagacgaccgatcgatcgatcagctagctgcagcttccagaaagagtagttagctcgatcgatcgatccgggaaggatcagagttaattagtgagtgaggaattgtagccatgggccggccgccgtgctgcgacaaggaggggatcaagaaggggccatggacgcccgaggaggacatcatcctcgtctcctacatccaagaacacggccccggcaactggagatcggttcccatcaacactggtacgtcctaattccccaattctgtgtagtttcttactttcttttgtagatgaactatagctagccaagtagccatggtgatcgatgatgaactgagaagaagctgaagctgtgggtggatggatggatgcagggctgatgaggtgcagcaagagctgcaggctgcggtggacgaactacctgcggccggggataaagcgcggcaacttcacggcgcacgaggaggggatcatcgtccacctccagtcgcttctcggcaaccgctgggccgccatcgcctcctacctcccccagcgcaccgacaacgacatcaagaactactggaacacccacctcaagaagaagctcgccgccgccgccaactccacttcatcctccaaccgccaccccatcttcgccgacgccaccttcccctccgccgccggcggtagctacacggtgagcagcaactccgatgtcacccagatggcagccattgctaggcgctcccccttcgccgactgcccatcctcctcatacgcctccagcatggacaacatctccaagctgctcgacggcttcatgaagaccaactccccgtcgccgccgccgccaccgctgcagcactatgacagcggctattacgacgacgtcaagcccgccgtcgatgtcggcggcaaccccttgctgtcgtccttcgactgcatgtccggcgccgacctggactgctgcttcgacgttcatcagcagcaccagcagcagcagccggcgtcgttcatggagtacggcggctatggcggcggctacggcgacgagagcaagcagcagctgatgaaccaggcagcgccgccgctgtcatcgatcgagaagtggctgttcgacgaggcggcggcggagcaggtcgccgacctcatggacctctccgacggttgctgctccgtcccaatgatgttttaattagctcaagtaatgaaagaaaacactgtcacattcgatacgtatactgtgcacatcaataattaattttacattaattagctagatgcatgtctaggttaaactattgttgttactatacttgaagctagaagatttgttttatttgtagttttggatgtgtgaccggttgtacgtgtgtcactggcatcaaacgtcagcacaagaataagagatatcaacaggaattaacaggtgtgattatatatgtaagcatgatgtaactcatcaagattatttcttattcattttttcgaatgaattcataaaattatttccacagagtgtctccagtagccaacctatcatgcacaaagagctggaatattggaatataatatcgttgtcaaaatccctatccaatccattattgttagactcctgtttggattaaagaggtctttaaaatgacaatcttatcttcctttcctaattcttaatttctagtttccacaatttcagcaatgttagatggtaattggactactctcataatgtataaagttcactttagaggtttaattaagactcacgtttatgtctgcattgtggctgccctaaggaagtgccagaaggtaccatattttctaatgtaaaatttgatatctcttatatttctggtatcaagagatacgaaaatttgcgttaaaaaattttggtgcctcttaagattataaaatttctctactaacaaagtaataagtgctccttcttgtctcaaaacaaaattattttgaatgtttttaaagtcaacattatacaaatatggctatctagttctttagcagaaattttacaaaattacatgtgtaatactaaaaaagatattgtaaatatgattttttatggtcaaagttaactcgtgttgagtgcacaccttttaaaacgactgtgagaccagagggaaatggtgaaagttccagtttattttttgttcctgaatggagtgggctggtgcaatgatttatgaaacagtttcttcgtcctcttatgtacttgccgtatgcccatatgaatgcagatactatactattcttacaaagcagctgcggagagaagaagcttaaacagactccttacctgtcggcaactgtgttggtcccccgatcacattcagtgcaaacgaaatcagctcccaacttttttttcttgccctgttctcattcattgagtgcaaagataaacagtgccctaatctttcgtttaatgccggacctaccctgcaaattacaccaatgttagggcaattggacaggtcaggtccctctctatgagtatatttttgcaaatagctaggcttcagaaacttgtgtgttgatggtgcatagctactctaggtagtcatcagcatcacagcaaatgcagcgttagcttgttaaacatcaactaaaactcatagatggtactgcactactgagaatagtggtcgatgtccagcaaattgagtgattatacctgattatgacatggcctgtgtcgtgtctctctctgttacacgtcccttttatgctaacctgcagaatcctctgcttctgcctagtgaacctgcttcagtgtacaaattacaaactccagatcgcctattaaattgtacgtaagacgagaggaaaacctggcattgcatgaacaattaagctgatgaagtctcaacctgtcctagcctggctcggtgatattctcaactgcctgacgccaatcagctacttcctccgtttcacaatataagtcattctagcatttctcatattcatattgatgttatctagatttattaacatcaatatgaatatgggaaatgctagaatgacttacattgtaaaacagagggagtagctttgtacagcagctatgtgcttttttgtgttccagccccagatcaggcaggctttggaccagcggggtgaggccgaccaggttacatttttcctggcccaaccacatccaaccatgctggcattgctgccatagtgccatggtccataagaagcacatttgataccttcatggagttcttcaacaaatgcaggactccaatccttcagtcctgccaagaaaggaaagcattatgatcaaccataccggttcagaaagaaaaatactctcaagatctccagatgttcaagtgattcaagtctactaattcaaaacatctggaattctggaagtaactaaattttgttgcatagtttgtatagagttgatcgaaggcttggccataattactgtatgttcaaatcaccctgtaaaatgatctctccagaaaaagaaagtaatgcttaaatgcttaatagtagaaattagaaaaaggaaaggaactgcaattcttgacaacatggtattgagtggaagtatacatctcagtcttcatgtatccatcagagtagatacgggaccaaggcagtacaaatatagctcacgtgtaattaagagttgccaagggagtgtgccatgacaaccaaccggcagctaccataagtatgagaggtctatctgtgtaacctcgggggagtacatagacaagctcaattcattcttccaggaagcatcctgtagcacaacagtaaccaggaaaatgtaagcattagccttgtcaaattaagaacaattgacacatcatatgcattttgtgacagaaagtaaaaccgacgttcagttctgaaagtggaggtagtgctactggtgtatgaacaaaatccattccaaaaagataaagatcagtggtagtcaacagccaatagcatggcagtctaactgcaaaactatacctcaaagtagttcatcgacactaacagcaaaaggagtcttaatgtgtagagaactagttcttgacaagtccaagtgcacattctgtaactacttcgtcaattagcaggcataagttgccatcgtatttctgtcagaataatggcacatacttgaagtagaattctgttgacaccgatttgaccccagctataggtatcctgatgagtatgtatacacagcatatgaaagggactcatacaatgtgtaagaatagtgttgttatcaggtatttaattcatctttaataggcaggtgttgtaaaaaagatcaaggacccaaatattttcatgcatcaatattttaatcaagaaagaatctcaggtaactcaggaatggcttccaatccagattttgtaaaaaatggatttatatgacaaggtaaaatctatgctaaacctgacaacacaaaagtgagcatgggttaacttatctttacatctccaaaccttgctagaaaatcaagtaaatggtgactagcaaactcctagcattttttttataaccacacaatggcacaaaaacttaccacgttacaatgtaaaaccaaatcaagatgtgtagctgtggatgaaatagtcggctagtttataatagttactcaagacattagaatcaccttcttaattactcaagaaaatattcactctgctaatagttccactactttactagtcaaaataactctgagtaaaaaaaaatcagccacagatttttgtacgtaggaagacagttttaattcagtgtctaattgagagggggggggtctgtacagagcaaacattgcaccaggacttgattcaagactaaatagattatattgccaatttaaagagcatggtattgtaagttgttgtgtgtgctgtgtggttgttcagctgaccgcaggtagttgtttttcttttccttgtaacccgtctgagtttttacttctacttattgaaacacaattggtaattcttattccggtttagtttaaaaaataagtagatacattttgccagaaaagtgtaaaatggtaccattgtactaattttccattccgtggggatggttagtaaaaactactccactaagtaacaccacctaaatgcttgaccccactttccattgtcgaaaccattaaatttgcaacaaggagagatataaccatgacctatgagaaattgatggggcatttgcaaatttgccaccggttttttcaattttgcaaggatgccactcgaatgacagttccagtggcatttttgtaattttctagtggcagttttgcaataacaattcaaagcagtggtaaatttgcaattgccccgaaattgaaagaacaaaaaataattgttcatgaacttttccagaagatctatccattcaaaaatgaaaatataaccaactttgtgaattatatagtatagtacgtacagtatagatatagtttcagagaaaaacactaagtggtatggaatatacattacaagataataatgtcggctcagcctattattcataacatcgttgcagcaaggacacctttaggcagttcttcagtttgttcatatattagttcacatgaaaggacaaacctacagcataatcatcacaaagagtgagtagcttacctcccaactactaaccaaactagcaccacaaggaccacctcagcaagccaattcttttgctattgagcatgactgcctgaacaccctagctaatgccttcagtaaagacttacaatcctgtt

SEQ ID NO: 17449 - DNA, 12758 bp, Oryza sativa
aaagtggttgaacttttggtggctgacatcaaagaagaagtttcgatctggagagcggccggtatttttgatagcgaggagtagcaacttggtctctagctccctgtaaatagttttgtttttcttctgtttcggggtcttccccgactcggcagtttaatgtcgtgtatacctatataactctcttttatcttaatgaaatttggttggcgtccttccgccaacccggcaaaagagtttggccagctggagccagtattccatccatccagcgatgaacaatggattgtgcaaattttgccacccttcgcaccacattctcaagtgtctttaagaaaataacaagaaatcaataacctgtaaacccaattgtttttttttctctcgaaaccatcaactccaaaatagatttgttaaaaataaaagacttagcttcaaggagacaaatcataagagattaagaaaaaggttaaggccattttacaagtaactaaaagagattaattaagagcatctgcataaaaggacaaattggaattttctaactcaatagaaggccatttcaaccaacataagaaaatttactgccagggaatcttgaccaatcagttgtgattttcgattggtttattatcagttaatagggatttgacttctactgttgactactagatgaattccatgaacacttttgataagacttcgcgtaaaacaagtaacgagcatcatgctcttagatctgagtggaagttgttgcatcatcagcgtagtggttcttgaagctcaagagaaccaatgatgtatgttttctaaagaaaatgatgtgcagttgtaaatatagaataacaaatgctgttacgagcatgcctacttttagtagccttgtgcctcgtcaatcagaatttaaagggaaacatcacactaattattccagtcacatagaattagcataggaccactaattggttgcaagtcgtacaggaatataactctgaaatttgagcaattattttgtggtttggcgattgagaacgacctacttaacctacaggagaacatcaggttcagaccacataaacaacactagcaaggtatggataaacctagttgaaagtggcttttccgattgatggaaactaaacacacatacaaagcactgatttgaattaaccgttaccaatcaaagtgatgatatgtgatagcaaccgtatatgtatatggtaccctttcctacagaaaggactcataccagctgagggattacattgttagatgtcatgtcattttcaaaacttgaacttgtccttgttgcatcaaattcagttaaaaggttagtcaacatacccttatccttgatcagtggactaggtcattttggaacaagcacatgaacttatgagctataaatggggaacatcatagcaatttccgcgaattatatgggcgaatttggttcagggaatgacggaacttttggagaaaggatggtttctccttttcttttctgaaagttgaagggaatttatcttgacgccctgtatatatatctagaacgctcggtaaaatttgtgttactgacctactgacgtgcaacgcaacagaaaagtttatttataaaagagatagaaataataaatggaggatgttgagtggctaccggcaaagtttcctgcgatgctggcgcgatcaagcttggtcgatggcgccggcgaggctgcggatgaccggatgggcagccggcggcggtctcctctcttttctcttccatcccaaggagcagcagcgaagctggagagagaaaaaggacaaaatgggccaagaaatctgctctgcaataccgcctggtgagtagtgacaaggcccatagaagcacacttcacggcccatttcatagaccaacagacaagtcaggcatgcactcacaggcaaatccctatttgctctgctgggagaatacaaaatctgatgattttgtccccagctgagctcaccaagtttatctttacccatactttggcaaaaaaagacgttccctgacctatttccagtttatcacaactctagctcacagctatgcatttagctatctgatatacaacaacagacaaacctaaaacagtgtgatcagacttgtaaccagctacctaagggcctgtttgggggagcttctagctgctgcagcttctctcagaatcagaagctccctcaaacagtccagcttttggtccagattctaaaaagttgtagttgtagaatccagaaaatgaactagaagctggaaaatccagcttttccaaattctcagaagctggctaccataccaatcagttgcttcttagaatcttaaactccccaaacaagccctaaaacatgttcacaaacatggaacagcaaacaaggtatcttgatactagaaattttacatgatgagctgaaatggaggaacagaacgtagcaaacagcatgcctgagtaagaatgtaatattgtaagaaccaagaatgtagaatagaatttcccctactacctataacatcaaacagcaagccattttagggactatgaccaaatttcagaaaggtaggaattgtagttcaatttccttttatccaaagagattggcccaagccttgtcgaactgtaagagaactcacagaaaaccaaggtcttcatagtcacaaaccttactcaactgaacatcttcacacagaaaaagaaaaacagttagttctttaacaaagtcacaattttattgacttgatccagatctacaagactacgatagaaacttcaacattggcagggagcaaaccacaaagagaaaagggcaacttttccatttggattattagaattgaatatctgctaaattttatttcttctattcatcttagccctgtgaggctgtgaagttgtagacctgtagtaattgattgagaaatgtcatgtaatcacgttggttcgaaaaactgaagttggcctcctatcaatgtctggactggaatcccttctgattaataacaaaattagaaggaattggctataccctttgggctggaaatcactataaaatatctgtcacaaaaggatttgttctgaaacagtatcttgttcttattgcatgaacaatgaaacgcaacagcaatggaccagtgcattgaataaatgaagtttttatttagagtgataaatgaccaggatgcaggttgctagattagctaatctctagctgaattttatcaagcaaaagaacaatatagcagatcccattgtatttgggaagaatcccaaccttatcttcaaggaagctaccgcacttattacatagttcacttcactcaatagagagaaaccaggaaatgaaataactaataaccccagcacataaagcagatcccgttgtatgtcaatcaattaatcgagattacgaaagcatcacaacacacaatggttaggaaatagtataatgcatattcaaagtttacactttacagacatctacctgaccaagataaggatgcatattctaggtttgcagtcatctactgtgactaagaaaacgaaatgcaacaataggtctgaagttatgatgactgcacaaaaaataacaaggaagacacttatcagttacactaaaaatatcaagtaactgcaatggtacaagattgattacaacactaccctacaatagaaactgcaagcttatgggaatacaaatacaagcatcgattccatctatctagtatgaaaatcagcaagcaaatataccttgccccttgtgtgttagaatcaggtttccatctgaatctattgatctatcatttgctaataatggagcagttacactcagcaaacaatcttcccttcagtaacacataaaacacagccgttgaacaagtaaactctgaaaatcaagcaatttttgccaggctgctatccctaactgagtgaagatcatgtggggtgatgaggaaaatagaacatgccatgtaccaccagatcgatctaccactccaccagccctcaagctcctttattttagagtgtttaatcaaggaatcaagcctcaagctcccatcttcatgggaactgaaagaatcattagcgctagacaagcacatgtcatcatagcttctctgttaaccgaatcatgaaagagctgacagcaacaacatcgagaacaatccatgatgactcaaacatgtcatggaaatagtctgcaccaatctcctcggcagctgacctaaatgcattaccaaatgcattccccttaacagcccccagccttggcttcccacatacccccacaacaagcactttctcaggctcccttgctaagcaagcgcagataagtggcttcatccttgctcctcgctctctcagtgcgtccattaggaaaaagcagaatttggtaagagcctgaggttggcataacttatctgtatccactggatcatcaagcttcacccaccgaaacttctttgcactccgaatgaacccggtcttggtaatcgctgagcttccttgcctcagtattgccctctgtatctcaattgcagactgcatccctttccgcagctgatcgacattgctcagcgacaatgcagagtatgcaacccagaattgctcagcagcagaagaccccttggagtccttggactcagcattcagtgattcaagcaaagctgtgacgccataaacaacatctgcagcagaaaccttggagcggtacccatgcaccctcaagaaactccgataatagaactcggtgagcccatactcaggcaagaaccgatcaaactcatcacgcatcttccgcttgacctccatgctcatgtactggaacctcttctggcagtcggcgagcgggaatcccatccttgccagaagcagcttcagcttcttgaggccattgtcgctccaggtcttgagcttcgtcgcgacatacgacgagcagagcatggagtcgaacagactccactcccggagcagcatcagccgcggctcgtcttcataggcgatgcgtgaggcctccggcgcccggatcttggtgccatccttgagcgtcaccaccgcgcccacgccagatggatcgagattgccagatccattgatgtgctgctcgagctccatgacggcggcctggtagcgctcgttggtgatgcgctcgtggacgaactggtcggtgagggagacgcaggcgaaccagaggagctcgttggtgttcttccgcagcgcgtgggcgagctcgtacatgaggcaccccgacggcttcccgtggaaggtgccgagccggtagtactccctcctcagcttcccgaacagcctctccgggtcgccatccgcctccgcatcgtcggagagccgccgcctcttcctcctcccaccctcgccgtcggaatccgagtcggaagcatcggaatcttcgtcctcctcggcgacgcggaggtggtcgtcggcctccccctgagcggagaggtcggaggcatcggctagggaggagacgtcgaagtcgtaggagagatcggcggtgtgctcgtcgtcagtggtgaagagcacgacgacgcggtcgttggccgccgaaaggttgtggaggtggatggggcggtgcgaatccacgacgaacgcggtggcggcggggggcagcacggcgcggaggtcgcggtgggcgccccagttgatgaggaggaggcagagcggctgggatgcggagaaggaggcgaggagggaggcggcggcggcggcggacgcgacggggtagatggagaagcggatggagtcggcggagaggacgtgggtgagcaccttgagcgcgcagagggcgtcggcgtcggcggcggaggggaggatcaggagcggcgaggatgcgtcggcggcggacgcggcggcggcggcgtggaggcgcgcgtagaaggagtcgaggcggagctctcgcaccattggcgcatcaatcgaagtggtgaattggaggattggggatctgggaggaatgggttggaatttggagatggagaaggggacgaagaagaagaggatgaaatggggaaattgaattgaagggatttgggttggagaggggcagcgcggggaggaattcggaaattttgggtttgggagggaaaccactcgatcgaaatttggggatctcacgattcgaacccccgcgaagtttcagtgactgacatatggagccgattgctcgtaggccgtcttagaagaattgctcttgggccgcacgtaaaccgcatctccgttccggtccaattaacatgggccgcacgtaagtcgctgcgccgttccggcccagttccgcctgcgttggtccggcggatcgtcacctgcgtcgtaggcctgcacttgttcccccaacgtcgccgcgtgctggtccatccgtcctccctcctcccgcgccacaccgccgctccgcatacccacttggccggccactccgccgccaacgccggcgcggaaggggttagagcatctccaacagagtggccatttcactatctaagttaaattttggtaattttaagtaaaaaaacgggctctaacagacttgctaaacggctgaccatgccatatggctggctaaactcctccctacgctggccaactgtggccagccagagttgccttgcaaaatcgtgggccccacgcattttttcccatctcctctcatattctctctccgcagtcgcaagcgcgccgctggcgccagcgccatccctgctgtcgtccgccgtcatccctaccgctgtccgatgccaccaccgcaatccctaccgccgctccccttctccttttgcatcggcctcagaggatttggtggtgctgctgctccgccgttcgtcgtcactcacagcggcgccgccggtcctccggtccgccgctccgctctctccggtctccgccgcccgcgctgctcccgccggccttcaccgccccgcctctcccgccggcgtccatcgcctccaccgccccgtcgtttccatcggcctctgccactcgcgccgctgccgccggcgtccatcgtctccacccccgcgccattgcaatgcagagaagagaggagaagacgagagagaagtggatgaaaaagatcacaaataaaaagtgtgactgacatatgggacccactgttaaattggagatttgaatggagagactgttggagtgaaattcaaatttggctctctaaatttttggcaatttgctaaataggacatttggagaggcaaaaatagccatgttgttagagatgctcttaggatgagagaaagaggagagccccgccgctgctcttcgtggtcgtcccggcgccctgctgcgcttgcaccgaaaaaaagaaagggagagacagattagtagagagaagggatggcatgcgcgttccattttattttttttaaaatttattttatgactggactatcacgtagttctcgcgtcaacgtaaaccgctcttaaaacatttgagagagtttgttttggactgttttacttgttttgcaattaaggaatataaattagatccatccactagttaacggagttaaagtgaactttttctatggctgaatggccaaggattatctgcatgtaggcccagtaagtgatgagatcaaatactactagctttgcatgttgtatgtgcatgagttgattcgaaaattacaaatattatctatatctacatacctgaatatatgcacaaaccagtcatgcatgttcaaagtctgagacattagttgattggatatatatgttgagctgcaatcaaaactgttgctattgctagctccaagatgtttttggcatacctgcatgccgcctcctattagttggtacgaatgggcccaagctaagctagcaggagtagcgctgaatccaagattgtagctctagtttcacacgctaggtcctcctcgtaaaattggatggaactatggaactcatgtgagttgtgtgagctttaggtttggagccacatcatccgagagaacgatttaccccttctatttacatgctgaacggactatgcttaaattaattatagtgaagagtaaattgcacttgcagtaaattaacctgtcaggttcctatcttgaatgtatatatagtcttagtagttaattgttctcacatattgtccttgtccatattcatatctaaaaatacactcttaaagaaaggatgttgtagatgaaaaaaatactagatagacacacatcaattcaataaaaaaagtatagtataagacataataataatcgtaaacaaaaagatatgaaaaaccaaaacaaaatgatgcaaggagtagaaacatagaaagagaaaatagagactaagatttcaaatataacatgtctcatgcatgccacctcaagtcctaatcaacgacaacttagtaaaattagcctttcggtgtcattttaactttggttcacacgcgtcaaacaagttcatatatcaaatgagtgttttacaagttcatatatactaacttttaactaatataatttagagatgatgtttttccccgaatcatgtcaattagagatggatgcttcattacttcataagcatggatcaatataatatcatgatgatattgtgtaaagtacaccaatttttgcatggtttcgtaaataattgtggtctcaatcactataaaaagatgatttttcatagcatcaccctataattttcgttggcggctatacgcgaaaaccgccaacaaaaacgtaacgaggggtggagcctatggactgacaacgaaaactggccgcgctaaaagatctgccataaaaaactctatttttcgacgcgaaacttcttaagtgtccgccaacgaaaatcacgttttcgctggcagtagataaagaggaccgctggaaaaaaaatccaccgcgcacctcaccgcccaccaaacgccaaataaaatccctctctccgcctctctccattctccctcgcatctctccttctccctcccatctccaccaccgccggctaccatcgccaccccacccacccccagtaccgccgccatcatgccttgggagcggcgcagggaaggggggtgccgtctctcgtcatcagcggcgcgcgggagggggcggcgggagcggatccggcacctcctcctctctccccaccgacggtggcggcaaagaggagggatggcggctcgcgcaggcagcagcgatgcttgggagaggcgaatctggcgccgacatgcctcaagagggtggattaggcaccggtgggcctccagagggcggatccgccgccgccaggcctcgagagcggcgtggggaaggaggaggcggcgggagtggatctggcgtctcctcctccctccccaccggcggcggcagcaaataggagggatggcggctcgcgcaggcggcggcgatgctcgggggaggtggatccaacgccaatggtgcttgagtccaaccatgacaacctcgagtgcgacgatgctggtggcgggtttgcttgggccaacgatggccagcggatttttgtgatgatgatatcttgttaatatgttatgttgctgttaatatgttgatatttgtgatgctctgtatttggattgtgcttgaatgatgttcatgtccattttcaatttttttttggcaacttcctggatgagatggtagaaagggattctggggatttattttttttcctgaaaatcattttcactagcttttggcataatcttgctgactgcagaagtttatttttgctgggagttcacttaatcttgctgccaacgaaaatagattattttcacttacctacgttgacggttagcctagccgctagaaaaagcatattttagcagtcaggaaaaaccatttttttcccgtagtgattatgcctgcatcaaaactcaactattaaaagccatacatgcagctaaagcatcggcacgcatgaagcacgcgcagttcaccatccatatatatccttttaaataataagtttgcagctgacatgtcaatttaaatggccgcgctctgcagctgtactgtacttatctcgctcgtgcgtgcacaccaactacactgtaactttctgtacgtgatggatagatatcagccccgtttagttcctaaatttttttcccaaaaacaatcttttaagcctaatttgtctcgcggtttccaggcgagttataaaattagtctttttatttgcgtctaaaaatcttttttaacatccggtcaaacgttctatgtgaaacaaaaattttcatttcaccaactaaagacctgatatactcttatcctgcgtacgacaggtcgacagctttcctagctatccgcctgacgccactatctgactatctccaatactcctcattcacaaaaaaaatgtggactctttagttagctacccgcgactgatcagctcaacagcatgatgtgcatgaattttgctgttgcctgcatgcctacgtgtcgtgcatatgcatgcttcaaattaaagggagcatgtataatataattgccaacaattaaaagagattctaaagagcttacaaattattggacactcgatccttattagctagtactatataagttgcaattagcatgcatgttcttgcttatgaaggtgtgaattgtctttatttaggcctatatgtactgccttatttctcaaattaatggatgatgttttgaatatcgacatgcatgatccttaatgcacatctttaatttattattattattttaagctagacatttataaaaacttatataaaactataactatagaatttgtttgtaaaaaatctcctaggataacattcagactttaaaattccactatttttgtattaatggtttaaggtttagatcaggcttgactacacatattctagattctaggatatcatcattttaagacggagatagtatcaaataaaagaggagtatacatattttaaatatttcaaatctatttaatatttaaaccaaacgtatatgcgtagaccaggttcctaaagtgtttttagtaatatgctagaatttagtggtaaacaacacagtgactagatgaaataaagaaaacgtggtgcccctatctcacataagtatggtcgtgtttagatctaaagtttttcttcaaactttcaacttttccatcacatcaaaacttttctacacatacaaacttccaacttttctgtcacatcgtttcaatttcaaccaaacttctaattttggtgtgaactaaacacagcctatagagagagtttgcttgtatattcaacttccactgcatgtcaattatatatgcacgaagcctagaatggataggatagagaatatacattaagttgactcaatgactccaaacttatccatttcaataaaaatccaatattaaacgctattccatgcatgctcataaaagtagaccaaccaaagcagcaagacgccatcagggtttcccaaactgccgggaccggggttaccacgcggtaaccgtgaaaaactgtacaaaaccgtataaaatttattaaaaattcaaattattttttaaatttatttaaatttaaggaggttaccgcggtatttatattaccgtacccccgcggtaagcccggtaaccgcggtaaccagcggtaagggaaaccctggtcgccatcaccggccacaaaaacatataataaaactaacaatagttgtctgcgcaatgcatggcctttcttctatttttgtttctttttttttctaaattcacttaattctggatggttaagattgctacaggatccattcaaaatttctccatgttttcccattgtatgtcttcatgaggtatttctctattgttgtatttattctacttgctcagttttgataagccattttcattcccatctgtaatggattggttccatgagatccgagatgctaccacttcactcccacttccccatagccatggctaggccccaccaccccctccaaatctctctttccttgttaataacttatcctcttcctccgattctcaccctacagtacactcttccaccccacccatccttattggaatgatctaataaactaggggtgcttgttgcatccgccatcaaatatatcctcccacattatctctcttccttaatcaccagacttgctttggttggaggttaaaaaatggagacaattcaagaaatgccattttgacaagcattcaaattcaaaaaaataccatcgacgagtgtgagttccaaaaaatttcagagtacaaacgactttatcccaaaaatgtcatcgccgttagggttccgtctatcccgcgccattaagtgctataggatgaataatgtatttaacggcacggaatggacggagccctaacgacgatggtatttttgggacaaaatgattttggacgatgtcatttcttgaaactcacacttatcgatgatattttttggatttggacatttgtcaatggcctttcttgaattatctctaaaaatgtggaggttcgatcttgaatcaaccgatgtacatatgtagtacaactaagaagaataaaagataaactaaatgaaataaatattttattagggagcgccaaaaagtagttgcatagatatatatcaagagatagactcatataatgcacaaaaaccaaaatgtgatatccaaatcacattgcatatgcatcaaaaagctgccaacgacccaatcatacactgggacacatgca

SEQ ID NO: 17450 - DNA, 3635 bp, Oryza sativa
cataaattaaagttttgttttgatagatggatgttggccaaagaacaagtcacatggacttcgcccgtgcttgctcactcacctaaaaatggacctgacctttttggagggtcaagtatagtaggtgaagaatatatgggcatgtgtatatatatactttgttaattagttagctgagaagaagaaaaatgagaaatacaccaactttgtaataagtacagtaagttaaagaaaattaaatatagttgcatgaccatgtaatccagttgatcactactcatgggtataattaaatttatccttaatcaaagtcaaaaaaattatccttaatccactcgatctgaaaagcatatataagagaaaatcctctgaaaagtatcaacaaacattatggtttcggcagtgacagtcagatacagagatgacagctctgaaaatgatgcaaaaattgacatttgacaactaaatctcttgcatgctccagaatagacagtacactgaatagatttaatctgaagcagctaaattgtatacctaaactctgaagaattgactagtaaacagtacctctcaatcttctagagcctatacaccaaactagaggccagcttcctttctgcatgttgattttttgattccttgttttttagtacacaatatttcttttcatgaagacaaacgattttatttacccatgatgcaggaacctagtctctgttgtagtgttattgccattagcctagctttattttaacactcaagctatgctaggtaatcactttaacgacagaaacaacaaaaaggagttgatgtttaaacggctaacagttgacctgcagacttagagtatatatatagctctaatacttttcaggcatgaagatccaaatgatgaaccctcacacatgctagtgacaaaataacatactataataaccgcacccacaccttaattttttcttttagtaaaatgaaagccatcaagtaaatttgtgctacggcagctcagaagtcagaagaagagaacaacagtgtactaagcagatgataaccaccaagaaagtaccaactgctgcaaaaatctgttcccagcatatgaaagttaagtgacaattaattcagatatacaactactaatagtcaaacagaaaagcacagttattttagagaatataattaagatgttcatctgaatataatctgtacatggacacagcagttacatgaacgcttcttatgcgtatgctttttaacatatattatgttacattacacaccatcgattcaccaaaaatcaaaatatgaaagaaaaaaaggaagagaactttttaatcggttcatacacaatcagattcattcatccaccgaatcctttgaatgccaaatcgccaataccaccttacctactgatgatgctgatctactcgcacgacgaggccgaatcaaatccacggcgatcaccggcggccggtgccggaggaggtgtcggaggagcagtcgcattcggccgcggcggcctccacctctcgcctgtggaagctctggtggcagccgcaggcggcgcagaggagcgcggcggcggtgccatcggcgcccgacgccatgaactcccggcagccgtcgacggcgtggccgccgatgctggcggcgtggttgcgctggcactccctgtaccgcaccaccttgttgttctccttcctccccgccgccgccgccgccgccgtgctgccgttcgcgtacggcttggccgccgaccggtcttgctgaggccccatcgatgatcggtcacagatcacacctcgccgccggcgagcgtcgacgacgttaggtggcgaggaggagaaagggaggaagaagagaggaatggaaaagctttggtatcacggctttggatggtacgtacttatatggaggagaggagatgagcaaaagtttatctttttctttttttccttttttttttgttgagaggaagtttctcttttttattttgtcttgttaattactttacatgtactttgctttcttgatctcaaatatattactagggcgtgtactcttttgcttgtttatgcatattgttcacttgcaaacaatttaccttttttgttaaacaagtcatgcacatgagcgaaagagtatttggtctagtggtttgcagcgacctagtatcccaaagttctgagtttctatctctatagaagtgaattttagattgggttatctgagggactaaattcttgacttaaaatgttgtatatatccggttggatatagagacgtgataaaaaaaataccattcttgaagaaaaacgtcatgcacaggaactagcgcggcactggtataataaattaatatctttgagaaattgaaatattggtaccactttctattctgtacagcaattgtaccttttttgcatgatgattaaattagcaagcaattaactttggttgaacatattagtggcatgagaggactacattgaattgttaatcagtagatactctcagtgatttttgcttatcatttttcaggtaagtagataaatttgcactcgtagttaagttggtttctcagagaagcattgagccttttgaacttattatttattatattattatttccatagaaatggtcatgttgagcacgttggcacattaagcatgatctagtagctagttttggttgttatttctgttgctagtgctggaatattttcacttggaaaaagccatatcttatcttgtcctcttgtgctatttgccagtaccaaaaggcaactgcagagcattcagtttggtgactcgtgtgtgccatttagttaaggaccaccatgaccaactaactaagcattttaagtaggtcctttagtggacaggattagatatgaattgacttgacaaaacgtcttatgcgtctcttaggttgatggagattcgtctaattgctaagatggtgaccggtttttgttcactgacatggacatcttgaagaaaaggtgaagtagtgtgggggagaaagtcaaaattcagagattcagtgacttgtgcacaacacaaagcacagaagaagaaggaaatttagggatgagaggaagtttcttggatctacatgggaggttggattgagaagcactcttctccaattgactcttctgttcatcatctgtctgctacttgcttgtgccaccttctcctccatttttcaggaacaagtctgtccacttgatcaatggtgccaagctgtattctctgttgtgtagagaattatggtatgggaccttcctgtacgtcttcagaacatacctaattccaatgatgcatatatgtcctactgcccacatttgagcatgatgaaatcatgccaattttttccttgaaactaaatcattaggagaactaccaattatatttcaataaatataagtaaaaaatccaacagattaaaagaaaaagagaaaaaacaacatctcgacaaggacaaaaccttgccgaaagcttcaaacggtgggcggctagagaactaaacttacaacaccagctcgctaacaactaaacaatgacggagcacaacacaaggcatcgttgccgagctcattgcaaaagcaacacagctttggctttgttgcgaa

SEQ ID NO: 17451 - DNA, 2439 bp, Oryza sativa
  unsure (1)..(2439): unsure at all n locations
aaaataaggaaagaattaggtgccctagtgacaaaaacagcacacattctttgctttgcttaacttttaattattcaggtgaaaaagaggagcatgttctgaccagggaataccattctgagccttgtcaagttaatttgtcaaagactagtaaattaggtgtccttacaaagaaaagaaaaaagaggacatgttagcatgaaccgtgaagtagacttgttagattattaccacctaaaagtctaagaaatcaatcaagtaactcgatcgaattctgctcctgatcttgctggcattatcgatggaccagttattttttttctctcaggattctagaaaacatcactgcaaaaatgaaaggaatatctcaaactagtaccacacctgaagtccttttcattaaaacataatctcttaagaccctatgattagtacaacgatgtttttaatatctccatcaactttaaataacttataatatatcgttgtacatgtgccattgtctcttcagtttaaaaattaaaatatgcacttgatgaaaagtactattagttttctctacagggggttatgcactaaagttctaaacagtccatgctcatatttacttacacccaaacaatgaacttgagtaaaatgcaagaactaacttatcatcataagttgaaagaataaacataatgatacagttagttataccccacgggatgcatctcatcagtcagtcagtcatgacaaccaaatctttgaaaagttaaccaagtacaccggattaaatggatttgcaaagtactgaagtactcttgaatctccatgcttgagtaaggaaatatggggctcaattttgaccttatgaagtactagtagcaacaacattagggcctactggctggtggataacgtggaatttggctccaccaatcaaatcattacagaaatattaggacaaagctggggcacacctcactttaaggttcatcaactctggtgtcttctaatgctatcctctggcgattagaatgtttgttattatcaaagccattgcccatgaagagcaatcaaggatcagatgtacacgaatggtttgagtcgccatcactggaataataattcagctcatcatactaatttattttttcagcaaatgacatgtacagtagtgttggatagaagctgagaaggatgtgaaggtgcagggtcccccacgagagctgtttatgctttgatgtggcgatccaacaacatacagtggttgttgcaaattggctggcgtccattgcaatattgcattgcattgcaatgcgacgtatgtgaaattggcaaattgctaggtgcatgtgagattttgtgtttgtgtgtggcttgcaattgaagggcctttcttttcggccagcttatcctccgcaccgcaaatctggttgctcgcttcaatgaatgtcccagcctgcatcaatgtctgtcaaactcacaattcacaactggattgttcaacaacttttcagcaaagattttaaagaacaagtttggtttgcgcagcaggttcagcggcatttagcacaattctgagcagaaagcaaaacgtcaagaaaccaaaactaactaaataacgctgatgcttatctgcagatgtcaataaaatcggtggataataggctaggtgagcgactggagaagcatgaagagggtgagtagggtcagtgtgcctgccactgtaacaccgtgaaatggatggtatctggttggcgtccaatcgggcgtcgcgagcaagcgacactctgaaacgggacggaaggagttggtctcggagacaagaggcatctttttatcttgcaatcgattgatctcctcctattctttttctgttgctagtgactagtgatggcgattgcaatagcaaaacgggatagctagcatctagtactacctctatattccttccccatatcgttcgccagttgttgcttctgggatcatcgcgtggcatctcacgtagtatggtgctactccatccgtgctagtataatataagagattttggttggataagatatgatcttagtacaataaaatcgggatatacctgtctgttcacattcattgtaataggatgtcgtatccaactaaaatctcttatattatgggacggaggtagtagttttcttcttccatcttggagcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17452 - DNA, 675 bp, Oryza sativa
acccaaggaattcagcattcaactatcaaccaatgaaatgaccattcaacaatatgtcaaccaactcagcattcatcaaaccataaattcagcatacaacaatagatttatccatacaaatgcaatttagcaaatggactacaacaagctgtccatacaaatgaaatacataaaaatgttcattgaatactaatgaaatatagtaaataaggtagaaatacaagtagcccagctacatattacattccatgatggctattacggtcagcccacatctgatcagctaagccgtgcctgaactgaaccatcaatgcatggtcattcgcttggtcggttgacgattcatcaatgtcctcacttgaccaatcaggcggagctataagctcatcaattccgtcatttacgacacaattatgaataatacaacaagctacaacaatatctacttgagttcgaaatgggaagaatagagtggcatcatcaagcactttgaacctcctctttagtgacccaaatgcacgttcaaccgtcacacggagggatgagtgtctaagttgaacaactccttctcattttgtactggattattcccccattcattcagatggtaccggacagcacgaaaaggaggcaagaatccttgtttggctccatatccagcatcaactagatagt

SEQ ID NO: 17453 - DNA, 2275 bp, Oryza sativa
cggtgtcaaacattttgaaacggagagagtagtaattaaaacttaattaatcatacgttattaccacctcgttttgcgtcaaacacttaatttgtcagggttatagataccacatacctaatagtagttgactaaatctcggcaggacccaccacataccatgtcttatacggaaaataaccttcggatataggaggagttccacataaggaaggataagtagagttctacatggaaacgacaaggactactcggattgtatccatattggtttccctagttctacttggacaaggggacacctatgggtataaatacaaggcccctaggagaagaggggacacggaacaatagatcaagacataagatcaacatacaagcaaacatacgctaagacaagacgccggatatcgacttcaaagataagcatggctagtcccctacagtatctacggatactgataggagagacatagcgttgtctttgatctcgccggatgcggattcgagtaggaaggctaccctattgtcgactacgagtcagtacttcagaccgccaagtcgacaacagttagataggctaccccaaatattgtactggtgtgattatggtgaataagagcaacgaccggcttcggccaacagaagtagggttattacctgacaattcaggggcccgaacttgtataaaaatcctcgtccccatctcttttattacaatctcgcatatatcttagtaccaacgatccccatactatgcaaataccggaatcgcgacatcaaacgtcgacataatcttatcttcatctttgcgtaaaacacttaatcttcatcttcaggagattcaaacaccaccaaagtctctaaaactatctctttggtagtattattcagaatgcaaatatgcaagagaattttatttttaaagcttgctaaccatctgtctatatttggtgatctatgctgaaagatatgagaattacacttctttcaaagataccagcaagcaatcattactatctccaggaaaccttttgtccgaaaacataatctggcaaaaactatcatctagtaaaaaaataaagaggtgttccaccactctttagtgtggacaattttcccttatttgatactagtttagtcaataaatttagtcaaatgtagatacaaagccaaagggtacaatcaattcacatgcaagcatatgcatgctcttccaacaaatgcaaaaaaaatatgtaaaactcataatggtcaagcatttgctacaatagtttcgataacccggtaaaaatggataatttacgaccatatatatataaggttccttcaataacatcacggtttttccatggtgtgacacatggggaaaaacatcattccaagccatttataggttcattgaaggatgatgtcaccttgaaggatcttaaactctgagggcaatcccattagaacaagctgattcatagatcaccataattcattacaagtgtgcagaagttttagatcatggattttcacccggattctgttgtctcccattctcatccatagaccagcggtttaatctctgtcgagcaatctctacctagaaaaaagaacatgaaacacatcattaaatgagaaaaaaaatctagagagacccacatgctatgtgggttaagagatttaataaaaaaaaagataaggaaaattgtgagcaattaacatacctgtttttcccaatcagttctaagagtgataaatagaagcacaatagtctggactagcgtaccaagaagcataccaatccaaatgccctatagaaacaacaaatggaattgagaaacacaatttaagtcccaaattgactaatgaaattttatcaattggctcctcacctttacttgaaatcctagcacatagcctagtattacaccaatagggataccgaacaagtaatatgatgtaacattaacataggcaactacactttgccaacctgatccaacagcgacacctacagatgattataaaatattataattccaatgtgcaatttcaaattatattgatatatatactattcttttaaatggaataccatacctgagagcactggttgaatactattcaacaaaatggagaaggctagcaagggagaaagctccgcaactgcatctgctactaccttactttcagtaaatatgtatgcaagccttccacgaaagataaggaagagcacaaacaacataaatcctatcgagaaagaagtggtgaccacattgaaaat

SEQ ID NO: 17454 - DNA, 15833 bp, Oryza sativa
  unsure (1)..(15833): unsure at all n locations
tcctgcaccccttccagcattggatatcataacagggatataccacaatgaaatagtgccggccatagcagcgatcttaggatcctggccaagaaaaattaggagtggagtggtgaagaggtatatcgggaggaggaggactgcacaacacaagagaactatccatgaacgttgtagatagatgcccaacatgtggtattgcttggcgccatatgattgcccacacaatgtttccaatgcacttgccatgcctagctgcagtttacaacaatgtgcatttaaggtgagcaatttataatgtgtttttatgcatatatagaagataagattacatctagaaattaattgttagtaaaagtctaaaatataaagaggtcatcattacttgtagtaaggtatcttttgataccaaagtctgtgattgagagcattgatagggagaaagcactgcttatggaaatagtcagatatgatcaactccaaaaacaattcctggctgcttggcataaggtttgcagactaagttaaaggagaagaggaggccattaacttgacaatccaaaattaggcaccgctcatgaaacacttgaacaaattttataacaataaggacttgccttaggtaaaactgatttagaataagtattatgtctacctagtgcctaatttaactatcccaaaagagtccttctggtggaatgatgtttgtaaaacaagcatccactttagaggaattcctagatgtatcttacataagggaactgcctgcaccttctaggaagatatgtggtctcactagccacctccatgcaatgtatatctaaggctatattcctttgcttctaataaggaggcctctgtcaaagtgtttgtatctactgatctggatgataattttaatctgccatcatctcggaaaacatatgatgaggtttctcgatagtcaaacaaactcctaaacttggaattggatcacactgctgatcagtggaagtatatatggggaaacatgaactatgcctttcagaaattcttctatctgatctttaattacatccgtctagcctccacattttatttggttatggaagagtaagtgcacttcaaaagttaaagtttttggattgctacttcttatgaatagattgaacacacgatatatgcgagatcataaaaaattgctccaccaaagtatgacctagtatgtgtgttatgtaatcaaggggtcattgaaacaatgcaacatttgtttcacacgtccattttcatcttcatgttgagcttcaattggatttagttggaataccgtgatgggaacttaaattatgatggctaaggctaaaaaccaatatgtgggttacagcttcatcgataaattcttaacttctgtctagtgtatttggaagataagaaataacttcatcttgagcagaaacctcccaccttttcttccgggagatatctgtttaagactgagctcctccttttaatatttggactaaatgaggagataaagatcaataaaatatattactgtagggcctccctccctgctgtgcttccttaaaaaatatctagatatataaaaacttggcagtctgctattgttccagagctagctaacacagatatcttacgagcttatttgtacttgaagtcatgaagagcacacaagtatataactaatgcataaagacaatgcaatgattaagagggggtggctgaactaagagtccgcttcaaacattaagggatgctttgaattagtcggatggcccctttctaaacaaaaaatacataggtctcacataatttagttcttacagtacgaattgtgtcttttttaaaaaagaaaatttttttatgtgcctctgaatattttggatcccttccgtgacattaaatgttgcctcatctctctgacatgtctgatatttttttccccatcaatacactttccattactttgaccgttagatttttttttctaacatgactatatgcccacactatccatttctcatagactcgcacttatgtacactttaaaatataaatctcaacttgaaaaaaatacagtaaaaatcaaatcgagcaaagtttgagagttatttgatggaaaatttggaaaacaaagtttaaattagtttaaacacaaaatgtaattaaatagtattaagtgtagtgggtagagaggatagttacgaggatgccgccgctgaagcgcatgaggacggtggagacgagagcgtatccggcgagctcggtggcgccgatgtggccgatgaaggcttggctgatgacggtgacgccgaaggtggagaagcgcgcgcagatggaaggacccgccaccacccacagcttcttgctctccaccaacacccgcggccccaacgacccaacctcctcttcatcttcttcttgcttgtcgttgttgctgccttcgccatgagcgtgcttaggctccagcagaggagccgtcctgcagtcatcatgttcatcacccggcctctccatttctcctagcacagcttggcttagctagctgctgctaactttaattgtgcaggaatggagcgaattaattaatgggaataattgcacttgaggggaagaggagctatcagaattgatgaagggaagcaggttaggaaggctctcagctaccgttttaaaggagattgatcaggtagctgggttgatggctggacttggaccagagagttgagtgagcaagtacctgattgtccctgtggctgctacataaggtgggtaggtagtgagggcaaggtgggaaagtagtagtaacactgactcgttaatcatcgatttaggaatcagcattccagacaaaaggaaggaccaataatatagcgagtatgaaattaattaacagtgactgtcgtcatatatactacagaactatcatccatccaggaatctggggttgtgtgtagtgttaaatggctcaatgcaagtggattgtgttatgtacgtatacacaccagggttcgacttaccgccggtaaccgcgcggttaccgtggttaccgggcttaccgcgggggtacggtaatataaataccgcggtaacctccttaaatttaaataaatttaaaaaataatttgaatttttgataaattttgcacggttttgtacggtttttcacggttaccgcggttaccgcgcggtaaccgtgcttactgccggggcgcggtaactctggccccggcgatttgggaaaccccattacacacaaacggcggagcttgcaagcggcgtacagagccagtaattaacttacactataaagccttaagaagttatatatatatatatatatatatatatatatatatatattaagcacatataccatatagtgacacaaattaaacatttatagtatgatagataataaataaagcaatttgtaggttgcaatataataatttattctctataaataataaacgataatataattacaactaaaaaggccatagtagaaataaagtggtataaataccttataaataattgaaactataattcaacaatgaattgaaatcgatagaggcacttctgtgagactgtgacctacgtaccttcaggatccaggaaacacagccgcacaggcagggctgcaggcaccggcagcttggctgatggcgtctcgctccgtcgctcggcgcgtaaggaactagggcattcgcgacttggggttcggcgacgagacgagtagacgacgaagcgacgcgcgctcggcgctccccggcctgggcgctgcgctatgatgtgggctgccgcctgggcccccttccggcctgggcccaggcggttgcacaaccggcctaggcccagggcaggcagcggctacgtacgtcatgtcgccggcccggtctgttcacggcagctatagttgccggacgtacgtgtcacgtgtggctgaccggcatccccgcttggcgcttgcatcctcaactcgtcgtggccaccaaaaccaaatgtaggacttcgttcatttgatgtcaaaaaaaaaaacttactaaaatttaagcaacttgtcaaaattttggcaggatttcttatatgctctagttaccaaaatttagcagtaaactaaatgtagctattttttttttgataactttaccaaaatttagtaaagttgaaaataacatcaaagtgaacaaactgtagagttcctcgtaaatccaacgataccacccaatatgcatctaagaactgggaaatgcatcttgacaaaaaggagatctcgctgcaaggacggcgttacatcattacatgtatgatcaggttaggttgtttatgccctgcagttcaggtaatacccacacaagaattgggtttgaaagtaacactagaaaagaaaagaacaaaataaggggaaggccggccgggggatcaaataacaattgattctttttttctttttttcctttttacatgcgcggtggtgcgtgcgcgtcacaccgccctttgaattttggttatcaaatctgcattctttttgttgtaggacttggtgatttaattaaatcttgaatatgcatgcatggagctgtaatgtataggtctcaccataatctctagagaaaatcccttatatacccctacaattttagctaatcccttctatatctctgaattttgtttacctccttgtatgcatccaaaatttgattttgatcccttctatacctctcccgtcagttgaccgtctaatttctataaaatgacaattttacccttttgatgaacatagaaatttataaattacattattgaaaatgtaaaagcttgctgtatgagactattatagttgtgtgtttattgtgcgatacattatctatgacaaaatttatttttagataatgaaataaaaaatatgtatttattttatttttaaaaaagtcataaaaaattaggagcatccatataaagataggactaccaatgctcacgatatatttttatgaatactccgataaaaaaaatccattgtcctattgaaatttcaaataaaaaattctatttattaaatttgttttattttcaaattttatgtcaaaatttcttgcactaattattttgtctcattagtttcgtaaaatgcacatattgtgcactcaaacaaaattttcaattgcttttcaagcatatattcaaacctaaatcctcaagggcataaaagacatttgcaaccaaacttaatagtgaaataaaggaaaatataacgggaagggcatggaagggatcaaattgaaatttcaggggtagagaagggatcaaataaatttcaaggatatgaaagggtttgagtgagtttttaaggctatacagggaatttactctaatctctgtggagtgcgacacgccatcttctttcgtcaagcaaccaatcgtcctaccgaattggctcatcatctatcacgccttccattcctcgtcaaatcctattaaattaatgcttagattttttttaagaaaatcctattaaatcatcattatcatcaattaattaattaattaatcaatgtgccattaactaagaacgtttaattgttaatatgtctgtccgggacgggagatgatctcacttgattttttacattttaactctttttaaaaacttattttataaatagacacttaaacaaaagacaacttcgacattgggcaaccgcgggcgcaactatgacgtccaaatctgtattagtcccactctatactctgagtaggccttccatgcccttcacatagcactctatttatacctttgttctcgtttctaaaagcattaacctggaggtactatatatgcttgaaatgaactgggtatataagttgacccaaatctatctacactctccatgtggagctcttccaccaaacgaacacttgggtctaaaccggaacaagaagagtcacggaccgaaacagactaaatgggctggattttacactctcactccctcatgggttgatgccctagcaactcaccgctacccaacagccaaatttccaggatatcccctcggtgctacggcattgtgcctatgcgtcgtgtccccctccacgggctaacacacacgcacacttgtgtaacacgggttgaagttctaatattacatgtaacactcgagagacaaaatcaacaatagtccactctacccgctaaatggacccacattcacattacacccaacttacacttttcatcatcacttttatgtaaaaatgttaaccaggaggtactatggttatatacacttccaatagatgttgattaaatgtgctagtatcaatttatgatttaggtgtatatatatcatgtgtctgagctataatatgcatgtttaattgcaaggtagttattgtcgacgtttgatgtcgcgattccggtatttgcatagtatggggatcgttggtactaggatatacgcgagactgaggtaaaagagatggggacgaggatttttatacaggtttggacccctgaattgtcaggtaataaccctatatcctgttggtcgaagccggttgttgctcttattcatcataatcacaccagtacaatatttggggtagcctatctaactgttgtcgacatggcggtctgaaggtctgactcgtagtcgacaacagggtagctttcctcctcgagttcgcatccggcgagatcagagacaacgctatatctctcctgatggtatctgtaggcaccataggggactagccatgcctatctctaaagtcgatatccggcgtcttgtcttggcgtatgttggcttgtatgttgtggtttctgttgttttgtgtatgttgattcttccctctcctcctaggggccttgtatttatacccataggtgtccccttgtccaagtagaactagggaaaccaatatggatacaatccgagtagtccttatcgtttctatgtagaactctggtcatccttccttatgcggaactcctcctatatctgaaggttgtttccgtataagacatggtatgtggtgggtcctgccgagatttagtcaactactattaggtatgtggtatccataaccctgacagttatatgcatttgttttttaaaaaaaaaatcttgcatatgctaattatgtttgtttgattaatgatgtaggagtatacatttttattacttgcttaaagtgcttgttttggttgaagggtagctatatttttaatttgttcctttttgtgaatcttggagatgtcaattgtgtttggttcactattcagtagtatttaatttttgatatgtgtttaagcactaaagtgactatttccttgtagcatagacatatccatttgtttgtttgtgtgaattccataattgttgattgtgctcaattcacaacttagtaggatttattttggtgatgcgtttcagccccaacatggatgtttgattccatactgaaatcttgttatggattgttgaacaattctaatgaaatcgattctcttttgtttttgtatatgttggaataaatataccaacttgatccaatatctcttgatattgaataatttctacccaacctaaaaaatgtggtgtattaattaattacacaaaaaagtgggatatacatttcaaaaatagatgtgtgagattatgttgtggtttatgcatattcttgagtgtgagtgcctcgcttagatttgttggtagccttatacactacgattgttctcaagagtaaggaattgaggttcttcgttttgatatgtagctcatgatttgcaccgcatcgtctgaatttcatgatcaacaaaaacatcttgattttaccttgtttagtgattaggtatgttctaatagcatttcttaaacaacatggcccaccttcgaagggtttgactattagttttattaatcatgaaagggatgaatttcattaatcagaggaaggtttttcacctttgttggtttctacatatctagtgtttttagtcatgtatcatataagatctatattttgcatcattgaggctatgatgccaggactactttattggttttagataagttttatactttggcacaatgtagaaaattccatcatcattcaaccagttactttagagtcaacctactagaatggtttccctggctaatcaaattagtaatacatggattgtggagctgacactttggaatttcgagggattacttttttttttgcattggtggaaataattcgttacagataactccattcagtgtggtcaatttttagtcttcacttatgataaacgatcacaattcttagtgacagtgttcgagccatcaggcattgacaagatgtcaacccactctactcacccttcaaaaaagatgatcattagaactaaaagtgatgaaagggaatgcaactatcacatcagaaaaaatggctcccgccattaaggagaataatggaaccgtaggaaagagaactagaaatgtagattgtcttgtgccttgtggaatatagggttccataaagaagttgtttgaggctaatgttttgaaaagtgataagagaaaatgtgcaggtccttctgttggtaagtctaaggcaacgtcaacaagccatagcaataccaaagatataatattcctctatttctgaaaatgttatatacactaatgtatttattttggcatagcttctcacatttgtttcattcatatagcatgtttaattgcattcttcatttgttccatgcatcaccataagttaggaggccatatgcagtgtcaaagcagtttttaatgtttgacgtggacttttggatatatatttgaccattcacgttattaaaaaacaatgcatagttatcatttattttatgtgatttgcttttatcattataaatacttgaagcatgacttacatttttgcatatgtgcacaaattgttttgaataaaacgaatggtcaatcatatgtccaaaagtcagtggggcgtcaagcattaaaaaccgaattgagtaattgcaaagagacctatatctagtctcttggcttgaggttaagttagtttatttctttcccttatgactgattacgaaagtcatttttgtacgtagttcatacatgttaagagtcctaagtattcacatgatcccccatcaagcttacttttgcacattatagattcctcaagctacatgtcagatgaagatatttgttttagcaagttgacaaagacaccagtactgatttgctttatgtctactaaggtgactccacgtggtaaattttaagttatcccctaaacgcagggttaataaatcacttttgtcgataatttaatgtggttacacttttcagacatttctaaggttctaagacatctatgagtaataccacaaaggcatgtaactgaagtagaaaaccatgctcttcaaagggcaaaagaatttaaaacctaataatcctttttaccgtgtaaataatgatatgttggatttttcatggtaatgttactttcatgtgttcattctcatcccgtattgaactttttttctatgtgcatgaggtattatctaaaaaaatgtggatgacaggattgatcttaacttgcataacggtactgcaactatagtttgagagttttggatgagatctaatttgaatatcccatcttgatgtttgatttttatgtatgtttattgtgaatgtgactgtaccaattgaaaaatcctacaactatataaatcaccaatttgtgatagcacattgtttttatgtcagaaacacaattttgtgtgatagcaaataacttgcaagattttcttggtgatgctagaagaattaacttccagcttctgcattatgaggcacatgtagccttacataactaagtttggtatatctaagtggccgtttggtcttatcgaccaatgattcattgaaattatatattagcgaaaatttaaacagatttttttaataatactatggccctaaagttaaacttctcaaactctttttaatctgctacagattgatatctaaatttaggacttactaggagatattggagacatatggccggtcaacatctccaaggtgatgggacgacagatggtggtgttggaatgagatggcgctgaccacgaccagtttgcgaggagggaggtgactacctcggtggggctatacaggtcccaccacacgtgtcgctgcggggtggggcacaccatctccttcgtcaagcaccccaccgtacccccgaacgggcccagcccacagcacgccttcctcgtctcatcaaatcctatcattatcattaatcaccatcattcattcattaattactgattaattaattatcattaatgactgcttagtaataacgagtcattgatttctgtatcaacgtttaagagtacaacaagagaagccagctataaacacatacttccttcctccgtactcgtaaaagaagtcgtttaggacaatgtttaagtcaaaccttgggaatataaatcataaataactctcaagttgttgagttcgaaaatgtaaaaaatatatgaatagatttgtcttgaaaaatactttcatagaagtatacgtatatcacttttcaataaatatttttatagaaacaagaagtcaaagttatgttttggaaaccgtgtcgttgtccaaaacgacttcctttacgagtatggagggagtattgagaagataaaagagtagagactagagagtagaagcagcaggctacagatttatagccagctatagcacagacttcaagacacaatgtatgtatcacatgtgggaccatgtattaatacggtagtatatgtttatagttaactattttatgaattagctattatagatgatttggagttaggccctgtttagtttccaaaaactttttcccaaaaacatcacatcgaatctttggacatatatatggagcattaaatatagataaaaagaaaaactatttgcacagtttgcatgtaaatcgcgagacgaatcttttgagcctaattagaccatgattaaccataagtgctacagtaacccacatgtactaataacggattaattaggctcaaaagatttgtctcgcggtttccatgcgagttatgaaattagttttttcattcgtgtccgaaaactcctcccaatatccggtcaaacgtccgatgtgacacctaaaaaatttttgtttctccaactaaacaggctcttagtagttggctatactattattaaacttgctccaatcttgtttaccgaatctggcaggatgggtgatgatgtccatgatccccttgtagatgtcgcagaagacgatgtcggcgccgggcagccgcggccgcagcgccgccagccgcgccgccaccctcgcgctgtacccctggacgagctcgttcgcctcctccacgcagctccggccatccacgacgtgcagcccctcccacatcacccgcggcgcgcaccccagcggcgccacccccatcaccgccgtcctcctcgccccggcctcgtacagctcctcgacggcgcgggcgacgcggtcggcgaggaggcgggcgaggccgcggcggccgtgcttgggcgccgacgcgtcggcctccgacccgcgggagagcacgcgcgcgtacgcgtcggtgccgaaggacaggatgaacaccgcgcgcgccgccgccgcgtccgcgtcctgcggcgtcggggcctccagccgcagcagctgcagcgtctcggtggccagccgcagctgctgccccacggcgcccaagcggaagatcgcgccgcgcccgccatcctcgccggcgaagttgacgcccctggccacctccgccgccgtgccgttgagcgtcgagatgaggggcggcggcgggaggcccatcttggcggctgcatcagaaatgattcgaattagagcaattcgtgttcgtggggctcacagttcatcagttgaggaggagctaggtggttggttaccgaggagatcggggaggaggcggtgggcggaggggaagagacaggtgccggaggaggaggtgagggagaggttgatggggagtgtggtggcggcgcagctggcggtggagtcgccgaggacgaagagggcggtggccggcagcgaggccggggcggaggcgacgatgcggagcagcagcagaagcaacagggggaggagcgccatgcctcgggcgttgtggcgccaaccaaacaaacacctcgtcaacttcaaagaggaatcgattgccgatttggagggtatgaattgaatttactaatatattaagggttaaagtgtaattatttcatctcatgacatatttcgaagaggccccctgtaacaaccaaaattactggtctcggtggaatcgcagcggcctgcagatctctcttctccgactcaatcattcgccctgcgctgcacaaggtgagaggaaggaagggaaaaccaattggatctctcaattaatcggggtgtgggagcaagccgcttcaacgcaattacgcaacgccggaggtagtcaggtagttgcgatgccttcctgttcttaatttcgccgttgttttcccctttactgaaatttctttaaactgtcccgaattgttcgatgcattcgcggggaacgaaaattttatgttcttgttcgtagtttcttgggtcaacggctccgtcggctgcagtttgggatttcaatttgggcgccatttatgggtagatttcggtgacatctgatgatagctgttaggtttgtcagcagtcaaccaattggcctgcccgcgagtttgtgcaaattcctttcgtccttttgtttgggcataaatttgatgaatgcccttgccctacattgcttgtagttatgtggaacacgccgagcagaacaatttcatggtcttagtgtactctgatacaagtaatgttttcttcagtttggtgggagatgtcaaactttgtttgctaccactagctatggctgcttggttttgtacctgtatttcatgttgacctagagcatgttttgcttcaccgtgttgtttttttggagttgtaatccacaaatttttgttggtgtcactatctattggttggttggtttcaatataaatttttcaataatctctttggcgttccaatttttcctacataacaggcatgattcatgcaatacactgactgaaaaaataatatggcttcaaaagccattaaaaggaagccttacactgctgatattgatagaagcgaaaaacagatggagacgatcataccagattctgtaagagaacctcttctaggaaacagaactcatgaaagcaaatccgaggttagtgaaatttctccaaatcatatgaatccaggttattaaccgcattttagttcttcatgcgccttaccccttttctcgtactttttttttagagacatgagcctaatatgcagccaaatttatgggatggaaaaggacaagagcgccttggttggatgcatattatatcgacttttattctcaatctgtaagaaagataggtacctatcatgaatatgattccagagaagtggattttttagtgtcttactgccctctcgaatgtacacagcagaatgcttaaacttgaccttttagaacatttactatctgaaaaatcttctttttttttccaggaaatgcgctctctcagtttggaccattgctagcaaagttctttagtaggtcttgtgcttcccatggttcacatgatgaacaggcagttctacttgatctcagtccactacaggtataatcagtgctggcacatgcagatctcctatttccatttaaaataccatatgattgatgggttaagtttcccatcaaaagcatgaattcttatgagtatcagatgtgacatgttaatttcatgtaaatattttgagatatttcaaaccttttactgaagtatgaaggaaaatatcttttcttcctcagtagtttaagcatttgaatgagttgtttcaagcatactctcgacatctttgatgctcaattcatctttcatttattttttatccttttttacaataataaaagttcttgtttgcttttgtgattattcatggacaaaaatgttggtatatccatgaacaatatcatggtaacatccatgaaacttgttatttcttccacaacactcatttagtagttgaattgcatgctttaaaaattcaaatgaattcttgacttggtttattaattccaacccttctgttctacaggagcaatgatggcatctttatgttattcttgactgtttcaagtttttacatttaggaacttttttacatgatactacggttttgacagttccatgtttactttataggaagagagactgaggttcttgagacaaagattaaatgtgccatttgacagttcctctgtcaagcatcaggttccgcttctgtacctaactacctataggcctttggtattcttgttctattgttctcaccaatgggacaccaattttcttgctcagaagaaatgataaactgaacaattcatatactaacattcatgatagtaaaatatttcattttttctatgacaggatgctctgaaagaactttggagattagcttatcccagccgacaacttcctcctctgaaatcagatctatggaaggagatgggctggcagaattctgatccagcaactgattttaggttcgtttcgctaatccctagtaatgattttaggatatatatatataagctgtcatgcatttatcaacaccgcttgaacctcgacaactaatcttttgaagtatctaatgattgcagagcaggggggttcatgtccttggaaaatttaatatattttgctagaaattacccagtatgtttctattaatcatgaacatttactccgcattagtctgctgttattgggtgattcgattaggtacaatgctcaatgtctgctttaacatgcaggattcctttcacagtttattacacaaggcggatggtaggagatctgaatgggaatatccctttgcagtagctggcgtgaacatatcttatatgttagtgcaaatgttggatctgcaatcaggtgaaatttgcagtaacaccttatctttgggcccaatttacctcctttgctcttgacttcgaaactctcttttttttttcagctctatgcagagctacagcttatctctttcacttcttttgtaggaaaaatgggcacaaaagtcagttctcaatttgttcaactacttagagaagacgagatggcttttgataaccttttctgtatggcctttcagatgcttgacgctcagtggctcacaagacaagctagttatatggaattcaatgtgtgttctctgtagaacatctggtctcttctattggcttctcattctaccaccttattcagttgtcttcatttccatttttcaggaggttctaaagtccatgcgtattcagttagaacaagaacttactatcggaagcatttcttgtgttcaggagatgccatcatttaggttgctaaaaaggtagccatgtttgttgtttacagaaaggagtgtatcttacttgtcagtaggatcttgtgcatactaccgattctttcattggttgtaccaacatgacccaaaaccaaaccctttgggggttttnaaaaaaagggggaaaaaatttttttaaaattttttttttttttaaaatatagaataataaacccagtatatatctggtactttggtaagtgttcaatgttttctggggtaacaatttaagtatttctcta

SEQ ID NO: 17455 - DNA, 14743 bp, Oryza sativa
ctgcagcccccaccttattagttgtcttcatttccatttttcaggaggttctaaagtccatgcgtattcagttagaacaagaacttactatcggaagcatttcttgtgttcaggagatgccatcatttaggttgctaaaaaggtagccatgtttgttgtttacagaaaggagtgtatcttacttgtcagtaggatcttgtgcatactaccgattctttcattggttgtacaacatgacacactgtaagattatttatcatagaataataaacccagtatatatctggtactttggtaagtgttcaatgttttctggggtaacaatttaagtatttctctaatgaaaattacctgcaacaggtttgcttcttgaaacatgtgaaaaatgtaagtaaagtaaatatcttttattaacattcctgatgtttggaatatcaataaaagatgcagcatttatgcattcatgcctcaaccaagatgtatagtatagtttattctgaaagttagatagatttacatattgtgatttctgtataacatatgctccattaccttataaaactgtgaactacccagagttttcttgtgggaatacctatagtactacccaagcattcaagattctgagtaatcagaattaactagctcaatctagggtaagggagaaaattctctccctagttaatcaatcagccttgggggtattacaagaaaaggaacacagacacttgtctcatgccaagttgaatgcctttgggtttctaggagactaggaccatagggagaagcatatgaatcttccccacctgaacagaacgcctacagaagctttgcttctttgtggcagtgccattagacagaaaaatataccccaagataaaaacctgaaaacttccctgtatatctcaagattttcaacacccagaaacacgcacacagagagaatcagttgcacacactgatcattttttgagggcaggagatattgtttgcttgaggagatattcgctccctatctgaaattgaaatgtccttgtctaaaaagtctgaaatgtccttgtctaaaaaatctgaaatgtccttctccaacatattgcattcctcaaacaaattgtattctgccatacctgagttatccatgctgttgccgccttcagttatactggagcacccttcaaataggtactccatgccgccttcgaatgcctcatcattgaaccattcactgaaattcatcgagttgctgaagtaagccccaggcattgtatccaattcataatccaagcaagggctccagaggctttcttcaatgccatcaacaattggaaggggttcattcatgcattcggcgctgtcatcggctgcaagtggctcattgttgtcacttgatgtatttgcttcactggaactgagctcttggactgcattctcacttcggtcatcatcttgaggctcttcatgtaatgctggcaccacctgtggctcttgttgcagttgtgccaataactgtggttcctgttgcagctgtgccagtaactgtggctggtccaggtagcagctgatgtcgaagttggttaccgcattggcacctcggtattcgattgcagcaagatcataggccttggctgcctcctcttgagtatctgtaaaaagaggtacgtttgttgaaatgagaacaaattttctggtgagacactgaatctttggggcaacttagtactactaggagtcatgaatacttctagtaacattggcattacagaattgatcaggtcatgctgtatagatttaagactttagaaaatgaatgcattggatcttaatactgagagatgctgaattgcatcccatattcacattttttttcactttctagtttgacatgtgctggacaccatctgagatctgatatgacttttcccacattgctggttgctagaactgtgctggcaaccttctgtttactagtaatcggtgaacactgttcactctcccttttttctttctttatttgtgatgaaagtagtgatgaatccatctgtgtggttctggatcttgaatcttgatctagtttggcacagggggggtaatagcctagtagggcattctccatgcacgtgaagtgatcacttgcaactggctgctgactcactcagctagctctagtggaaagagccggcagtgatgaacaattgaagatccctatgcaccatctggtttttactactggcattgcagcaccactcacgtgcttgtcacatgcatttccaagtcatgtaccatataatgtatctatgtatactaggattttgtctagtaattaggacatggtggtgatcaagacatggggcttgtttttatgctatttctagggcaagttgggcagtcttctggggattgcatacaggatggtatcttggtctcatggtctttgatcttgacagcaggaaaagattttctgatttttttaagtaaaagaaaaagaagtttcaacactatgcttccatatcagtgatatcaccagctcacttaatttatagtaaaatggagagtttgtggttcaagaacatacaaggagaataatatatactactttctctgttctaaaatataagcatttttagaatagtcctaaatcaacatttttaactttaactattaataatgaaaaattaaaaagagcaatcacgtaagaataatgttactagattatagagtaaatttaataaaactataggtattttgcataatttatcacaaaactacatattaaaaagcttgtctcacaaaactacagatttagtgtctccgtttatcacaaaactacaggtagtttgtacaatctatcacaaaactacgatttaagaactttcacaaaactatagatttagtgtattcgtttatcacaaaactacacatttagtgtcttcatttatcacaaaactacagatttagtgtctccattatcacaaaactacaagttttaacaacgctaaaacttgtagttttgtgataatgaagccattaaacttgtagttttgtgataaatgaagatactaaatctgtagttttgtgaaataagtacttaaatctttagttttgtgatatattgcgcaaagtacctgtagttttgtgaaaaacgaagccactgaatctgtagttttgtaaaacaagttcttaaatctgtagttttgtgatagatcgtgcaaaatatctgcagttttatgaaatttactcaaactagtatcataatatgtaactctttcatttaagataacttgtttttataaatattattggtcaaagtagcatcccgaaaattatattgaaatctaaaactgtctctattttgagacagaggaagtactacctagtaagtaatcctcaagaaaagcaaggggtcaaatctacatcgaagggaaacaagaaaaacacgccatttaatttcgcagatgggttgatcaaccatcataaaatttggtaaaagttaggtggccggcttacagcaggcaaattctccaacaaacaagagcggcttgtaaatgctagtaatcagcatttgattaagttaagtgggctccaagaaagaaagaagagcaaagagcatgaaagattggatgaaagaatacgtaccgaaagtacccaggtagaggtacttgttccccaggacccgccctatccgtgcctcccaccgcccattgtggtgatgcctgaacaaaaccagacaaaaaaaaagttcagaaatgaattactaacagacagctactagctctgaacaaaatggaaacagcaagttggtagcactggcaccacaatacagtaactgatgttggaagcagatttcatcaagaaagagagaagcttaaaacttttgcagttctgacttttcctagatgcatgcatgacattgcacgaaactgacacaagaaagagaccatggggcatccatgcagagcatacacggctggcaaatgacgttgccagctgatgaatgccaccctagctagcaatactatgctgactcatcattcagggagagagagagagagagattaattagagttaattaatcagtagtcctacctggcaacgcctctgtacttggagacacccctggagaaaccgctgctccggcggcggagggaggccaggtactcctccctcgacacaccctccatctccgacctctccttctcatattcctccagctgcaataattcacattatcttcagtaataattcagattacacaagtcgcaattgtctagtggtaagttggcaaacttactgggaaattgagcactgtctcaggaccccagtacttaagagctgcaaggtcatatgcacgagcagctgcttcctcactatcataagcccctaaacaccattaaacattgcactaatgttcagaaacagatcaaacaccaacacaataagtagttatgtaacaactagttgctatatgcctatattcttagggataaactgttttcatattgagacaaaccaaggatgtgacagatcaaacaaacaaaatgtgagattatacaagaacaggaagcaacatgcagcatgaatctgacaaaacagggtgtatagacaactagtttgtgggacttacccaaatagactattgagaggagcatcaagcagcagcagcagatcaaggtcacatgcgcatcacaagggcaaggtcccccaaagataacagcaaaaaagaaaggagataaaaaaagcttaatcagaatgtcagccttaaaaattcgctccactttatagtaataagctttgtactaatggccgatgtatcaagatccttggcagtatacagaagtacaccaaggaccttgtatgtttcactttttctttcattatagtacattatactgtaaaaatactcaatttcactttctttacagcattttcagataaaattcatgttaaaaatcctaaaaaaaattaggcaactaatgcatgttgcgatcaatgtaccttgcctccctttcttcttgttctgaagtgaagtggagcaattcttgtcccacagatgggcctcaaatctgccagtccaccgatgcctgtttatagacacatgcatgcagcaaatgattccaccgtatattgaatttattaatgattgataaataagcagcattcaagcattagtgtttgctttacaggaggaagaaaaactgaaggagttgaccaccccagcagtaaatgtagatcaaccaactccctacttcccagctaataataattgactcactccaaggggaggagcagcaagaaaaaagattaaaaatgggaattatgagatcaagaaatggatccgatcgatcatgctcgccaacctccaaaagatgaggcatgaaaaggggagcagactcgccacccacaaaacgataaaataactgatgatctctgacatgcaagtgaaaatattcaggaacagattggaaagaagcggctggtaattttgggagcctgaaaggatggaaatgatgcggaattttgggctggaaatcagccattgattaactagcggcaatgcaggatgaattcgcgactgaaatcgagaggggatcagaaagaacagcagaattgggatcagagggatggaagcaactgaacatgcagggacgcatacctggtgactcccctgtagatagaactcctcttgccgccgccgccgccattggaagaaggatcagccacctccttgctctccttcttgggcctcttggccttgccggtgctcttctccgtcctcggcctcgccctcctcttgcagggcatcgacatgggcgaagaggaatcctcggaggaagaggaggaaggagacgacggcgaggatgatgcagatggagaagatgatgcaggatcaggagacgatctcttcgccatgatctctcgcgttggtgcaggtgcaggtgaggaggaggaggagaggcagcgaagtggagcccctgaagttttgtaatttatagcggagggggggaacgaaagaaagtgcagcgcagagatgggttttttgggttgctaatcaccatcatcagcattaactgaagatgacacctctgttttttttgtatttttgtgcgtcagggcctcaagctggccaccatacgagtcaattttgatacacttattcattattttttttcatttcagatatttcctctgtttttatacattattattgatgtaagtgcgcattccgtttgtgcacaagtagtggtcgtattcagatttctttctctttctttatttttgcagatttcggtatacgtgcagacgctcatatacatacgtgtatactcaccttctataaatgcatatgctatctctatgaacacctttgaagattaggcaaggatattggcgtttctgaatagacataattttcaaaggaagcacaccggtaataatatctttgagatttgcgaagatacaggacaattttacatagcatagcagatgacgcactggcaaattaactcaagataacaccttgttttttgtatttttgcgcgtcagggctctgctggacaccgaagattagcaatcaatttcgttgcacttattttaattggtttctttttgagagatttcctctgttttaattatattattaacgagtctccaccaaaaccctggtatatcaaacaggcacaacattgagaacatttcttatgagccttgaaatttggtggggattgttagaataattgggttaggcccaacttataatattaaatctcaaaggcccataataagtgttgaggataataataccacctcaggatttaagcgagaaatatctcaacctaaatagggagttattggaggctccctgttgaccagttgaggtgggggtcggaatgccacacgcgcgcacgcgcgcgcgccgggccgggccgtgggcgagggcgagggcgtggctggcttttgcagccactaacccacgttcccacgattccctccgcaacagcgcttccacgttctttctcctgatagataaggaggccgcgagtccgatccgatatcatcgcttctttcccggtgttagtttctccttctccgcgcctgagttgctctcgcttcctcgcttctgatctcttacgcgcacgagagattggaaggagcagtgcctccgaaaccacaccttcgcctgagatctgcaccgggtaggcgggtgatcaggtttttggggagtgcctcccgcacgactgctcatcaccatgtctggagttgccaccgccactgctggcggaggtggtacgccgccgacaggagctcgatccggagctggtgcgccaggaggtgccgtgaacgacaacaacaacggaggcaattctgcctcaccatccagcggagggagtgcctcccgtacgactgctcatcgccatgtctggagttgccaccgccactgctggcggaggtggtacgccgccgacaggagctggatccggagctggtgcgccaggaggtgccgtgaacgacaacaacaacggaggcaattctgcctcaccatccagcggagggccattctcagggtataatcttctcctcctgctactattgttagcgctatcgctatactatgtgcgctatgtccttggtctgttctacatgatgcctctagcatgttatcgcgttactgttatgttcctgttcctgacattcatgatgtgcatagtatgctactggttatgtgaagatcaacctacactgcttatgccatgatcattgctttaactttttgaattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtacgtcatggagcagttctatgactacaagatggtcgatgaccattctgtagtggaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagataggaagtctgccaacatggtcattagcgagggcggaggaacatcggggtacggtaaaatgttacctacagttctctctgtttatcattcacctgattggtgggtggacactggtgctaatattcatatatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtccctttaataaagaagaatctagttagcggctctctattgtgtagagaaggttttagacttgtgtttgagtccaataaatgtgtcgtatctaaatatgggacttttgttggaaaatgttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgacgcgcttagctaacatgagtttaattccaaaattcactttggtaaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttttgactgcgtgtcatgtcctgaataaaattccaatgaagcataaggaagtaacaccattcgaggaataggaaaggaagaaataaaatctctcatacctacgaacatggggctgtttggccaaggtaaatgtacctatagccaaaaagcggaaacttggacaaaaactgttgattgtgtgtttcttggttatgctatccacagtgtgggttatagattcttaatagtaaactctggagtacccgacatgcatgctggtacaattcttgagtccagagatgctacattctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtggttgagcgtccatatgggtgcaagcccgtaggatgcaaatgggttttcaagaaaaagcttaggcctgatggtacaatcgaaaagtacaaggcaaggcttgtggccaagggttatacccaaaagaaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatagatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttgtgcttatatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgcaagccagctcctactccttatgatcccagcgtgctattaaggaaaaaccgaagaatagcaagggatcagctgagatactctcaaatcattggttcattgatgtacttggctagcgtaacgaggcctgacatctcatttgctgtaagcaagctgagccggtttgtcacaaatccgggagatgatcattggcaagctttggaaagagtaatgcgctatctaaagggcactatgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagcagaccatcttaacgaggtcaacaatggaagcagaactaacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggggtgatagcattggactatgtccaaacggctagaaatctggcatatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaactattgtgtgactgagagaagagacccttgaaaagggctcatttttatgatgtgcttctcttctttcctgcatggtaggatggcttatgtcttaatgtgatccgagtggcttttccaagtagagatgttgacctgcagaacatctcagaaggaacacacctatatgagttcaactgctagtcacagtctatgaggtttgggcgatctctagatactcatgaaaggcctggagtttgacttatatgctccaaacagaggggatgcgaacggcagcccagtaccagtcaaggttctgagtgaaacctgatcacacaaaactcacaattcaaggcatagtccattgttcagttgtggtctaatgtagctcatttcctaggtggaagttcaacttaacagtctccaccaaaaccctggtatatcaaacaggcacaacattgagaacatttcttatgagccttgaaatttggtggggattgttagaataattgggctaggcccaacttataatattaaatctcaaaggtccataataagtgttgaggataataataccacctcaggatttaagcgagaaatatcttaacctaaatagggagttattggaggttccctgttgaccagttgaggtgggggtcggaatgccacacgcgcgcgcgccgggccaggccgtgggcgtgggcgtgggcgtggcgtggctggctggcggcgtgcatgcgtcacgtcgctatgcttttgcagccactaacccacgttcccacgattccctccacaacagcgcgtccacgttctttctcgtgatagataaggaggccgcgagtccgatccggtttcatcgcttctttcccggtgttagtttctccttctccgcgcctgagttgctcttgcttcctcgcttctgatctcttgcgcgcacgagagattggaaggagcagtgcctccgaaaccacaccttcgcctgagatctgcaccgggtaggcgggtgatcaggtttttggggagtgcctcccgcacgactgctcatcgccatgtctggagttgccaccgccactgctggcggaggtggtacgccgctgacaggagctcgatccggagctggtgcgccaggaggtgccgtgaacgacaacaacaacggaggcaattctgcctcaccatccagcggagggccattctcagggtataatcttctcctcatgctactgttgttagcgctatcgctatactatgtgcgctatgtgcgcgctatgttcttgttcctgttctacatgatgcctctagcatgttatcgcgttactgttatgttcctgttcctgacattcatgatgcgcataatatgctactggttatgttaagatcaccctacactgcttatgccatgatcattgctttaactttttggattaaaatatgccgattaatgactatatttccaacatggtacacacctgagattctttctggaaggacacaatttccacggagactacaccgagtcactggcaatatttgccgatgttgaactgccttttgcccaagctacacttcatttttacatagcagggtacactaggaagtaaacaagctcataaatgactgcaaattaaacgttactggagatgaaattttttgtctatattgttactgcaagagctttcacctctgattcagatcagttacagacttgcagtgagttgattctacagaaagaggacaagcaacttttaaactagaaatggacggacggacgcctctttgccagggtccttagactgaagaattgaaatgaaggaaggtgcatagcatagcagctacacaaggagacgaatagcatcgggacgtgaaaaagaaacaaacacatgtaacatgtaacactgcaaaatcaaacaaattagcgccatgtgtccaaatggcagagctctgcagccatgcaaaatatgcaattcctcattcagaggaaagcatcctactagccccgcaaccacaacacctgtccccaacattcagagcaacctactgtgtctgtgtgcagtcagtcaattactgtacacaacaagcatctacagtagctaccaatgcagcaaccccctttcgatgaagaatcatcaaacaaacagttcatccttcaaccaggaaaaatattcagcagtcactaatgctgtagtactacgtacagatcatgtgaaacatatgtgttgtgttgcactgtggatgatggtttgatggctgaccgtgatgacctcaatatttgagtaaattagtcatcccaattaagctcccatacctgactgccaaattatttgttttgtagtagatcatactcaccaaaatggtttatcacgagtctgttttctgaccacatttttgtctagacagtctgctgcaagacggtagttgcccagataattaggccatgtttagtttctaaaaactttttcctaaaaccatccaatcgaatcttgacatatacatgtaatattaaatatagataaatttaaaaactaattgcacagttagggagaaaccgcgagacgaatctttggtgcctaattagtccatgattagccataagtgctacagtaacccacatttgctaatgattgattaattaggctcaaaatattcttctcacggtttctagataagttatgaaattagttttttcattcgtgtctaaaatcccttccgacatctgatcaaacgtccgatgtgacactcaaaaaaaaatttcttttcggcccaacctgactgactgtcgattagaccgactgacgtcttctgtcaccaccatgatgtccgtccagcttgttcacattcctcagcagacagacatgcaatcacaacaattaacactaggtttatgtaccatatagtggtccatgatgcagaaatattaatattctcaactctaaattctactacaaaaaaaaagagtgacatgttgcttgtag

SEQ ID NO: 17456 - DNA, 1492 bp, Oryza sativa
aggtgctagagtgaagataaatcctaggttgccagattattcaaatattcaatcaagataaaagaaattccaagcttttccatctaacatctccctcattagaccagaaacatgcttgcttgcaagctactccctccgtattttaatatatgacgccgttgactttttgacaaacgtttaaccttttgttttattcaaaaaatttatgtaattatattttattttattgtaacttgatttatcatcaaatgttttttaagcatgacataagtatttttatatttacataaaatttttgaataagacgagtggtcaaacgttgattaaaaagtcaacggcgtcatacattaaaatacggagggagtacctgacaatgcaaccgtccacggactgattgcatatcgtacaaaaatttctgtaacacaaaacagcactagtcaaacctgaagctttcatggaaccaaaccatctctagaatgagcttgcactccaatttgttataatatccaataaagcacacactctctcctggtattactgtagtaatgatcaaatttcaatgttcagaagaaacaccattaaatcatgaattggatttaaaacatgtgtccttccatgtaacatagtcctacagagacagctgccaacagcagtcgatgcaaacttctggttttcatttggtataacttagaaaggatgaaatgtgcaaagatattgcaaatagaaatggatattgtagaatcaaatgcgaactgtttcagagctgtccacaagaatagatataatatttctttataatactaacagattattcccaagtaacaaaacagcatgcagatcacatgagagcaatgcaatgacgaaaaaatcattagtagagataatcctatggatatatatacaatagagcactactaattgcacgttccatttccaccactgcgcactacttgatttttttttctttcaggatcttctgatgttacaaataattattcccaggttaaaaagaaaatagcatgcagatcacatgatatcagtcgatgaccaaaaaaatcacaattagtagatagaatcatatgaacatgtatacatctctagtagtactaattgcacgttgctaatatgaatatcagtcctcccaccatagcgcactagttgatgttttctcagtatcttctaatattacaaataaggagacccccaaaatttaccatgttcttaaatgtcacagtatccataattaagtctgcattcattttctgaaatacatagtcatcatcacaataatttgaccttatctctcttagatctttactgattccccttccaaaacttcttaaatattgttgaacgtcatcgccctcaacagtttttgttggttcatgagtgaaggagaaacaagaacttctgccttttggtgtgtcaaagccatcgagatcatcactggagctatttgtagttcttgaaacgggggtcatcatagtatgac

SEQ ID NO: 17457 - DNA, 629 bp, Oryza sativa
tttttacatatattatgttacattacacaccatcgattcaccaaaaatcaaaatatgaaagaaaaaaaggaagagaactttttaatcggttcatacacaatcagattcattcatccaccgaatcctttgaatgccaaatcgccaataccaccttacctactgatgatgctgatctactcgcacgacgaggccgaatcaaatccacggcgatcaccggcggccggtgccggaggaggtgtcggaggagcagtcgcattcggccgcggcggcctccacctctcgcctgtggaagctctggtggcagccgcaggcggcgcaaaggagcgcggcggcggtgccatcggcgcccgacgccatgaactcccggcagccgtcgacggcgtggccgccgatgctggcggcgtggttgcgctggcactccctgtaccgcaccaccttgttgttctccttcctccccgccgccgccgccgccgccgtgctgccgttcgcgtacggcttggccgccgaccggtcttgctgaggccccatcgatgatcggtcacagatcacacctcgccgccggcgagcgtcgacgacgttaggtggcgaggaggagaaagggaaggaaaaaaaaagaatggaaaaacttt

SEQ ID NO: 17458 - DNA, 394 bp, Oryza sativa
accaacttttcagcaaagattttaaagaacaagtttggtttgcgcagcaggttcagcggcatttagcacaattctgagcagaaagcaaaacgtcaagaaaccaaaactaactaaataacgctgatgcttatctgcagatgtcaataaaatcggtggataataggctaggtgagcgactggagaagcatgaagagggtgagtagggtcagtgtgcctgccactgtaacaccgtgaaatggatggtatctggttggcgtccaatcgggcgtcgcgagcaagcgacactctgaaacgggacggaaggagttggtctcggagacaagaggcatctttttatcttgcaatcgattgatctccgcctattctttttctgttgctagtgactagctgatgg

SEQ ID NO: 17459 - DNA, 659 bp, Oryza sativa
cagttcagatgcggcagcgacatcggagatttgcaaggcggcagatgtgatggtcaaggaggtggcggcgcgcgcggatctgatacaggaggggtcggcggaggaggaggcttaccgacctcctgttctgattccggtggcaacagctagggactttggcggcagtatgcgtggattgactcaaaggtatcttcaccttgttttccctacaaccaatctgttccccttatgcaatgagagatgctttcaatgacgtgtgtagatcagatgcactgggtgcggttgcatcccaaaatttttttgattgtactgcatagaatatcctaggttaatgttattcggtgttttgtatctttataatcatccagctgttatatgtcggtcagtgttaccaatgttgaagtaatgcgggttagctgggttttacattttgttttgtgcaaaatttggcatggagtgagaagggggttatgatgacatgtttcaaataaaataaattagtgttaacaaaaatccaagcagttttaaacctaaccaaagcattcctttctgttttgttgcccataggtatattctgaaattagaaatttttattgagtataggaaacaattataaactgtaagaaatttgatactgaacatgcgaattttatttctca

SEQ ID NO: 17460 - DNA, 669 bp, Oryza sativa
tggctttaatgtgtttgagtgacgtcttatcagcccttctttcaacatcctatgaagcgtgctttttggtatacccgcagctgatgcaaatgaccgtaatgtgccccttagttgcaggggggcattagcaacatctgacaagtcaatttcattcttcttgcgaccagaattagttttctttctagaacttacattgactggaattccctgtgcacggcactgctttgctcttcgccaaatatcttgcactctaccccttttgatattgaacatttcagcaacttcagttgttgctttttttcttagtcttccattgatagttttcttaaccaatgcatcatatatctcttgcctttgtatgttggtaagatttttgtttggatgttcatcttcctcatctgaatcatccaactcctcttgttcaaaaacaatttccacatcaccagcatacacaccgtactcctgcatgtctacaacaacaattacaaggtgagtcgtctgtaccaatttagatggtggatattttattatcatggatcaacatggttgtaaacttatggctgattttagatttcagaaggacatagaaacattgacacaatttactttatgtgctgaaatgtcaaattgacagtccataatttgcaactaatgcatccaatgttatgg

SEQ ID NO: 17461 - DNA, 469 bp, Oryza sativa
tcccggtttccaaaccgggagtaccaatccgggactgaagatcgctatctttagtcccgggtgaaataaccgggagtaaagatcgatctttagtcccggttggtgttaccaatcgggactaaagatcgagctgacctttttttttttcatggccctgttgctgcatggtttatatatatatatatatatatatatatatatatataaaccatgcatatatatgtttcaatacatatatatgcatacatatatatatgtatatatatattatattatattatatgtatatacatgcataatatatatgtatttatacatatatatgttatgcgaatgcatatgtatatagatatatatatgaccaaaatatatttacattatagaaaatgtgtacacatgcatatagaaacatatgtagtcatgtattaattacaatccattatatgtcctagctagctacgattttgac

SEQ ID NO: 17462 - DNA, 729 bp, Oryza sativa
tcctgcagcccagagcagcaaccaaaaaaccagccggcctgagctcagctgccatttccgacatcgcggcgggcgaggagcagcagctgtgcggttcacactgcctccgtggtcccggtccacgacgcatccacccatttaaaccccacctcccctctcctccgcctctcgccatcgccatcgacgacgacgacgacgagctcgcctccccttcccttccctccacggcgcgccgcctccgcgacaggtcaccctcttcccttccatccaaacgagctcggatttaggatggactcggacgacgaggcggcggctgcggccatggcggcgcgggcgcgggagacgctgaggaagagcgcgtcgtcgtcgtcgtcgtcgccgtacgcgcgtagcaccgacgacggccccgtcgcctccgcctcgtgcgacgcgcgcctcgagcgctgctgccgcgaggttggcgccgcggtggcggtggtggaggagccggagcgggttgtttcggggggcggggcgttgccggagtttgttggtgagggagggggcgaggggatctaccgggtgccgctgcgcgccgcgatgcacccgggccgcccgccgccgctcgaggtgcggccccacccgctgcgggagacgcaggtggggtccttcctgcgggcgctggcgtgcgagccgcggcgccggcagctctgggcgggctccgagtccggggtccgcgtgtgggggctc

SEQ ID NO: 17463 - DNA, 1304 bp, Oryza sativa
ggtgatttcaactaccgactttacggtatcacctatgatgaagcaagggacatggtctctcaaaggagctttgactggcttaaagaaagggatcaacttcaagcagaaatgagggcaggaaaggttttccaaggaatgcgtgaaggtttgatcagatttcctccgacttacaaattccaaagacacctaccaggtcttgcaggtatggcctgtttttacttttgatgctagcggcacctccttaattaaatagttccagttctgtcacaagattcaaatgttcttttatgtgctgattaaattgacgcaactgctttggagctaatttttccacaccaaaaataattaggatatgactcgggtgagaagaagagaatacctgcttggtgcgacagaatactgtatcgagatagccgtgatgtattaacagcagagtgctcattagaatgccctgttgttgctaaaattacatcgtaagattctacaacttaccagttaccactcgttttgagaaggagaatctaagacacacatgttgttttgtcttgatcataatcactccctcatacataatttgatgttttattgctcttctggtaggtatgaagcttgcatgggtgtcacagatagtgatcataaaccagtgaggtgtgcatttagtgttgatattgcaagagtggatgagtttacaagaagacaggaatatggaaaaatactccaatctgacaaaagattacacagtttgcttcgagagtcccattttgttccagacactataatcagcacaaacaatataattttggaaaaccaagaacatgttgtcctccggataacaaatgattgtcaaagaaacaaggctgcttttgaaatcctgtgtgaaagccagtcaatcagcaagcaggatggaactaaatccgagtttcctccaagggcatcctttgggttgccgctttggcttgaggtatgcattaatatgtttatttgtttattcctgcattcatttttttcttttgtttagtcttaaaacccattgtgtttttcccttattaagaaaaaagaaaacccatagtgttacactctcagttgagtgttctatttctatctgtagtgttgaccattcttttgcttgtatatagaaagcctgttaagttcaaaaccatagaaagtctgtccattatgtattcagtttgcaagacctaaaataaaatttagctcataaatatagaagatatcttgtcattctagaatatgaattttggacaaccatggaacctatatactcccctcacataatgtaaaagaga

SEQ ID NO: 17464 - DNA, 1524 bp, Oryza sativa
cacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgtaacattctagcattccccttgttcctgaacaaatgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgtcttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaataagtggaaatgaatagtcctagatgcagaatacttcttctgattcttacacttattgcatggacaacaaataaaacccctttgcctgttagcttcggccactctcaaaaaatagtgcacgccgtcaataaactctttggaccgccggtcagcgtatatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgtaaaccttttaggcacctccgatttgtatgtaatcac

SEQ ID NO: 17465 - DNA, 3276 bp, Oryza sativa
tatgagtgtatgagaggtatgaccgagtattaatgatgtagtatatttttatataggtaactattgtatgaatggactattagattgactatagatgatttagagccagcaattggctatactattgaacttgctctaatggaatttcaacggcggccgctagctgatgaaatccggagtagattgccggtttggcgcggcccatgaaagagtgcatagtcaaggcacaaccaattctactctacagattacagaagccaaaccgccaatatccaatcaaaccttacaattcgaagaacatatttcttcttgatgtgccgcgttaacattggtatgtaccaatgaactcgcctattctacggtgaagacttaatattagtataataaatagtataaaaatgcagccatgcatggctcatggattaatttgcagctttgcgtctaaaaactaattatagatgcaaggaaattcacgataccaacgtactctccatctctaaataaataagtgcaattttaattaatcaaatcaagcatacagagtgaaaaagagacaaggggaagaaaacgaggagaagggagtgctattaaaaacgagaagaaaaaaagtaaagtacttcctccatcggataatataagacgcgtacgtattttaagattcaacctttaaaacatttgacgaacacttaatataatatgaaatgcattttatttgttaaaaatatgtcattagattgagaattaaatttacttttatatggttataatttcgttgctacaaaccttcaagtatatgagaaattattagctaaaaattagtttttgagaccgtgccaattttgaattataagatagagggaatagtagtaataaagaggtctaatggaccactctaaaactacattattaattagagactaatcttcaagttacaactatacttcctctattctattctaaaatataagtcacaaccactcttaacccaaaactaagaaataattattatcacattatagttcggattatcctaataaatagaatgcatgtacccaattaaattagaaatcttgatgattagcatttaaataataatattttaatggaaaatatgtgttagttaatgacatacatgcatgcacgtcttctattatgaaataactttaaaaaatagttgtgtcttatgttatggaatagaggagtacttatttagaaatggaggggtaaatcccagcctctatatctaggacatacaactagctaggataagacatgcgagtaaaattttatacttagttataaatatttaatgtttaggatgatatttgatcataagctacttaccataagtttggtattaaataaaaataagtgtataaaatttaatagggtgaatagctaattgagtccctcgagttttatcgaaggctcaatttgatccttcacgtttcattttgtccacatggctcctctaaatatttgctttggtttgaaatcatccttggcccacttaatatgccatatgactatttctagttaatatttctattagaaaatattccttttgcctttaatttgtatacaactatataccagaaaagagaaaaccaagatgaataaacaacattgcagatgtacttcccattatttcaacatgtgcacatatcgtatacgctttctagtacataatttattttcgttttacataatttactatgtattatctataaaaaaatcaagcatgtaatttttctcttatatatgtgaatgatggggatataagtgtcatttatcaagagagttgttggttcaaggatatgtttgaactaaaatgaaaacaactcgaaggactaatacgggtaaattgaaacattaaggactaaactgagcctcaaataaaacttgagggaccactttagctattcacccaatttaattggctgttgatggatatatatagcataaatattttaactaaatttgtatttataaaatttaactcttaatttacagacaaaatatttaggacttgaggaaatgcacaagtgaaatctcaagtttcaatcgtcgcttttatctcctcgcaacgggaaactctgcccaagttgaaagtagcccttggttagcactacgttcttgaaattgctgttcgccgtgaagaaatcgagacatctgctcctcagctctgggcagttgtggcaaccgtctcggcacagatcagagttgtggcaaccgtctctaccgacacgagctcccaaatattttgggcacacataagcttcaggctatccagtgcagacctatttgccgctgcgagaagcggctcaagcaggtcggctaaaccgtttaaacgattatccattaaatatttaatgacaagatgatacaagtaaaattttatagttagtcataaatatttaatgtttacgatgatatttgatcaaacttgttgaaactattgccatcagttttttacaccctccaggctgataatacttgtagttttagataagggtgaggtcaaactttagaatatttgattatgaattatttttaaaatatttattttcaaatatggtgactatatgtataaattagtattaaaaagtactttaataaaaccatatatttgttaacacttttatacatattataatgaaaaataatggacaaagttggtttttggagatcattcaattgtccaaaacgataagtattatcaacccggagggagtattattataataagattataaagattaataggctgtcgatggatagaatttaaaaaaaaactaaactaaaatttaaatagatcttattttacagataaaatatttatgactcgaggaagtgtataagattaagtttaacaatatagccaactactagctccaaaattaaaacattatctataaccaacctaatagtccacccatacaacagttaattgtatatatatgtaccacataagtaattaatgtctaatcaactaatctctctcatatagtttgtttgagcccgtactggagctgactataaatttgtagctcacttttcttcaaccttcatcacataaacaaaaatatgatacggtataacttatatatcccgcttaattttggccttgtttggatcctccgagctattaaatagccctccggaatcttgctatttagaagtattaaatatagattaccgacaaaactgattccataacccctaggctattttgcgagacgaatgtaatgatgtaggttaatccatggcgagtgg

SEQ ID NO: 17466 - DNA, 1871 bp, Oryza sativa
ttattgtagtatcactgtagcaaatcatagattaatatacctcgttagattcgtctcgcaaaatagcctaggagatatgaaataggttttgtcagtaatctatgtttaatactcctaaataacaagatttcatagggctatttaatagccctccagatctaaatagggcctttaatgtacttctcaaagaagtcgcaagtttcaatcctcgcttttatatcctcaataaccaacgggaaactctgaccaaggtgaaagtatccctcggtaaccactaccttcttgaaattgctgtcagccgtgaggaaattgaagcatctgctcttcagctctggacagttgtacactcggcacagatcagagtcgttgcaaccgtctctaccgacacgagctcccatagcttttgggaacacataagcttcagcctatccagtgcatacctgtttgccgctgcgagaagcggctcaagcaggtcggatgtacctaacaatggtggcaaaacgtccgtgtacacgaagtgtagcagagctttgaacgtcgccggctcgatgtcgtgcagcgtgacgcacggcatggtggcctcggccatggagccgaggagctgcgccctgaacaccggcgagcgcgcggcgagcacggcccggtgcgcgtggaacgtctcgccgccaacggcgaacgacgcgtccgagccgtcggcgctgccccccatagctccgagttgggcacccagattggggggcggcacggggataggattgccgtggacgtcgttgcgcacaaccatgaacccacacacgaatgtgaccgtgcctttgtcgctgacatgatccggctgtagatcactctgcttgacgaagtgacgccacccagtgaaccggagacccgatgctgtctccatgtttggccccatggtcctctttgcatggtgcgaggaaggtttcccgtctttgtccatcaagaaaacctcaaagataatgctgattttggggtcgatctcattctcatccagcagcaggaagacagagatgtacttgcaccctgcatgcgagtagaagtggaacacaatcgtcgcattgtgctccccggccgagattcttctttctggtacccattcgccgatgacagtcatccaagaggcttctaggtagtcaaatttgtactcgatgaaaccggaggacagcatggtcgccggcggcgtatgttttgttgcgtgcggatatcccaaaaggagaattaatttgatcatacgagagagaggacaatttatactaccgaaagtagcgatgagttgttcggtctggtgaggaataaacgacaggggattcagataaatttttaattaggatttgtaaacagatcatctccggactctggtcgattggtgataaaataaagggcaaaaaaaaatcgaagctattttcatccgtatcggtgagaccgcgtatgcgtttctgtctccataagccgtggccaactcggtgtcatacccagattgaaaattttccccaaaaaacagacaagaacaaatctcaaaaaatagcatctcaaattgcatttcggctcattcatttgcccaaaacagccataacatctaaacggaaaaaaaagaaagagcgatgcatccaccaatcatgtgcaacaagcaagcccaccggttgcagattggtgctaaccacttcgagatcgaaggagtggcgtggggaaggaggtcttctacctgcccgccgtcgtcacgcccatatgaccaaccaaataccaacacaaccaattctcagacgtgaatagacagtacaaacgcggaattattaaaagaaatgcacgaggtgcgacggattaatatgcagttttgcaacttataagactaataagca

SEQ ID NO: 17467 - DNA, 9398 bp, Oryza sativa
attcctgcagccctctcttcgataactgacggaaaactctgcccaagatgaaagtagtccttggttaccgctacctccatgaagttgtctttcgtcaccacgagatctatgcacctgttcttcagctccgggcagctgtgcatctcggcgcagcacagagtcgctatcaccgtctccactgacacgctctcccacagcttctgggcgcacatcagcttcagcctctccagcgcgaacctgtccgccgccgcgagcaaacgctgaagcagatcagttgtactcgtcgacgaagagccttcgatctgcagaacgtccgtgtacacgaagtgtagcagagctctgaacgtcgccggctcgatgtcacgcagcgtgacgcacggcatggtggcctccgccatggacccgaggagctccgccctgaacaccggcgagcgcgcggcgagcacggcccggtgcgcgtggaacgtctcgccgccgacggcgctgcccaccatggcggcgagctggctgcccaggttggacggcggcacggcgacatggtcgtcgccgtcgtcgtcgttgcgcagaactacgagcccacatatgaatgtgaccataccgtcgagtgattcgagatcgcttcgcatcacaaagcgatgccacccaaaccagtcgtagccatcctgggacgcccaacactgcatagtcctcttcgcatggaacgaggatggtgtaccatcttttccaatcaggaaggcctcaaagatcaccttgattttggggtcaatctgtttcagcatcacgaagaagagagagatgtattcaccattgccgtacccaaacccatgcgggtagcacatgatcttcgcattgtgctcccctgtcgagattgttgttgctggcaatctctcgccaatggctagcttgtggatttgttggtagtcaaacttgtactcgatgaaaccggaggacaccatgttgctactggcgtctatgggacctgaccgcctgagtagtagtagtattattatttgatctgctggttgacactttttcacggccaacacaagatcacctaacgatttacggtataattaacagagttgccaaaatcgatagatcaaaatcggctagcggaaccgatttcgagattaattcaatttcatggaatcacacagctaatttacgagcaaattagtaaagaagataatatcgtacttacgtgacgacgaacgactagtttccgagtaaactagcaaaggataacctcctcatttttatagagaagcacaaccgtttttcagcgcaaaacggtaaagatcaaccaaatcctaggattgctataactcaggcataaaagtaaaatagaaaataacggaaaagtaaaggaacgagaaaaatagcagatcggtaatgttcggggtcgtcctcgaatctaaaacccctgatatgtataagattataagggtatatgcactgctacggcgcagacgagaaatctacggaaacaaggtaccagaaaatcctaacaaataaactaccaaaaatatctatcttccactcctggcaaccacgcacatccacagcttcggcatgcaatcgatcagtacaggagccgagttgtctgctgtgaaattcaatgatccaagcatatgtctccaagctaagtcagccattatggccttccatcaattacgtatataatcccagtgcatcacaactaatcctgacacacataaatttgtctttccagcaaaccacttaacacatatagtacaagttattttagataatttggcctgctcaaataaaatcaactatgagccaaattatgacataaagactgctaaagagagaatttatagtacagcaatgcatgcatacgcatcgatgcaaagtactaggtggtgtttggatccagggacttaactttagtccctgtatttagacactaatttataatattaaatatagactacttataaaactaattacataaatgaaagctaattcacgagacaatttttttaagcctaattaattcataattagataatgtctttccagcaaaccacttaacacatatagtacaagttattttagataatttggcctgctcaaataaaatcaactatgagccaaattatgacataaagactgctaaagagagaatttatagtacagcaatgcatgcatacgcatcgatgcaaagtattaggtcgatgcaaagtattaggtggtgtttggatccagggacttaactttagtccctgtatttagacactaatttataatattaaatatagactacttataaaactaattacataaatgaaagctaattcacgagacaatttttttaagcctaattaattcataattagataatgtttattgtagcatcacataggctaatcatgaattaattaggctcaatagattcgtctcgtgaattagtccaagattatggatgagttttattaatagtctacgtttaatatttataattaatttccaaacatccgatgtgataggaaattaaaagttttagtcccatctaaacagggtctactccctccgtcccaaaaaaagataaaccctgggtttccatgtccaactttgactgtccgtcttatataattttttttaataattcatatttttattgttgttagatgataaagcatgattaatgctttgtgcgtgacttgtctttttaatttattttatatcttttttaaataagacagacggtcaaacgttggacacgaaaatcaaggtttgtctttcttttttttttacggagggagtaattagtaacgctttggagttccaaccgcggagaggagaagatccatgatgtctccatacaacgcctcttccaaagcgtcgagaatgtgaagacgacgacgcctggacgcctggtgcgtgtcagtgcgattgatagtcaaaaaacaaatgaaacgaaactgcggatacacaccggattctaatcactatagagtaaaaacatgttaactaaatggttataaattttttaaaaaatatttgataaaataaattaatatgtaatatacaattctacaaacatgcatgttcaaattcaacttctacaaatatataactaatataaatattcttattttttcgttcgtcacctcatatgtgcggtgatttttttgtccccctcgcctctcctaaatcttagtcggaattccatcaccccgacccaaaaaaacttcccaatcagaattcaatcaatcacacaaataaaataaaatcggaggaagcaatatacacacacaaatatatcaaaaaaggatcaaaggggaggtcgccgtcgagccgccaccgccgccgctgggacgctggcgggctgtcgatgcctccctgggcgccgcagcccccgccgctgccggttgtgggggagccgccgtcgccgctcacagggggagggcggcaccgccactgctcgggggggggggggggggcgccgcccccgcatcttgggctcgggggagggcgctgcccccgctgccgttcggggggagggcgccgctgccgccgcttgggctcggggggagaggcggcgtcgccgccgcagtcgctcggggagagaggcgccgccgccgccgccgctttgtcacgggagcatcaggggcgcggaggggagggcggcgaagcgagagaagggagagaaggaaatgggctagggtttttgatggctaaggagagggagggggtttttgtttccccgatctcgacgctcggccgtccgatcaaaaccctagagatcggacggccgccgtcaaccgggccgaaatgggcccaagagggatcgagagcgaggccacttttccggcccaagcctaggttgcggcctggggaggggtagagcgcccgcgcatgcgcaaaaggccataggccgaccggcaagggacgaaaagaagtctattttaggtccctcgggccgaagaaaaagattcagaagcatttacaattatagttattgaatgtgtttatttcgaatcaaacctaaaatgaaggattttctttctttttccaattaaataattgttaaatgatgtttgtattattaaaattaacaattaagctctaaaaattccaataaaattctaaagagcgtaactaatcatggagaatttaataaaattaaatttaaccatgttattttatttctcacatttgctttacttgtaaatttatttaattatacacatacctacttaaaaataccaaatatgtcaataaatttgtatttaattaattgcatatttttctgatatgtacgcttccaaattcaatatttttgtgcacatgtgttataagtacaaagcaatcttaagcatccatgtttgtttgatattcacccggtgcaacacacgggcatatttgctagttataacaaaaataacaaaattaattgttacaatttatagaagttgaattttaacttgcatgtttatgaagtggtatattacatattgatctatcttattaattattttaattttttttcataaccatttagatgacatgcaataaacgggtggacatccacctaggtgattaaaacagtttcccgatacacacaactattagttgctaataattttataagctaatgtatgagtgattttgtactacttgggaattaccgggagatatcatattttttatataaaatttggtatatgagcatctttgatacactataaaaaaggattttttttcataccgctaaaaaatattttcacatgcaggtctttgatccgtctgcatcaggtgtatgtgaaaatcacccgagttcaaatcaagagatcgcaaaacttagaaaaaaaaaacataacagaagagcagtcaacgtggtagctagagagctagtacaagatatataaatatttcagctacaatttctcaaccctcttcttcagctcagcaacaatgaccgggaatttctgcatgagcagtgcaaaaccatcggtgaacacggccttcctgaaattctcctcgacggcaaagaaatcgatgcacttgttcttcagctccgggcagttgtacatctcggcgcaaaccaagatcgcggcgaccgaatccggcgtcatgttgtccagcaacctctgtccgcacatgatctttagcctgtccagcgcgtacctgtcggccatggcgagcaggtgcttgaagaacacgttcgtcgacgaggagccctgatggagtttgccggcgtctgcaggcaactcgtccgtgtagatgaatcggagcagagctctgaatatcgccggctcgattccctgcagcgtaatgcacgacgacgacggcgaggtggattcggacttgcagccaaagagctccgtcctgaacaccggcgaccgggcggcgagcacggcacggtgagcggcgaacctctcgccgccgccgccgacgacgacgaaggtgacatccgcaccatcctcgctgtccagcaggccgccgagatggaccccgatgttcggcggcggcagcggcaataagccgccgtcgagatggccgccggtgacccccggcgacggcagcggcacacggttgccgtcgccgtctccgtcgtcgtcacgcaggacgacgacgacgcacatgatcctgaccttgccatccaccacgaacaccgatgacaaattgcttcgcttcacgaatcgtggccatccccacgcgggatagcccgcgggtgggtagacctgcactaacctgttcgatccatcggacgggttgccgtgttcatccaccatgaaggcgtcgaagatggccttgatgttcttggacttgctgatcagctcgaggtagagcgagatgtagtcgccattgttgtctgccttgtcgccgcgcgggtagcagttcaccctccaggttagccctccggcggtgaagaggtcggagttgatgggatcgccgatggcagaggcgttcgtcgccgagtaatccagtctgagctccacgaaaccggaggccggcgccatgctcgatcgatcgtgtgctgagatgagacgtacgtgtgatttcagcagaaagactgagaaggatagatagatatcgaacgaacgccaatgtgtataccgtataatgccgatgtgatgagttatatatatgtattgtgatctctttctctaattttggatgtgtcgatcgattttcttattggatagtacaaactcctatttcggtatttccataataagaaaatcgatttgtcgtgtcgatcgatttttggatgtgtcgatcgatttgttgtgtcgtagtcttattggattcggatacatgcccggcacatgaacatgataagatgaattttgcagtcctttagaaaatacttgagatacctaaattttgcactataatttttggtaccttaagaaacttattatagtatctagaggtatcaaattttacactagaaaatagaaaatgcttctcatcgaacgttcgaagcaatgacaaaaatcggacaggcagcctctgacacacatacacatatccaagcctatatctctacctccaaccatataacatgcacctttaacgatatttaaaacgatttttctcttaaattactcatctaatctataatctgatcacaccgttgtattcgttgtaattaaatctttacaacaaaatgtcgcatgattatattccgataaaaaataatcatatgtttcaatccattaacactttttgtttcatacgtgatagatacatgtttcaatatgtgtcttcagcgtctctcctctctctccacatgcatgcattttagctagtttcaaaacgatttttctcttaaattaattatccaatctacgatccgatcacaccgttgtattctttgtaattaaatctttacaacaggatatcgcataattatattttgatgaaagaaaaacatatatttcaatccattaacattggttgtttcatatgtgatagcgatatgttttaacgtgtatcttcaccatgtttcataaactttttaaatgtttcagttgctgattttttttaaccctatataacttgatatttcactcgttagttaattggaacatttgactgactgattctttttttttttttgcatattgcatacgtaggtggtgtgatgacgcgtaaacagtcgggcgtccgatatttggtggaatatcggacgtccgacacggagtcgtctccctagaatatatagcatctctaagtatcttaagaatgataaaaatacccaattgataatatggtcgattccaggcgcctggtggtatatttggaaccaaagaaatgcatgaagcttccaacaaaccccaagatcagctgatgaagtagttggacaaattctgatgaaaagcaagagcattcagctagtacatataacacccccaatataattaaacatgataaaaaaaaacaagttcaaagccagacataacttagaaaaaaaaaacataacacaagtgcagtgaacgcgatagaggactaaaagatatatatgcagctacggtttcacaatcctcttcttcagctcagcagctatgagcgggaatttctgcaccagcatcgcaaaaccatcggtgaacacggctctcctgaaattctcctcgacggcaaagaagtcgatgcacttgttcttcagctccgggcaatcgtatgtctcggcgcaagccaagattccggcgactgaatccgacgtcatgctgtgcaacagcctctggccacacatgagcttaagcctgtcgagcgcgtacctgtcagccatggcgagcagatgctggaagaacgcgcccatcgaggagccctgatgattgagtttgccggcgtctgcggccggcaagtcgtcggtgtagatgaaccggagtagagctctgaacgttgcagcgtcgatatctttcagcgttatgcacgacgaggtggattcggacatgacgccgaacagctccgccctgaagaccggcgaccgggcggcgagcacggcacggtgggcggcgaacctctcgccgtcgacgacgaaggagacgtccgtcgtcccatccccgccgttttaggaagagcgataagtaatcaccattgttgccctccttctcgtaaccacgcgggtaatagtctacactccaggtgaacccaccggccgagaagacgtcggaggtgagcatgtcgccgacggcgtaggcgttggtcgccgaataatctagtttgagctccaaaaaaccggaggccggcgccatgttcatggtggtggcagatggacagtctgcgagatggggagatagatcgaaaagcaatgtatacatatactaatgagtaattatgagtatcatttttctgttttttgagatccgtagatcgattcactttcctatacggaaatatatctaggccagttcagatgcataggcgcatcaccactgacccatatcgatgggactgactaggtgactagggctgtgttagggagtgaggttgggaaccctctgcttcgcacgtaaaacggagcagcgtttagtgtatgactaattaagtattagctaaaataaatataaaaaatagattaatatgatttttaaagcaactttcatataaaaaatttttataaaccgtttagcagtttgaaaagcatgtgcgcggaagagctggagaaaactcagcgtaggaagaggagttttagggtgagtttgagatgaggggaaaagagacgattgagaagatatgcaaaacgaggtaagccattagtacaagattaattgagtattaattatttcaaacttcaaaaatggattaataagattttctaaagcaaattacatatagaattttttttttgcaaaaaacaccctatttagtagatcagcatgctttctccagctgccaaacgcagccttagagcaggtacaatagcaggctataagccagctataaacatattttaaagagataaaggaagagagagaagaacaatgggctacagatttgtaatcaggcgtagcatgaaatccaagacgtaatgtgtgtatgacaggtgagactaggtattaatattatagcaagtagctattgtataaatcggctattacttcctctgtttcataacgagagttattctagtattgcccacatttatatatatgttaaatgatgtgagcaatggtagaatgctttacattataaaacggagggagtacattggctatgatgatttggagttaatagtgggctatactattaaaacttgcttagtacttgagaggggaggtatcaaatctcagccattgattaaggttaatcggatggaaatgattgatcggtacctgttgcctgttggtactaacgtcgttccgccgcggggtacctagtggttggtagggcagctaagtaatttcgttgtgtcatgg

SEQ ID NO: 17468 - DNA, 9904 bp, Oryza sativa
ccactatatatgtggtttgcattacatattttcccactcatttgtccaacatcttaaatggtagaccgacacattatgccttaggtgacaattttttttttgcacaaaacatctcaaaagcaatatatctctctctttttttttctgcatgggatatatttgtcatttacttgcttgttgcaatctatgtacagactggagactctgaagaagcatctaccagtatcagggcctgaggggctgaatgaacttcaaaagttagcagtgcgatttgaagagaaaatctatactggagccaccagccgggtacacttagcctcttgctaacttcctccggttgatccaatctttcagttgtggggctcaagcatggcatttgggatcttagtagaagaaatcgatcttcaaatgtttgcaaatatgtctgttgattttgaagtttgttagagtttcaccatgaagtatccactttttttttgaaccgatggtaatatttcacacctccaccagattatccaaggctgctgaaactttttccttccattttatcggtagaaaatctcctttgcgccttaatacggggactaagactgattcagtcctatgctagaggtgttgatgtccccacatcatttttcattaataacatatctcaatagtaaattagtaataatgaattatagaactaaacaatatttttaccatgagactggtttctctcattggccatgttaaaagtacaggagttgtaccttgagttctgtaagcccatcatttcatctgttcatgcttgtataaatcacctgtaaaatattccctttatccgagatgaaacatcaaacaatggtttactccagtccttccttttgtgttagtacttcattttggtaaacatttttgtaggagcttccttggctgggtatagggtttcataatctccatattccaattgttctcctgttcatacttcatcaggcttattcatgccaaagtagcttgctgtatagataagaatttgtataatttaaatcatagtataaaaaaacgaagcatatgtttcaattgtgctaaccaccaggatttagggtggcaagttatttattacaaagccaaatcttaccattgtattcttttgcattaccagtctgattacttgcggaagttgtctctaaaaatgctctctttggagacaaagactcaacagagtcctggaaacgcccaagtgattcaaaaccaaaatccccctggctcaggtatcatatgacgtatatccaatatccgattctgaaatactggagtaatagtaagatatttggtggtaccatattttgttcaccttaagtttttatctctatctctactattataaaaattgaagatgtttttgctggtattttggtatgtcattcatgtttgagccggtttttaaattcgtttgcttttggaaatacatatccatgttgagtcggattttaagttcgtttacttttagaaatacaaaaggagtcgtataagaaatctcattaaaaatacttgcatgttaacttgagatgaatgtcaaactcctaattgcagcacatgattttctagaaaaaaaatatctaagcgaattcccacagtaaattttaccctagccaaaccgtataacaataataagattaaaatagtattcacccgttgcaacgcacgggtatcttttctagtgtgtgtctatatatatatatatatttatgatgtaactatattgcatttaatggtgacccatgcatgtgtgttgacaaccccatttatgataggaaaccatctgatggatgctgtcagtggcaaagcttgggctctgccatactgggaagtacccctccgtcaaaaaaaaaaagtccaattctagctacgaacctggacatgcgtgtccaaattcgtagctagagtttgccttttttttttggacggagtagtacaacattacaacagtgctctctcgttttagagcctgtttagttaccaaacaaaatttttcacgttgtcacatagaatgtttagacacatgcatagagtattaaatgtagaaaaaaaaacaattatacagtttgccaggaaattgcgagacaaatcttttaagcctaattgcggcatgatttgacaatgtagttatagactacgtctaatacttcaaatatgtgttcatatatccgatgtgagggtcggccctgggcctaggctggctgggggcccatcaccaacccccaacccccctcccccagcagcccagcccagccatcagcccacgcgcaagccaggagggagggatgcagaaggccgcgacgccacttcgctaatcgctagatcgcttcgttttctgtttttctcctcacgaatcacgattccgcttccacgagtgactccctaactccgcgaccgcgacgtgtctcctctccggctctccgcgtcgatggcgccaggtcgccgggcgcctggccgagtggccggctggccaccggcacgccagggccgcctctatcctctaatcgccaacgcctgaacgcccaagcctctctgagcctcacacgcctctccccgtctccagtctggcagtctcctgttgcggtgttgccggccataagcccttggcaaactgaggttagttaggtacttaggttaattaggcaaacaacaaaccgaagtttcttgcttggcatcattgtatgatttttccactcgaaaaattaggttagttaggctataattttcatggttattgctgtataatttactttacaatatatatatttactatttcaggtgttacaatgttaccaaaaaaacatttgtcaggtgctcagaaaagaaacaaaagaaaacggggagatcaattaatcggttcacaaaagaaatgatttcgcttcaagaaatacgtgaagaagctcttttttataagggatataggatgtttgtggtctcctattaatgtattcatactactttgtttctatagtgttttttagttgtcaattatactatcgatattatttatcgataataaattgttgtattgcaacttgcaaactatttgatttactatttaccatgttagaaatgtttatttgtgtcactatatagtatatgtgctttatagagtatatgtattagaagtaaaaaatatttagccttaatgccttaagggcccatagtgtcgagttctcctagggcctctcaaatgtcaggaccggccttggatgtgacatgcaggggcaaaatttttgccaactaaacaagcccttagcttgtaccggataatgctcaagcaagtaaattaaggcaaaatgcctgcaagttaaaacctccaaacttgttgatcactcgaacctaattaagtaattaagtaatgggactgtctatgtgggatttgcatgattttttagacttccatcatgcagtgtttcaccaagtagatcgaaaatgtttcaatcttttaaaaagctgtacaaaatcaaatcaccctatgatatattttactacaacgtatgaaacaacggttccgaatatattgaaacgtaaaacaaatccgagtacatcgagaaagagtctatatgggattcacatgatttttttaggcttccatcatgtagattttgaagccaattaggcgttgtttcaccaagtaaatcaaaaatattttaatcttttaaaaatatgaatcataatcaaatcacctcatgaaacattttactacaataaaacaacagttctgaatatattaaaacatgaatgatttagctattaaaaatcattcgacagccatttagccttctcggggatgattgctgatcctgatagcaaacacacctttcggttgttgctggccacgaacccttgcgtggtcagattcaaagcttttgggcaccaacatcaaaacaaacgaccccttcaatatgcttgttctattagaggatagatcagccatgcaatgtagaaaagcaaagcaaggctcacaccatcacgtctgctgccagcagcccaaagaccaaagctacacatagctttctagcacccattatctttttttgttaatcaaagactagcatcatagtctagcccattggcaatacacaatcacttcatcgatataatccatcttccttcaccatcatcggtaactaggatggaagtaaatcactcagtcctaacccaagctcgcttcttaattttcttcaaactccgaatgaaatgattttaaataccccagtaaaatcatgcgctactataaggtgatcataacaacgaagaaatagttaacaaaccctagaatatgtactgattggtccttaactatacgatgattcaaagtgatgataagagacaattatcttaggctgggtttagttcctaactttttcttcaaacttccaacttttccatcacatcaaaactttcctactcacataaacttctattttttttcttcaaactttcaattttagtcaaacttccaattttggcgtggaactaaacacacccttagttcgttagattaagagcaatcaatggctctaatgtatgccaagcatagtagaaagtctcccaggggatagtattttctacggcacctaggtatatgtatgttgtttacatagttatgtaaaaattttataaattttgattagtagatctttatctttacccttttacctccttaaaaaattcgtagtgtttctgtcgtccaacgtcaatagttttcccaataaaataaataaaaaggcaaaaaacaaattaaagtccgactccctaaaaaagacgaaaacaaaaaagaagggctaaaaaaacttccaaaaaaataagggccacgtacgagtatgggccagaaacgtgcacgagttagtctgatggcgcatacgcgctaattagcaattttgaagaggttgtgtgcatgggtgctcaccaagggtgtggcagaagcagtaggatggacaccggcagcgtcgctgttgtcaggatggagactaccggcggcgtcgcgggtgaagacgcggggagttgaggccaccaggatcgacgcgctgagggcctccccgcctcctccccctccgtgcaacgatggctgtcgccctccacccttttccccgccttctccctctcctcgcgcgcacgccgacctccccgtcccgttcatcggcctccccacccgatggctatcaccctccgcccttttccccgccttctccctctcctcgcatgctcgccggcctccccatcccactcgtcggcctcctcgccccctcgccggcctccccgtcccattcatcggcctccccgcctcctccctctctccgcgcatgctcgccagcttcccaacccgatggttgccgcgcctcgcccttctccccgctagcaggcagcctccgcccttcttcctttcggtgcgaccttgtcaggcggcgagggagctcgaggattaaaagatggccgggagggagaagggagaaggacgtggtggagatagagaggagggtgggacccattaacatgtgggtcccactatttttttccttttgtttgaccaacatgtggaccccacattttgtttttatttggtacctctaggtactaagtatctcaaggtaccaaaaattttaatgtaaaatttaggtacctcaaagtactttctcaaggactgtaaaattcctcatataaaaatattattttctttgtttgataaattatttaaatgtaatgaactttgagtatttctggtaaaaagtaatgatattcttaattcatacaaactccaaactttgatcacaaagagacatgtcgattgccatcaatgtggatatcgaggaatggactattaatttgagtagaaataaaatgagaaaactagagcctgacagtacaggtcctgaaaaaggcaaatttgaacggccagacaaaatatcactccattacattgatttagctctcagcaaacctctgatctcatccttaatcgagggaaaacgctgcaccaattgcacatagccctcagttagcacggtctccttgaagttcttgtcctgcacgaagaagtcaagacagctactcttcagctctgggcaaccatgcatctcagcgtggatcaatgtcgtcgcaaccgtgtccactgacactgcctcccatagcttctgcgcacacatcaactttaacctgctcaaatcatacctatcagcagctgcaagcaatttctggaatagctcatcggtcgccattgctgccatcttgagctgatcaccgccgtcgtcggcaggcaacttgtcggtgtagatgaaccgaagtagagctctgaacgtcaaaggctcgatgtcgtgtaaagtgatggaggacatcttggactccgccatggaaccaaggagctcggcacggaacaccggcgagcgggcggcgagcacggcacggtgagccgggaacgtctcgccgtcgacgaggaaggagacatccgtcccttccccgcggtccagcaggccaccgagatgggcaccaatgtcagacggtggcacgggcacggtgttgtctcgtatgacgatgaccacacacatgattctgaccttgccatccaccacgtacgacgacgacgacgactcgagatcgcttcgcttcacgaactgtggccatccccatgcggtatagccattggttgggtgaacatgcacgcccctgtctgcgtgggtggaagatggctcgtcgtctttttccaccaagaaggcgtcaaaaatggccctgacattgttggaagtggattcgcggaccagctcgaggaagagcgagaggtactcaccgttatcttctttactataccactcgggtagcaccttatcctccatgcgtgtcctccggcaggaaagacatcagagcggacgatgtcgccgatggcacagttcttgttggccgccgcataatctagtttgaactcgagaaaaccggagtccggcatgtctacgcagacgatgcagctgaaaccagaacgcactcgagagagtacggagtgtaggatcgaacacgagtaaccaagcctactagagaagggtgaatagttgataaaaccaaaaacccaaaaacttttagcggaaataaaagttaccctcaaatcaatggagaacttgatgtagttctatcgctgctggtcggaccgctcgcacgccgccggtctaaccaccgcctggtcgctggttgaaccgcctccctgccactgccgctggttgagccgccgatgtgaccgcccgccggttagaccaatgaatcgcctccggtcaaaccgttgggatccagaaaaacacgtatcgacgaaacacttaaaagtatatcaactttattgcatcaatatatgtttacaaagtgcacctaaggtactcctctctcaactcacgaactaggattgaaacctcgaagtaaaccctaacttttctctaccaaaaagtcaatatccatttagtctcaacccctcatttatttataaaaaaaaactctaggactcaatacctcaatttccaaaccttttacaatttaacaaaactgcagccgcaccggccacaaacaatcacaccgagtcggacttccttctctgtctcatgctcggtaacctgcgcacgcctgattcatctccagccgcacagaccagctgggccgatgccttgctgcctctcgacgtgggccacctaggctgccctgcagccccccgcatctcataccaacgtgggccgccagcaatccaagccagcccaaccatccaggccgacatccacagcacacacgacacatgtatgctacagtgtaccgctacagttcatagtgtactgtagcaaccatgtacttgacatatactacctccgttttataatagatgacgccattaactttttctcacatgtttgaccattcgtcttattcaaaaattttatgcaaatgtataagatataaatcacacttaaagtactgagtgataaaacaactcataacaaaataaattataattacgtaaattttttgaataagacgaatggtcaaacatgtgagaaaaagtcaacgacgtcatctattaaaaaacggagggagtatatgcatgctccaacagtacctcgccgtactgtagcatcatatatactccactccagtgaagtgagcatagctcaactggttaggttccttgtggtggaactagcccacccgagttcaaatcctagatttgacacgggtgctcgcatttacggctaattattctttcagtggtaggcgacgtacccgtcgacagcgaggtgctcataggggtagggtgtgcgtgtgtgcgttcatgggggtgagtgtgcgcacgttgtgagcgcctgcgtttgtactgtgtttcaaaaaaaatatatactccactccaatttctttcaatctccttcacgaacaccgacgcttatatgcacaccttgtgaaacctgttgcgaagatctctcccacacgatgtccatccatggtgtgccatctcgtatccaacttcgttatccggtatctttgaccgtctggatctcaactcctccctgagtctagtcccggtccccagcgttaaccgaagttgatctctaagaatactgactctagtcaccttctcacatggtatctcaacagcactagacctaatctgctcctccctgagtatagttccggtcctcaccattgaccaaggctgacctcaggtcacctgcacataatcagacaaaacaactgtttctaagcacagatatcacaacctgacccacattagtcccacgcattcacaccaacattcatacatattttcaaaccaatttattgattaaatcttttgtaaagccaattattcatcacaaatattaatggagatgtatctattgaagcatcgaacaataatcctgatggctttagggcaagtactataagggcaagttttatgttagaggtgactatcacatctaatattgtccacatcatcaactaatttattaagggcagctcacatactagtctcaatgcaacataaatatttattttattcactcttatccaatcaacctcactcttttctccttcctccttgaagtttatgaagaggttaccccttgcatgaggggtggctcatcctctctctcatctactctctcctccacatcatcatttaaaattaggtggcatctaggtgattgtgcttaaatgcctatagtacttgccctaaggttctaagcacaaactccaaagtgccatgtatgcttaaataatgatgtggaggagagaagagaagagaggggaggagccatccctcatgcaaggggcaacctccacacaaatttcaaagaacaagagaaaataagagggctgattggtggcaagtgtattgggactagtgtattaaatgcaatgcatttatataagttaattttaattttttgaatggatgatgtggataaaattggaggtgaccaccacatctattataaaacttgcccttatacttatactgatcaagtgatcagcagtgatttactccacctcgaaaaagaaaattgatcagcactgagatatggaactcctcgagtttcgagtagcagtaattctcattcttattcatcaaaatgactagcagcgctgctatacaacaagatcattgttttactagtactgcatctgtgtgatgtctaggtttgtgctgaactcttcgatcaccttgacccgatgctcgtctcttcggttcagctcgcgcgcttgttcgcccggcgtgcaaaccagacgtggtccagggggcatctaccaggccttggtccgtctacgggcctgtctaggagaagcccagctttgcacgtccaggcccatggacaacacgcacaacctcatataaaggaataagttcatttgggtccct

SEQ ID NO: 17469 - DNA, 3892 bp, Oryza sativa
caaatttgtaaattctcaagtcaagatttaaaaactttaaactcagatttgaaaactttcaacttggatttgaaaattttcaacttggatttgaaaattttcaatatagacttgaaaactttattcaaatcaagatttgaaactttcaaatcaatatttgaaactttcaactcggatctgaaaactttcaactcaaacttaaaaaaagtttaagtcaatatttaaaaacttttaactcaaattttaaaacttttgcctcaaaattcaaaatattcaatttaaatttgaaaactttcatcttaaaattcaaaacattcaacttaaattttaaaaaaaatcaattcaaattcaaaattctcaagtgaaatgggaggtaaagatttaatttataaaatatcctaaaaagaatcacgcatgtggagaaaaaaaaggaaagatttacccaaaataacaatcgccagaagaagcgtaaaaaaaggaagcgatggggtaagcgcgagtgtgtgggtcgcgtatgagtatgggctagaaacgcgcgcgagttagtctgatggcgcatacgcgctaattagcaatttcaaagaggctttgtgcatgggtgctcaccgagggtgtggcaaaagtagtatgactgaaaccggcagcgtcgctgtgaggatggagactaccggcggcgtcgtgggcgaagacgtggggagtcaaggccaccaggatagggagatcgacgggctgagggcctccccgcctcctccctctccacgcaagctcattggcctccccgcccgatggctatcgccctccgcccctttccccaccttctccctctcctcgcgtgctcgccggcctccccatcccgctcgtcggcctcctcgccccgtcccgctcgtcggctctccgtcctgctcatcggcctccccgcctcctccctctccgcgcacgctcgctagcttcccagcctgatggttgccgctccccgcccttctccccatcagtaggcagcctcctcccttcttcctctcggtcgccattgctgtcgtattgagctcgccgccgtcgtctgcaggcaactcgtcggtgtagacgaaccgaagtagagctctgaacgtcacaggctcgatgtcgtgcagagtgatacacgacatcttcgcctccgccatggagccaaggagctccgcccggaacaccggcgagcgggcagcgagcacggcacggtgagcggggaacgtctcgccgtcgacgaggatggcacagtggttggtcgcctcgtaatctagtatgagctcgagagaaccagagtccggcatgccagcatatggagctgcaaaccagaacgcaatcgcgagagggattgagtcggagatgtatctatctatcgattcgaacagtatccaactcccataatcctgattatatacactgatcaaagtgatcagtacagtgtgatcgaactcctcgagtttcgagtagcagtaattctccttgtttgtcatcaaaatgagtagcagtttgatttcccgcgttattgttactgcagctgtgatctctctgggtttgcgctgagctcttcgatcacctgagcctcgtctcttcggttcagccgctgcattaaatctggcgctgcaacggccggccatacttcagtacgcagattcagagcaagtataatattaggctataagccggctaaatgctgaggtggaggagagaagagaggagagagaggaaaaacgggttgtaaacttacagccggcttggactcaagaaccaaaaaattctgtgagagagacaagttggccatatattaattataaagagctaactattatatgggtatggtaagagcaggctataaagatccttatagccaacacgtcgactatattattagccttgctctcatctacgaggccgcctggtccacctacaggcctgcctaggaaaaacccagcttgtacataaaaatattcatctttaccactaaaaatattaaaagggtcgtgcctaaaattcaaaagttacttatattttgaaactactttttttaagaaaaaaaagaggataaaagttgtatctcatatatattgatacaacaaagttagtggtaaaaatacttaagacttttacaagggcaaaacaaatgggttaggacacgtctcccgaatagatgaactaccgcaagggaactcgccccgctttcacccacgtggctcctttccaaattaatcatcatatatgtttatacaccaacaccaaggataatttaaatcacatcaatcaagagaccatgcacattttctcttaagagcaggtacaatagcagactataagccagctataaacatattttaaagagataaaggaagagagagaagagcagcgggctacagatctgtagccagctgcagcacggactccaagatgaaatgtgtgtatgacatgtaggaccgggtattaatagtatagtaagcaactattatatgaattggctattatattggctatagatgatttggagctagtagttggctgtactattaaacttgctctaaaatccatgcatcgattaaaacaccatgccaattataccttagcatgcacatattattccatgctgcattaattgtattcggatgaaatgtgtgtccgtgcggttatacgatgatcaatttgagaaattttaaattccattatatgatattatatgatgatcaatttgggaagaatggagtagttgagaattgagatagctaaaacaacagctagctgcctagagtacgatgttttatagaacatgctgtcaaacttttctgagttttataagatactccctccgtcctaaaatataaatatttttagtatagtatcaagtcaaatatttttaactttaactattaatagcaaaataaaaataaaaatgatcaatcatgtaaaattggtgttattagagttatcgttaaccaaactatcataatgcgcaactctttttatttaaaataaaacatcttagttttatagatattattagtcaaagtagtatctcgaagaccctatcgaagtcaaaaaaatgcttatattttgggacagaagaagtaatacggatacaagtaactggagtagtactattcatagacattgtaacaagcttaaactcaatagataccacatcaattttcactccattgcattgttttagctcccaacaaacctttaatttcatcaataacggatggaaaatgctgaaccaactgagcataaccctcattcagcacggccaccttgaagttctcctcctgcacaaagaagtcgaggcaactcgtcttcagctccgggcagccgtgcatctcggcgtagatcagcattgtcgcgacattttccaccgatactttctcccacagcttctgcgcacacatcagcttcaacctgcttagatcatacctatccgcgaccgcgaccaaattctggagcaaatcggttgccatggagtccttctcctcgagttcgtcggtgtagatgaaccgaagcatggctctgaacgtcaccggctcgacgtcgtgtatggttatgcgtgacatcttggcttccgccatgggtccgagaagctctgcgcggaacaccggtgagcgagcggcgagcacggcacggtgcgcagggaacgtctctccgccgacgacgaaggagacgccatggagtcgggcgttgggtgggcactgctggatctggatgatagcgtgagctagtggcggaactaaggggggtggcaggggccatggcgcctcccaataaatttttttttaattacccctatatatggtacccaggtccaacaggccaccgtatggcccaattcaatccggctggcccatagcagcgatttcaatacagtgaagactcg

SEQ ID NO: 17470 - DNA, 8207 bp, Oryza sativa
aaacttgagaattggacttgacatgattgtgctttgtgatgtaatgttgaaatttgaaatttgagaattggatttgacatagtttaaagcttagtttgagacttgtatttcgataaatttttgttaccgtatcagcaccggtccgtttttggtttcgacaatatttgattccgttttcgtatctggggtttccgattccgattccgtaaaaaatatgaaaacgaaaagataaaggtagtttccatccgatttcgtatcattttcatccctagtacggagcagttacaacagcagactataagccagctataaatacatttcgagaagataaaagagaagagagaaaagcaatagactacatatttgtagccagttgcagcacagactacaagatacatgtgtgtatgacaagtgggaccagttattaattgtgtatttgttaacgaaaaaatcgaacacactggcctgggagatctgcttagctccagtgcaggtccaaatataatgagatgcgggcgtgccagtcagtttgatcctgcaactgacaagatatgtaaacagtagataaaacagcctatcggctgacaagccgatggagtagttccagccgatagccgataatagccgatagcgatagggtttaagcaatcggctatatgtccaatgtagataatgatataaaggcaatcagatgatgatgatgatgtaataaaataacaatataatccagtataaaccaatcggctagcattgatatgatagaataagcatcgatccaaaggttaaagcacacatcggctggaggtccgatgtcatgaaatccacaagattagattaaacagtgaaacctttgttgtcatcggctaaatctaacttatatgtatatgcaatccttatgagctgatgcaacgtccagataactcaccggctgaaaccccgatgaaacccttattgacaatcaagaagcaagctagagattatggttctaagcacgacttagtagatcaaacttaactgatgcagcactaagtatgaaaagaaacataatatctagacaatcaagccgttgactgagttttcagggtggtagatgtctaagctaatctaatctagcaacgcaatttagccgataccagcagaaaccctaaaacgagaagcagccgatagagctaaattgatatgctaagactagattaacagagacatatgataaataggtaggcaaatatattatccaaagcagagtaatccaagaggtcgaatgtactgatgtagccttgaacgacgccgacgtagatgatacaattgcttggaccgatggaacattggacttatcccttcgccggagatcgaagacgatgcagcctcgcgtcgggtgccaagtcccgccggacgataaaataaagtagaaaaggtaaaaggtggcgatgtgcggaattgtattgatcgtgaagaagattacatagatcccaggtgtacatatttatacccatgggttgatacaagtccttgtcggacaagaaataaactttcctaaagataaaaggaaaagataaagtccttataggacactaaacacactttactaaagataaaaggaaactaacaaactattcctaattaatagataacttgccatgccacattctctttgaactcggtttcttctagataagcttcctttagtagatcaatttccttaaccgaatatagtaagaatccgacaattgacgacttgacaactctcatcggctaatctcaagacttcgaagccgatgctgactctaagccgatgactactccgggcttaccaaatttcactgttaacagtattatatgtttagggttaattggattcatgccatattataaatttgactgttttaaaaaataccattataattcgtctaattggaacgatgtcattaaaactcttctaaaatcagattcatgctatcctatacacttgataagctatttgaatccttttttaactaacatattttcgtatggaccaaattgcccatttcttcttccttcatctcttctcctctctctcctgttcatccttcccatctgttagatcctatcgatctcatcttaatttctttttcccttactttgggcctcatctctaactgaccaacaacaacaagaaacaagccccccgaccccccccccccccctctcctctttcggtgagcaagtagcaacagcagcaagggagcaagcggcggcggtgacgtaagcagcagcaggggagcaagcggcggcgagcaaacacgacgggtctccggcgccggtttctggtactcacctcgctcggccgaagttcgccgctacattgagttgagctcggtgctgcagtgggagggcagctcgtgtggtggtcgtcgccggcgagctattgaccattccatgccgggtgggcagctcgtgtggtgggcatgtgtaatttttttctaatgtatatttagccaaaaactaccacaaccaaaattttggggaagcagaggtggtgtagtggtggagttgtgacttgtgagtgcatgacttcacccacaaggattaaattttggtgtccaccaatattacgcacatgcgagtagaccttcaatattactttggtgagatcaaggatgtaccattggtttccgtctcttagagcatgtgttaggcgacgcgttcgtaagatgtgaggtgtggtgttgcgagtgtagtggtttatgtgcgcgtctgccatataatcttaaaacactaccataattttaaatctggtttaaaaatttaagctgaaatcaacgaagtatttgaaattctcgaaagtccagacacactatcaaactattgttacactgcacgaactttgtagtgatgtcatataaaaatggttagcggtactacgaatatatattgacaaaatgttcagtcgaaaaaaatagaagaccatttaacatttatggtccaaaatagatcacagaccgctacactcaagcacaagacaacaatccataattctcccagtatatgtaccatgaggtcataaattaatcaatattctcaacttcgaaaactatgaatcggcagcttgtgttctcaactacatctcttcatttttcgcacgcatatatttctcagactactaaatggtatgtttgatgaaaaaaaattctacgaaagttgctttaaaagtttatattaatatatttttcagaaaaaaaatactaatacttaattaatcacgtgctaataaatcaccttgttttacgtgtttgacctaccgaacacagccttaaaacaaaagcaaaccaaacggatttacctcacattaatccctggaatttctatttctaatttaaatccagccaccacatcgatccgcactaactgtctcatctctcaatcacagctcgtatttcatccatgagggaagggaaatcctgcaacaatcgaaggtacccctgcgtcgtcgccgccttcctgaagtgttcgtcctcgcgcgcgaggtagtcgaggcacttcttcttcagctccgggcagccgtacgtctcggcgcagacgatgatcccggcgacgttctccggcgtgacgttgtcgagcagcttcttggtggacagcagcttcagcccgccgagctcgtaccgctccgccgcggcgagcaggtgctggaacatgtccaccggggagaatccggcgagctcgtcgatgtcgtcgggcagcgcgtccgtgtagatgaagtggagcaccgcgcggaacgccgccgggtccatgtcccggagcgcgaccgacggcgcggtggcctccgccatggagccgaagagggcggccttgaagaccggcgagcgcgcggcgagcacggcgcggtgcgcgcggaacgtctcgccgccgacgacgagcgcgacgtccgcggtgtcgtcggcggcgccgtagagcaggcggccgatgtgcccgcctcctccaccggacgacggaggcggcggcggcggcggggacagcgcctgtgggctgtcgctcgggatcaggacgccgcagacgacggtgacccagccgtcgccggacacgaacttcttctcgagctcgctccgcgacgcgaagtacatccacccggcggcggccttgccgccgccgcggccgccggcgccgagagggtagacggcgacgaagctcttggcgtggaccggggacgggtggccgtcgaggtggacgaggaacgcggcgaagatggccctgacattggtggaccgggtgacgaggtcgagcttgatggagaggtactcgccgccgatccgctggccattgctgttcatcgcgccgccgccgcgagggtagcagaggacacgccacgtgtggccgccggcgtagatgtcgtcggagcggacgaagtcgccggcggcgaggtcctcgtaccggagcttcagctcgatgaagccgccgtccaacatggcgatcgaatcgtgtttcgtgctagatggaacgcgattaacgagaagaggataacgatggtttacgtcattttaaaccatgtcattttttaaaagttaccaaatatttacatacatttttttccaaattttgataaatacataagaaattctacaatattgtcaacttaacaaaatttggtaaggtttattttagctataatatggacaacgcttaaatctaaaaaaaaaaaaccctgcttattctgttgcgtatgttgcctcttcagcatccgtgggcttcttggccttctcccataaattttacaaatattttgacagaaatttgttaaagaaacaaatgtctggcagaaatagttttttctttcaaatttgccatacgtttatcaataaattttattaaaaaattgataaatgtaaaaaaatgtagagtaaatatattgtaacttatatatctacactaaaatataagtttaccaaacattgtttaagtttttcataccttatactccgtattaggtaaatttgaccgagttcgcccccttttttatgtatagacgcacttgtggcaagatctcatttctcatggttcacatattatcaactgaaaaatcttatttcctagaggaatttcacagttgttaaaaaaatatctcaagatacctaaattaacttgaaatatttagtacttagatataccaaattttgaactagaaaatatctcatttcttatggatgataaaattatctcatttcttatggttcacatatcatatggctaatgtatggctcactttttgctagctataacttgaacaagtgtgataaatgatactactagcaaacttagagcaagtttaatagtatagccaactactagctccaattcatctatagccaatctaatagctcattcatacaatagttatatactacgctattaatacctggtcccacatgtcatacacaccctgcatcttggagtccgtgctacagctggctacaaatctgtagtctgcttctcttctctctccttatttatcttcttaaaatatgtttgcagctggcttatagcctgctattgtacccgctcttagaatactccctagcattcaaacagccccttcataccaaggcttgttctccgggacgccgatggggtagaaggtccccttgcatctggtgaaatgtcgcttgccatctgttgtggtcgccgaaaaactcgaggtgcccctgcacaagcatcatcttgcgaggggtacccgtgtttgcaatgccggtgttcataatttgatccggagagagatcttgtttaaatacaagtcgtatagcttagcaaggcgagagtctgataaacgttaaagagttcaggcctccagggcaagcataatacaccataatataatattaagacggtcatgcatgccaagaggcaagagcaatgtgtctgttaagagttagcaacgaaaagttaagttcaactgaatgtccgatgctttcctttcaagaaaatgttgaaatttctcacacgcatgaatggaatgaagcagatgcagatgagatgatgaaggttttccttcttccatcaggaaaatcagtctccgcttagatgacaattttgaacgaatacaaactctattctgtaaaggtccgacaactctaaggcctaagctttcacatactcacgaatgaactcctcaaccgctgaaacattaccggtcagaccagcaccttcagtaactgtcaccttgttctggcattggctgaaattaaatgcttctccagggttcccaagcttgacttcatcagtgatgtcagcagatgatatggcgttccttgattcccggagcttgtttctacacaacagtaaaatcagcacacaagtagtttaagttaaatgagttgctgattatagtgacctcggttatttcaagtatgtaaacatgtgtactctagagacttgtattgcagaataatttattgtatccactaaagctacatcataagttataggtggacgcattaaaattgtagaaatttaatataaacaccatcacaatctgatgcactatagttatactaatatgatatgttagaagaaaaaacatacaattccttttccaattgcttcttgatgaattcttttgagtgagctgtaactttatctgtcttgttgcagaatatcagaacaggaaccctcttcttcactacagttgcctttgtcaggatgtcatacaagtacctgcggaaagagaatattgtaagaccatagcaactgcaacaaaaggctgacacagcacacaatttattactccgtatttgtctcggcatgacaagacggaagctcctagtcacacttctaatctcattccagtaagagatggatttcaatttaagctaaaataaacaccacatatttttactaagaacaggatgtaagtcagcgaaattactctgcagcagcatgcatggtagacaagaaatcttgagcatcaacaacataaactattccagctgcttgaggcaggacttcatcaagtttgggtttgagccttgcatgaccaggaacgtcaacaacatgaacaggttttactttgcctctctgcagagcgaacaagaacatgcatcaatatattgtagtcagcaaatgcatggttctatataacaggatagtcttcctttcatttcatatcaagatgtttaaaatatttgtctctaagaagttgccttaccctctccagctcagaatgaagcacgaaagtatcgttgttttgttccattgaagtcacagttccttgatgtgttgatccatcccgaagctagagaaagggagaattagcacagaccacagagacaaaagatactcaactcaaattaacatgaaaagggaacagtggtgatgtatgatgttgcgattcaatatatcatggaaagaatacagacaggagcatattaagtcgaagcagggtaagctgaagagatacccatagattacaacatcaaaatcagattgagtaggttatttaaaatggtcatttcctaagctactgaactgtacatgtatagaggttgaaacaatagaaagaaaaacgagttcagaattgaagaccattaaatgtttagccattattcatcaatttgatacaatttcatttctccgctttaatccatcaaaaataaaaaataactgtcactgaaggagtgagaaacacacataaaaaggaaccatatatgggcattgaatgattgaaacagaaaattacctggtagaagagaatagttttgccactaccactgagcccagatagcactatggtgtttgctttcgaggatttcaggcacgaaactgaaataaaacagaagccaggaattgcatattaattactgcacatgcagctccatcaaaataatgtagcaaaatgactactttagaagttccactttttggtgatggtggactcacttataccatactgaggaatttgtgtgtgcgcttgtgccacaaattaaacagatacacatatgcaattgatcagatggattgaaggcaaactaggtaatatgagttactcaaacattatcgcaacatgtaacagcgacaagggtacaaaaggtaagctcaggcttcagaatgtaaccttatttgagcttggcaacaatatactgtattatggctggctattgagctacgcgatcagatgcacaaactagttcattaattcgcaattatggctatgaaacaaactgctggattatggagttgca

SEQ ID NO: 17471 - DNA, 3384 bp, Oryza sativa
  unsure (1)..(3384): unsure at all n locations
ctcttccataaaccagtactctcgtatgcaagatttgaagcaaccaaaaaaaaaaactaggcaggcttgaatagttgaattgatacatcacctgcgaccagcaacagaaccgtcacggcgaccaccgcgacggcgacgtaaacctgctcgggaggctgctgccggatccacctctcggcttgtcccacccacacctcggcctggcgaacccactcgtccatccctgcacgaaacgaggcgacggaggtgggggtgagcaagcggcgagcggagcgcgtgggctggaagaagacgatcagatctgaaggagcagcggagatgcgcgttacctcgctgcacgcggaagttcccagagcaggacgacggcgcaggcctgcgcgtgttacaccctccctctccgtacgccggcggcgagccggcgcgaaaccctaggatgctccgccgccgcggaggtggccggagtcggaggggagaaggcgggggttgggggggaagccgagcaggagaggaaagaatagaaggatgaggagaattttctagaggaacacgagattctcgagttaagcccaatatgcacgaaggagtacggcccagtatgggatttcggcccaattcctccggagaggtcgagatccatatattgggctggatttccttgggcctcaggatttaaatgggccctgattttatcactgcattgaaactattgttttttttttgtttttcatgcgaccgagttcaaattcaaatcgttacttagcgatgcttgtatcatttgtatccaccacaaccaataatcccaaacaccaaatgaaaaattcgtggtggctcccataatggtttccagttatgatatcatttgcaaaaaaaatactattaactccgttttttaatagatgacgctgttgactttttctcacatgtttgaccattcgtcttattcaaaaaatttatgtaattataatttattttgttatgagttattttatcactcatagtactttaagtgtgatttatatcttatacatttacataaaagaatttaataagncgnatggtcncacatgtnaganacagcnncccgcgtcatctattaaaaaacggaggtagtatatagctgagatcgcaaacttgcaacagatgaagagagaagaagaatgacagcatagattccatggaacagtgccaggtagctccaaccattgccatggaggtaggtgtcagggttacggataccacatacctaatattagttgactaaatctcgacaggatccaccacataccatgtcttatacggaaacaaccttcggatataagaggagtttcgcataaggaaggatgactagagttctacattgaaacgacaaggactactcggattgtatccatattgatttccctagttctacttggacaagaggacacctatgggtataaatataaggccccctaggaggagaagggacagacccaccatagaagatacggaacaacagaagccacaacatacaagccaacatacgccaagacaagacgccggatatcgacttcagagataggcatggctagtcccctacggtgcctacagataccgttaggagagatatagagttgtctctaatctcgccggatacggattcgaggaggaaggctaccctgttgtcgactacgagccagtactacataccgccaagtcgacaacagttagataggctaccccaaatattgtactagtttgattatggtgaataagagcgataccggcttcggccaacaggatgtagggttattacctgacaattcaggggcccgaacctgtataaaaatccctatctccatctcttttacctcaatctcgcatataccctagtaccaatgatccccatgctatgcaaataccggaatcgcgacatcaaacatcgacagtagggctatcaaaaaagctcgaagctcgcaagctgctcgagcttgattcgttacaggcttgattcaagctcggctcgaatactagacaagtcaagctcaagcctaggttgaggctcgcaagcctagcaagctcgagctcgaatagctcgacagggcttgattaacataagatgtattgcatgtaagaagatattcttgatgggacaatatatactggtcatcgtgcttgacctgctcaagtctcaagacctcatcaatgcttctcaataaagcacttatccggctgctagtaatagtactacattcctattagatgtagtagctagcttttgttaattgcaacatttcaaagtcatgaattcatgagaaaaactacagaggcttcattcaatacaagtagcatccattaattttgactaccaataatttgtattaatatctcttatacaaaagtaagttctttggagtttcaccaagtcaagctgtcaagctcgagtaggctcgaagctcgctcgagcttgaactcgagctcactcccaagctcaatcagtatccaggctcggctcgagctcagctcgagttcatgtcaagctcaagcctacatagccaaactcgctcgagcttagctcgttgatagccctacatgaaggaggaagaaggagctccatacctatgcctacctgccaatatatcaaatccactccaagaaatttaaaagaaccctgtgatggagcgtggggctccttaccgggagaccgcgcaggcccccctttgccggttcggccgggagccctgggtgagattctaagctcctggtctgtggaaagttcgcgagagtggaaacacaagacacgggcgatgtatacaggttcgggccgctgagaagcgtaataccctactcctgtgttttggtggatctgtgtatgaagaagctacaaagtgcgagccagcccccgatcgttctgggatccgaaaaaattttccttctaagtgggcaaggtcctccttttatacctcaaggggataccacatgcaccatctctctcttttttgtggggacttatcctatctattcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccatgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccac

SEQ ID NO: 17472 - DNA, 5695 bp, Oryza sativa
attcctgcagccctccactccaccacaaagtcggcgagggcctggctcttgattgcgtggcttggttcaaagcgcaaatcgaattcagagagttcgattgcccatttcaccacccgtccagtaccctctcggttatacaagatttggccgaggggataagacgtaaccaccgtgacccgatgcgcctggaaataatggcgcagtttcctcgaagccatcagaatagcgtaaagcatcttctgggcctgagggtatcgggtcttggcgtcccggagggcctcactaacaaagtagacgggccgctgcacctttcggtggggccgatcctcttcactaggggccacatccctggggcgctctttgtccaagcggcctcgcggggtgcactcgtcttctgtgccgacgacctcggggtcggaggacgacaggggcggccttcccacagtggcctcggggccgtcctgggggtcgggggctcctggcgtcgtcggacaagcgggcaaagggccaactccggtcgtcaggggccttaggccaccgttcggctcgggggcctcttctccctgctctctcccgggtcgagtcggcacagggttagcctcggggtcagagggcgataggtgcggccttcccgcagtggccctcaggccatcctgggggtcgggggcgcctggcaccgtcggacaagcaggcggagggccagctccggccgtcgggggccttgggccgccgtttggctcgggggcctctcctccctgctctctctctctcttcgggcagaatcccggcggtcgcaaattgcgcgcatcagcaaaggaaaaccgaccgacaataatgagcggcccctcggctcgcgtttgccttcaactccaacgaggagtgcggtgacgacggtgcggacgacagcgatggcgaggccggctacccgggcgcgtcggagtgagcccccaggcctccgccaatcttaatagcttttccttcttcttccgaggccttcgggcccccttcttgttataggctgatttaatctgcaatcaaataaagaggaaatttttgtgtcaatttcatttgttctgtgtatgagacgaggatggtctgtgccacggtccttctgtgtcttggcttgaacaagggctcgtacccaggtcccagcctcaaacggcgcgggtcaaggctagtgcctggggagatccacatgtcgagactggccaggccgggagcgtggtgaccgagggttatgggtgacccgattatgggtttttgccgattcccccccggagttcaccacgtcccggggcacggctcggttctgggccccttttggcgattttagccgacccgagcccccgagggtaggattgagcacgagtgacctatttcaagtcaagattcttcaaaaggaaacaaaagcacagacacagcctttaggaaatcgaaaatgcttttattgaaatacggaagagaaaaaagataagcccccggccaaccctgcacgcccgggggggtgcggggttggcccgagcccaagacctgacacccaacccccactaggggtagaagcgacgaatgtgttcgatgttccacgggttaggcagctctgtgccgtcgcccgtggccagccgaacggagcccggccgggggacgccgatcactcgatacggaccctcccacattggtgagagtttgctcagtccagcacgcgtttggacacggcgtaggacgaggtcgtcgacgcagagtgatcgggcccggacgtggcgctgatggtagcgccgcaggctctgctggtagcgcgcggctcgaagggccgcgcgccaccttcgctcttccaagtagccgaggtcagggagcgtcggcttccttctttttgtcgctcgcaggcctcccctttcgggtggccagcgaaacaccttcgacggcgaggacatgaccctcgtcgtcggaatgggccgacctcttcttcctcctcctgtcccgccgccctgaccgagcggcggacccgggggcggccgaagctgccacaccggaaccggaggggttccaagtctgggcctcctccttgcgagccactcggtccgcgagctgaagaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggtgcggatatgtgccttgaaagttcatagtgaactgttggcacaaatcctcccaagagtggacggacgcgggtggcaagttcattagccaaccccgtgcctgtcccttcagggccatgggaaagaaattcgccatgaccctgtcgtcacccccggcggcctcgatcccggtcgtgtagacctggtgaaactcagcggggttgatgctcccgtcatatttttcggcgatggtgggccggaaccttgggggccaacggacgttacgaaggctcgccacaaaggctctacagccgacaccaccaaccgggggcacggagggctgatccccgcatccgtgttgatgtgacactccggacgaggaggcgccctccgttgcgtgggcagcacgtcggccattacgccggcgctcgatactgatgcgggcatccggccccccacgcagatcttcctgggtcggaggcgctgacgaaggagtggcggccgaatggcgagcaaccgccgccgctcgccgcgccctccgccttgacgacacggagccggtggtagcagcgccagaggtcttggtggcggaggaccgcccaccagcacctaggcgctgccgtgccgtcatgaccaagttggccacgtcgtccagccaacgttgggctggagactccgggtcagggacaacgggcgggtgacgtaggagcgcgcccgcagcttggagtgcgccctggggcgtgctgccgtcgccatagacgaggaggcgacgctccccatctcggcgccctcctccatcacccgtggatgtcgaagtcgcggatccttcgaccctctcgagcgcctcctcccgcctaggactttggcgtggagggggcggtggagtacgagctcgacggcgtgggtttggctccccgtcgtcaccgctaacactcggagagaggttgtgcgcctttgcttgttcagccattgggctgaacaggaaaagcttggcgcacacgaaagagtgcgagagcttagaagaacacacgcagaaccccctacctggcgcgccagatgacagagtgtggggctcctcaccgggagaccgtgcaggcccccctttgccggttcggccgggggccctgggtgagattctaagctcctggtctgtggaaagttcgcgagagtggaaacacaagacacgggcgatgtatacaggttcgggccgctgagaagcgtaataccctactcctgtgttttggtggatctgtgtatgaagaagctacaaagtgcgagccagcccccgatcgttctgggatccgaaaaaattttccttctaagtgggcaaggtcctccttttatacctcaaggggataccacatgcaccatctctctcttttttgtggggacttatcctatctattcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattctgtccaccacgcgtcagtttatcaatctgcatgttcgcccctcttcatacaatgtcttgcttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctatgactggtcactgaccggataaacgagcgtgctgcactgcgatacatgcggcgtgacgcgctcgtccaaaccacaataaatgtggttaggtgagccccgctatgctcacctaccccatatacacggcacaaaacccacaaggggtcggggcgcctcggccctcggggccgagacgggagcggtccgacccctcggggagacaaagagaagggcgaacacatcaccctcgggcccgacgccccccgagggtgccaggccacgtgggcgattgtgtctgcctcaagcctctagtcatgatactcccggtcccatgtcaccgacaccctgctatacacacgaagaaatctgtacgaaattcgtacgaaaactacctgcttacgtgatttccatggctagaacactagaagcccacacaagatcacaggcctacaacactctagattattcaataagaaaagcccatatcaaattgataggttcaatatcatgctactcattcaaacttcagagcttcgcttgagtggagatgcagaaagcaaggataaaataaatttaatcagttctaaaaaaattcaattcaatcaagcatatgagctaggtggcggctatatgcctaggcctcaccgcctcagctgccgccacaatacgagcagtaaatattgggttgcttcctgcatagtaggtaggatctaccatgcccacactaataataaatcatacattgatgcaccgatgtacttgtttgatatgctagctgatcacttcgatgctgcaaaggacaatatatattagttgtgtggtagtcgatagtgatatgagcatgcagtagtaattcctcaatatgatttgaacacgatttacttgtttatagtttgaacatctgcagcctgtgtatagattttcgtagcacatggttttacagacaagtagagatataactcttgctttttcgtttgcaccatacgtgggcctgtatttgttacgggcttaggtacttgcaagatgattatagagcatacaagccgaaaagacaggctgcatgtgctcttcgtacatgtttcgtaataaaaagtttcgtacgtatagacttttccaatttaaaattaagcataaacacgatccaatccaatcacaggaccttgccatcgattggacaatacgattttataatccacctgatcagcgccctgagccctgaagattagccacacaatttgtttatcctcgatcggtgccaatgtcatcaaacgtcagtgaccttaatagttaattaattaattgcttgattaattaccagatgaactgattcttctggcaagtccagatcgacacgaaacgtacaggagatcacgaattgcctcttccgatcaagccatagccaggatactgcatcaattagccaggatactgtgtcgatttgacttgatcgaccagatcaaagtagtaattagcacgagcgattttgcgagatcgggagcacacgtagtactcctacgttgagtgcacgtagatatagtcttgcacagtgtttacactgccgtggtcaactaatactgcacctgcacgctgcagctaaaaacacctctcgatttttcgcatgcaacgaaaaggttgtgtacacgt

SEQ ID NO: 17473 - DNA, 1814 bp, Oryza sativa
ggctggttccagaatgctagaattgctgtaacccggccctatgatctgcgtcaatagggtaggttagtagttgtaaaatctcttttctctttgctaatataggcattctttagtttctaaaatttttttcacagaacatcacatcgaatctttagacacatgcatagagcattaaatatatataaaataaaaaactaattacacagtttgtataaaaatcgtgagacgaatcttttgagcctaattagtccatgattagccataagtactgcagtaacccacatgtactaataacggattaattttgctcaaaaaattcgtctcgcgatttccagatgagttatgaaaatagttttttcattcgtgtccgaaaaccccttccaacatctaatcaaacatccgatgtaatacctaaaaattttcattttccaaactaaacaaaggccatagtgatgttcatctttgcttttggcctacctagctagctcagacagctggttcagtagagtgtttggctgtcctaaactggattgagttcttcagagttcggtcgggccgttcattcgttgataagcaaactcaattaatctcgttatcaaatgcgttggctcgatcccggcttgctgtaagactgtttgttgctgctgaacttgcttctgctccaactgttctatcctcttttttcggtgttcttttggcacggaaagaatgcaaaaatggttgcttatccaaaccgaaacgaatcagcattcagtgtcttgtcaagcactagaagtagtgaattatcatgctcacccactctgcctgtccgacgcgtctgaatcgaccaaaataacacgttttggagcctcactagaacagacgaaaattattcagactgactgacacttagtgcactgtacgaattaatcatcgctcaataattggcaggggccatcatcgatcaatcgtgcttgcagcatcaccctcatatcaccgcaacgtcatactcagtcttcacaggtagccagctcaaaggccagaagctgaacacatctactatggcctggtttagttcctaaatttttttttccaaaaacatcacatcgaatctttggatacatacataaaactttaaatatagatttttttaaaaaaaactaattgcagagttggaggaggaatagcttgacgaatcttttaagcctaattagtctatgattagtcataagtgctaaagtaacccacatatactaatgatatattaattaggctcaaaagattcgtctcgcggttcccaggcgagatatgaaattagttttttcattcatgtccgaaaaccccttactacatccggtcaaacatccgatgtgacaaaaaaaaacttctaaacaatgttcttcactgacactgtcaagagcgatgagacatcgagtgatctgaaaattttgatcacggcgatggcgactgaagaagaagaaaaaggaaagctgacgcctagtacgcactagtgcgctcgcaacgactggccactcactcgctcactgcctagtgctcgatctgctcatgatgcaaacgcaaggacttggtacttacatggccatgtgagactctgcttgcaaaggaagcgagtgatgcttttcgagtgaagaaattattttgccttgctcttggaggcaaccttaattgcgctttaatgttggtcggcgcctgctgcttgatttccaaccagggaagacttagtatggcgatcaagattagtggagacaacatcttgatcaaccattttgtcaagattcagttcgtttatttatcccggactcatgggcaaccga

SEQ ID NO: 17474 - DNA, 1133 bp, Oryza sativa
agctctagaatgaacccttatgcttaggtatatgcagtatttgtttcaagcagctaaattagaatcatatgagctccagatagagataagaaggataaaaattaaaatgtaacatagtacaaccattttatcagaaagacaagcacaccacttgtgtttttcaaaagacagtagcgcagatacagtcatattatcagaaataatacaaattaagctgtaatgcagaaataatcttattgtgctcactagtaacctattttcctatctcaataatagtttctttttccttgattgaaccgagcaagaaaacaatgaaacaacgaaatcaaaggtagggttgagtatttcatatcttacactttctttggctgcagccatggcaagaacaccagcacccatctcgacctcttgtagaccaaccaccaccaagtcaacatcaaaaaatgcacgacccaaccatgacatgagtgattcataagatgctttctcctggccaacattccaagtcccaacaagcattttaatgttcactagccttctatacgacaactccctgtttgacaattcagttcgcagaatatcatccagagggccaggggaagctagaggccatcctctaattccaccatgatgagcaagagtaaagacataagaaccaccaatcgccatctgtatgaccggacagctatgcccagtccattctgccagaaggttaccttccacatccatgacttgaataatgccactggcatagcccacccacaccctttctccaagtgccttcatgcactgaacagaagaacaatgatgctggaattcttgcagtcggttcccatttccatcccacataatgatcaaaccatctgtgcaacctgaccaaaccgttccattcattgcctgaaccactgcttctgttcggcgattatcttcaacaaatgtcccttttgtagcaactctgcgtactgcaccagctgctcccatcagggcattccttgatttctggaaaaaattgaaagagctttgtggtttatccttcttcacgggttttgctttgatttcttcctctataaattgctctggcatcacaggtgcctctaaccgagctgactcaatttggccgtccatgccaaaca

SEQ ID NO: 17475 - DNA, 9139 bp, Oryza sativa
  unsure (1)..(9139): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcaacgccatccagaagctgcaaaaaggtgacaggctacacacttgattattgcaaggcgggttatgaacttaatcagcatgaaatggaaggagataaaaatatgatatactcgattagatgagctattatacgggaagaaaaagttcggaggtcactgtcaattcagtataagtaaagcactagtatcctaaacacatcttgtagaagcaactcaatgatcttgtagaagcattgcatgtgattgtatgaaaaatgatcaacttttggtcatcagagtggctagtgttttacagggtgtaagtgaccccatctcgcaattggagatagcttcaaagggaaaactgaacaggatatgtgccaattaagtgattaggtgcctgcatatatacgaatgaatcatttcttcaatgatttgtgtctggtatacatgccagtattgaaatgattttggattcatggacttttcagtaactatcttttcatgatactgtatctgccagggtctgttttggattgcttagcttatctgaataaattcatttcagttttcaagatggcatatattcatttgaggttaggaatgaaagaatggacgcacttctcgagtaccatgtgattttcgtagaaacttttgatatatgatttttaaaaaagaataatcagttttaaattttataatagttaattcattcgtttgtactctcgaatagtgatcacaaaatcattcagccgttcagctctttagggggggggggggggtcactcttagctactactacttgcataggagagattaggattggaaatttgagcttttcaacttagctgaatctgagtctacttctgcaaaacagtcggtaaaacctaataaaaagagatgggccagagtgtcctatgtaagttctgattctttctaaacctgaagaaagctgttgaaaagctcctcgatggacgatgccttttggtacaaattaatctcttttcagatccaagcgttcccatcctgttgggtggttaggtttcacattagtagcaagctctgcacgttcacaactcttttgtgctggtcacagcgtttctttagcatcctatctcctgtgttttcggcgtgattttcaggtttcaggttcgaacaattagctttttgataggaccactctgagactatctaagtgggcattagccgttgggaattttggtaatgacaggttacaagcatcagaattaagacatactccttccgtcccgttccatactataagttattttagttttatcctaaatcaaacttcactaagaactttaattgagtttataaaaaaacactaacaattacactaacaaataaatgcgctgttaggacacattttctagtgaatttaatgaaaccaattcgatgttatagccgatcaaaggtaaagaagtttgacttatgacaaaatcgaaaatgacttatataatatatatggaacagagggagtattagcttatcttaacttttttttatatatgctagcttatcttaagtttggtttagatagtgagggagaagaagaggaaaaagaaaatgaactgatgacatgcatagtaatggtaatgggccaacttccataaacgttggatttgggccaaatactttaggtcaactgaacgtggttgaccattgatgggatgatgaaagcttcaaagccaccaactttttttctcctcctaacatatgggtgtgtttagttcacaccaaaattggaaatttggttaaaattgaaacgatgtgacggaaaagttgaaagtttgtgtgtgtaggaaagttttaatgtgatggaaaagttggaagtttaaagaaatagtttggaactaaactcggccatattttattccaacttccatgtggatgagagaaaaactggaaggactttttattcggctgtagtaattctgaagtgaaccacacttcaattttcttcaggtaataatgcccaagtccacaaaattgtgctgaaacaagtaataaaagttcacacgcttgactttgataaatcacagctgcggtagactgtatgaatcttttttagataatgaaaatggtttgtgctagtatagaaacaaattattcactgggttattcctacggattatctactttattgtagagatgagttaattattttggaattaagcttaataaatagcttcgaaccagtggtctaaacaatacaatagaagaaagttctttttttctttaaaaaaagttatgtaataaataaatctgtgacaataatccagtagaacagctaaaaagaactggacctaaggatggattggttactgaacaatactacatttttcttccatgctaacttgcccacgggggatttgcaattatgacactgcaaacattaacctttgctataatgacactggacccacatttcataaatacagatgggcccatttgtcatccactcggagtgtcaaaacagcgaaacccctatgtttgcagtcccaatattgcaattttctccttgcgcaccggtatgaagtccaaaagagacaattcaatcgtcacattaataagagaataaattcatgattgtagaacgagtttcaactttcaaccagcagtagaactcttcttctttgtgcgtttgtcgtacctctacagtgtaagtgcttacaaattttgtggacaagattttcagtggtcagcgagtacaaattcagcagggaaattcaatgccgaggattttcgtggcatttgtaggtccaaattgagcacatcacggttgaaaccatgcaagtatgcaacatgatagctgccattttcgtcgagtttcagatcgagaagcacggcagtttgactgacgaactcaaaaacatggcgtctttttttttaaaaaaaattgtttcaggaaatttgttcatgggacatgggggaaaggcgtgtggctagcgcacgtacggctgttgctgtcaacggacgagtgattcgtgatgcatattggaattggattcgtgattttaatttgctgtgtgctttgtactacagggtttagcagaagttgttctgaactttttgattctggttgcgttgagaatgagaactcttttcggggatatatatagagacagcgactacacgaaggtgataattaaatggagatatcaaatgtttgatcgagcaggagtcgctgatttgatttgatttcagttttgatgacctttgtgaataatcaatgtcatgcaataaaagctttttgtgcagaaagcgaccggtcagcagattgtaaggagtagtaataaacttttctaatttgtttggcttggggcatggcaaagagcgtgacgtcaggcgggcgtcaccgtggcgtcaccggggccgcgtccctctcaaccgcggcgcgtccttttccggctttgggcgacgggacgagacgacgacgagaggggagagaatcgcatcgcgaagcagcgggggctgcacgattcgtcgtcgtcgctttcctcttcatcctctcctcgccgtgtgcgcggtgcggcctcgttcgcgtcggcgtcggcgtcggaggcggagacggaggcgaaattgcaaggaaaacgacgacgggcgtcggggacgggaaggagcggagggaggcgtacgtggatgtgaactgattggtgcgtaggcgagccgcgagcggcggagctagcgatgctctactttcgaagtcacgttactttgtcaccgatacatggtgcgacactctgccccctcctgttggttggagttacgtttttaatcgtcgtaatagttgctagctcgggttttttatttttctttttctccccctctcccggcataagccagtctgactgtttgttttgtgtaacaaaaactcttttcctgttaatatattgatgtgcaatctttttgcgcgttcacgaaaaaaatatgggtgcgacagatattattcccttgatctcaaaaagtcaaaataactgtatttttacactgttcatctccaatgtttcaccgtttgttttatttagattttttttgttagtatttttattgttattagatgataaaacatgaataatagtttatgtgtgactaattttttatatttttttcataaaatttttaaataagatggatggtcaaacattgaacacggatatactttgatcattgactgaatccgatagactttgaacctatatgtcagcaactaagacacggtgatttcgaagatagaaattcttgatccgtgaagtgaacggcatggagcgtgaataatatgggccaagtgtgaacctatcttatgtgggagtgggacgacgtgctgcacggttcgtccctacatatgatgcaagcaacagcaaacccgacgctggaggatggatggatggctggctggatgctcattctcattctcattctgtttctcctttcacggctggtgtttcttttcccacggcctcaggctggctatgacctcgtttaaacgagtttttttttttacgaatcgacgaggctgttaattttattgaataaaggagacgaaaaatgtaaaaaaaaagaggtaaagtatagaaaataaaaaacccagggccgtggccctaactataggcagttacattgtcaaccagacggcaagattttttgcgcccgccaacccccatgtttttgcttcctcctttgtcttggctagcagagttagcgacgacagctccttgtgctggaaagtcctccggttcctttcgttccgtttaaacgagttttacactataagaagcagcggatgagaatacatagaaaagaagaaaacaaacatttaacttctaatttatcttatatattttaccattatagattcttataatatagacaaatagctaaactatttgtgaagaaaaaaattaaaaaaaaactgagctaccaggatatctctaaaggtgtgtttagttcacgctaaagttgaaagtttggttaaaattagaacgatataacggaaaaattggaagtttgtgtgtgtaggaaagttttgatgtgatggaaaagttagaagtttaaagaaaaagtttagaactaaactcggcctaaacaacggaacctacatgtcgtgtcataggagccctatgacatcaaccatctcctgcatctctatgcacagatggctgatttgatctcatcttttcacttatatttatacttatcaattaaaatttaaatttttagctttaaatttaaagttgattttgattttttttttatcaaaatttatttttcagtctttaaatcgttaaaaacacttatataaaaaagttttaggtataaattattttttatttacaaatatgttgtttgaggccgtttttcagtgcgaagtgaacaactgcatgccaaacgcatcgccggagaaggaaggggaaaccggtgacggtgagagtcatttaaggcgttctggtagcctacgctttttattttttttggcagttggcctgcatcggtgaccaacccccgaatgaaatcaaccgttgcaatctcgcaatttctttctgttggaacgccattgatttctttctcccccaagactaattaacatgtggatgtggtgtcatctttcttccagccaccaacccaccgcaggagaaactctccagtcaacttggttttgaaaaacgcgatgagtgttctgatgatgtgtacagtacgtgcttcgccccgcacgccgcggcgccaaggaacttcgaataatttaccgagttgtatacaggccgctgccgctgctgagactgagaccgtgcttgctaaattgatcgtcctcattgtgtcgcgctccttccacgtagggctgatgtttcttttcgtatggcctctgactatgacctcatttacaccgtgtttagatccaaagtttttcttcaaattttcaacttttttatcacatcaaaactttcttacacacataaacttcaaacttttccgtcacatcgttccaatttcaaccaaacttccaattttagcgtgaactaaacacacccttaaacgagttttacactatgagaagccggggaggagaatgtatgcaaacaaagaaaacaaacattgatcatcatatgataagaatccaaaatttctcaaattgatcatcatataactacatgaacacggatttcgtcggaatataattaatgcaatataagtgaatgtgtgcatgctagagtgtaattggcatggggttttaagagcatgtacaatagtgctattaagaaggctccaaaacttattaatcagcctaatacgagattagaaaaagaaaatcgctaggagagaaacaaatgggcgcttgttttagcgctagcgcttgcacagcaccccatgcagtatcggtcacgggagatgagaaaaaaaatgctaggtgggtcccacacgaaaaaaaaatgttatatttaatgtatgtatgctttaaccaaggcagcttatagctaacttgtagttaattagcatgttgtatgagttggctttgtaagttagctctaccttgacatgataaaattttggagcttgccgctagctgcactattgaccttgctctaatcaatgcatgtattgtgggagaatgtgtgcatggtgtcttcattgatgtgattagttttggtgtataaacttatatgatgatcaatttgggaaggagggagtgctattcacaaggtttttcttaggccctgtttagttcccagaacaaaaattttcaccctgttacatcgaatgtttggacacatgcatggagtattaaatgtagacaaaaaaaattacacaaattgggtgtaaattactagacgaatcttttaagcctaattgtgccatgatttgataatgtggtgctatagtaaatatttgctaatgatggattaattaggcttgataaattcgtatcgcggtttctaggcagaatttgtaatttgttttgttattagacaaagtttaatacttcaaatgtatatccgtatatccgatgtgacaccccaaaacaaaaatttttgtcatctaaataagcccttacttcctccatcccagataaacaaattcatagtgtatcatatttgtttattttaagatggatatagtcttgttttaagatgggtttaggaaagaaggttagaaacttctcctatgcacctaaaacagggtaactcattaccacatgattaatacttactaggtaaaacaataccgaaaaatagattaatatgattaaaaaaaagtcttccctatcaacttttttactttttattaaaaacatacctcatccgtcttaaaatataagaacttttagttggatggacacagattcaacgtactaggatcttatattttgggacacagaaagttattatattttgggacgtagggattatcttctaaccgttcatagaacgtttgcgtgaaaaacgagaaaatagaagttgagacatgtactttcaaacatatctttattctccttttgaataataggttcccaactttaattagtcatgacttaatgagttactcgttccatctacttttgatagtcatatttctaaatctgaaaaatttatttttgataggcatatttcaatccaacaacctatcatcttaatgactttctcggatttaatacatgactctctattatttcacacatgattggctacaagagcattgagaaatgtaaatattaatgaattgcttgtttacgtgattataaaagtagatagagggagtatttcgttttctatacggagaaatgatttacgaacacatccaattgtattacggttaccgcggcgtgctgactgaccgcttaccaaccacggttcacacccatcttcctggatcaaaccggctagtaagctagttctgtgatttatgagtaattaattaagaagcatgcgattatctttctcatcatgtgccaaagattcagggcggcgaggcaatctcatatattctcaacggacaaataataacaacgctttatctgcagcagccatccgaatccatcggcgatgcacagcgaatgcattgactccgatgagtactactgtacttgatggtgttctagaactgaaggaaggaatgaattcggtttgagtccgtgagtggttgattgatacaggtagtaccactgtaccaccatttgtggggttcagtttggcatccaagtgattgtgctgattaattgtctcattgttcagccaatcaacggtacaagatgagatgagatgagaggatgggctgttatctctgatgtgttttctgcctctcatgtcatcatcaactcgcccataacttaaaccatattatttttagggatttagggatattcagtttatttaccattttcaagcctaactaattttagtaatattaaaattttgtaaagtttgataatgccacaagatttggtaataaggtaaaattatgtatgcagtattgtttagtttgttaccttgtaaagaataatttggatgattaccaaattaattttggtatggtaggatgtgataggttattcgagacatgtttggattgttgtcattttaaattttggcaataccaaaatttaatatgtttgaaaatagtaaaaaaaaagtgaacacgcccttagtttatttatccgattattgaaatggcttatttattttatgctttgaaaaccaatttccttttagaaaaatagtactgtaattgatcaggctatttattttaacttatttataaagttcatcttttaaaatacttaatctattttaaaattgagtagataacttacgacgataatccaaatcaaacaaacctaactttaacactgcaagagaaaccgggctgcaggaatt

SEQ ID NO: 17476 - DNA, 1831 bp, Oryza sativa
tcaatgaccgcccaatcacacgtccccacgtgtcccccctcacctccgcattattaacctcgccacctcctcctctcctcccacctcgcctctctctcctctctctctctctagtttacttttcttggagccaccaagaaaccagccatgtccgtgctcggtgtcttcttggcgtcgctgcttctggcggcggtggcgccggcgagggcggcaggaggggggtgcgcggcggagaggttcagcagcaaccgcgtgtacgcggcgtgcagcgacctgccccacctgggcgcgtccgtgcactggacctacgacgccgcggcgtcggcgtcgctgtccgtggcgttcgtcgccgcgccgccgtcgcccggcgggtgggtggcgtgggggctcaacccgaccggcggcgggatggccggcacgcaggcgctcgtcgcgctgcccaaggggggaggaggcgggtacgaggtccagacgttcgacatcgaggggtactcgctctccgcgccggggaagctcaagtacccggcgaccgacctcgccgcggaggtcgccgccgacggccgcgtcagcgtcttcgggaagctggcgctgcagaacggcaccgccgaggtgaaccaggtctggcaggtcgggccggtctccagcgggtccatggtgccgcacgccatgagcagcgacaacaaggccgccatggggaagctcaacctcctcaccggggcagccacctcttccggcggcggcggcagcaacctcaggaagaagaatgtgagcactcttcaatcttgatttctagtatcattttgtttgcctttcttgaattcctaatcaaatttgagtgcacaaatcaaattgtagttagaaaaggggggcgatttcagctcgaattccaccagggaacttaactccaaaagctaaaatcctggggatttttttttttagcaaaagctctcatattgttgttttcttttattgctttatgaattagcaacagtagtggttactgaagtctgaagcggtactggtatgagtcaatttaatttgaagtatatgcttatgaggtggtagagcgttgaaaagaaagaaaaaaacaacacattttttaatgcttaagagtcaatctttggttaaaataatctttcctgcttctgttgccatgtgaaatgctcaaatgtttatacatatgttcgactgttatatcctggttggtttgagatgatttcaactgtgttaaaatctgtaggaataagatgacgtttgctgactgattatgtgtgacaaaatgccttctttgcttccgtactacacactcaaatttctatgctttcagattgcaattttcttgcctgtattggtttcttcctgctttggtggacttcagcacgatttgtctttcctgttgatggctacatcgaaatgctcatttcacacaatgcaaattcagtagagagtagggagccgtggtgttattgatgttctagtgaagggatcgatctttggttgcaaaccaaacaagctttttcttcttctgttgattcacattcacaaattgcttgaccatattgataatgatattatgatgtattactaattggttcaaacttttttctaattttatatgtgcagacccatggaatcctgaatgctgttagctggggtcttctacttcccatgggagccatatttgctagatatctcaagacattcaaatccgccgatcccgcgtggttctaccttcatgtagcttgccagctgattggttatggtgtgggagtttctggctgggccactggcattcatctaggtaacctgtctaagggaatcacctattcgg

SEQ ID NO: 17477 - DNA, 15503 bp, Oryza sativa
caatcacaccgtttagtagtttaaaatatgtgctaatgaaaaccgaggaacatgacgtttgaagtttcagaaaagaacgctgcctttaacatgaaagttccaattcttacattccttattgatgtttgttgaaaatatatcctacagaactgcatgatttattagccccctacattcaaaaatataaggaggattttgattgtctagttctatgctttgacccttggtaataaaataatatataggttttgctatacaaaaatatatttgttggattcatgttcgaaactcctatttaatgactatgatttcgtaacagtaagaaatttacggtgaaagcttgtctttggagtaaatattaagaaatccagacctccattgctttgttttccacaaaaattctctgaggttcctacgtttgaatcgtgcctaatagcctacacgagagagagctgtgtgcgagtaaaattaagctgatctccatgaggctccagtatttacaagcttgatgtatgcatccttgaagtcggcaaaaaatttagcttggtcctgtgcatataaattgatccatctgcaagtagtttggcatatgcccaatgtcaatggcctgaccaaacatgtgagcatgaaggaaccttgcaaatatatctatttgtcctataaatttgtgacttaaaacctaaagcctaggtcctgactgaaagaattgaagatagagtaggattagtgcatggagtttggaagcttatgattatccctagtacttcttcagagcttgtaacaagtaagcgacattatttagcatatctagttcaagaaaaaaaataccttaagcattcatcatcttcagtgagtgcccaatccgttcgcagtcctaccattgccggcatgccagcttcatagaagaacacaacacattgtattaaggtgatttacaaataatgccaagtcgattgtacattgtacaaggatgatttacaaaggcatgagctaagttgagattcagttatggcttatggattcatgatgacagtatttaaagggcatgatggaaaaaatgaatggacttacatgaagatggctgtggcttctcaaggagtactttaaaataggagttgtcgaaaatatttggattcccgaatcctttacctccaattgtgtgtgctccagataacacaaccatctcctgtgtcctgccaagtatcaagtttaacttcagacatggaaggatgctaagttttgaggaacattttgtagaagcctagaggggaaatcatgtgcagatacgtatcatgtacagatacataatttttaaccacgcattagtaaattttcataaataggcaatgggaattgaattcacaagatgtttgtgtaagtagagaaaaggaggactcacgaaaagccctttttgctgaataatgttttcagcgcagtggcatccaatgtttcttcaggaagtttaccagcaggatcagcagtactacagagtcaaatgcattatttcataagaatatgggtattactttgagaaaatatggatacctacatgttctttaaaaaatatggatgcatactaaatagaagcactgcctggaaatgaacagcctaaaattttgccaacattgcaagggaactgttaaatgaacaaaccactgtgatgttgcacctggaatctaatcgacctagtcttactggaatttctggccctccacatagcgcaactgactcagcaccagccacggcaatcaaatccgcccatgatactgttagcaaagtaacggtatatgtgtgcttgaagatacatcacaaccgaagctcaaaacagaaagaacatataaaaagggtgtaaaccatgtaccttgctgcacaaggtcaattacttctttcgcttttcctaatacctgttcagttataagtcattaaaaacagatatgggaagtcaaaacatgttgttcttcagtaaggatatgttactactatttatgataaaaagcaagaaaaaaaaggaggaaaaaaacctttatggatttatttagcccagtattttcaggtctatcaacttcataaattatagatccattcatgccacctgcaagatattgtcataaatatccatctactgttttacttctcagaattcatctttagataggttgaagtgtagttattcgtagtttgttcttgtttgcaatactctataattctactttatacacattcaatttttgctctaaaactgtatatagaacttcaaccaatgaagacattaaagatcgaacctgatttatcagcaatatcaaaagtccctgcatcatggaaagccaaacgaagcatgccagcagccttgaccttggataaaacattcctcacaccgttttgaataattgaaccatcaattggctcagccctatagagtcaaacataaaaaaacttctctaaaagatgtcatactgccgttttacgagaatgaaactactttgagtaggttattcttatacacaaatagctattgtaggtatactttattgacctgtggttcatttcgacttttgattctaggccatgcttccacaattgaaccaattaaacataaataaaaatactcatagaaatgtaaattaatacggttagcaactcatagctatggaaacttagagcagaataggaatatgattatggttgaatactgcacttacgcactcgctatatgaacatgaggaagtatgaaagggagcagagcaacagaagcaaagtccctccttgtataacaaagagaagatatgggacctgtggtcaccatacacaaagcaaattcagttgggcagaaatatatcagtaggcactggaagcattctctcagttcttgcaatggaaacaactcatacctgaaaagaaatctgcattttgctgctcagagggttctgaacaagcagaatcatcactactgcacctacgaccagcagcagaagctcctatcctcgtcttcccacttcttctaatcctgtatcatcacaattttcacaggtcatgtgccttccatgaacaaatgatggcacggttggtatcaaagcatgagagaagatgcaaacattacctgcaggtgcaacgactgcagctggagaagaagcgggaggaggctgcaatatgggggacattagtgagctccattcccgtccttctggccttgttaactgtcagcaatggctgctactatcctgaactgaaagaggaaaaggacacaactcactagtcactagtcagccagcctatctctacctggctatacatgtgtggttcccaactgatggtccccaagaaagcactttggataagctgtacttcagtggtaaatatctgcccaattgtagttctgaagaatatgcctctgatactccagtgattatttttagaattcataaatgccattaatgtctcttcctatgtggatatctttctttcaccagtaaatactcccatctgttcattaaaccttttatggtaatagagtatgatttgaactgtttgtgccttactaaatttgcaatttcaacacaaatctataaaacaagctaagcaaaaaagaaaaaagaaaagaaaagagcaccaacaattaacacaatttagaaaacaaagtaagccaagatcccaccgttaaactcaattacaagttactgctgatgccaagaaatcatgttcacagaacaagtgagaaaaatcatagtttgttgatgtaaacaggtagtacagaactttctaagcaaactgcaatgaaattatatgcttatttacaacagtcattgcatgtttgaatgtgaattatctgcttcagtgtgtaatatgtattgtcacatataaatgagagaacatagtggacacttacataaataggctacaaatttcgcaaacaaacacaggtggtacttgggagctattaaaagtaccatgtatacgcttttctttgtttgggaagctagctgtctgtgcctcaaatttacagggaattatccgtctatataacacagattgcttaggagtccaaattctttgaggatggattgaacgccacctggtcagcacaatccaagttatctccagctttgtcactaccaacacccatcaggtcgagataatgttggtagtgggatacaatgacgttcatcttatcgatggagccttgaccacagatgagatcgccatacaggatgttcattgtagcaccaaagccaggatacctcttggacaaagtgtcattcttggttggtttccagttgccaacgaatacatcatgggctgatggttgcttcctcttcattggagtcatccacctccagattgctgcttcaaatgctagggtcgcattctgttccaataactctgggtggttcaacagatcctgtttgataccctgaccgataataccatagttgtagttcctgaataccatgtacaagcagatttaattagtcagtaccttaacctaatcagttactaatcaacagctatcaagatagggataggtcagcctaaccagtaaacaggaagagcgcctcgaccataatactcgactccttcaacacaaggatacaattcgttgctgttgtcacaatagctttggcttgggctcaattcatggttgtagcaaagcccccaagccaatggaccaccagttgcgacactatatccacctgtagaaatcacaattccaatactctatcagatgctactagcctagggtttttttattcatctgaagttcacgtgttcggtgaacaacagaacatatcacacagttggaacgaaacttctgaagattgctaccaattgaacaaaccttaggttacaatcttctttacaaatcaagtacatattcaaatcggaccaaagtccactgtgttgtgatattcagaatttcagatgcagaattgcagttgtctacttttaatatggaaatgccaaggatgatacacgatgccaatcaaaactaattaacatgctccacatatagctgcattcggcagcaattaactactagctgagataaaaaattgttacctcccattctacacacggatccagattactttcagatcttaaaagcaacactccgcagagcacctatcctaaagattacagtaggccgcaaatctactaccaattcgtccatttcccccaatctatttctcgatccacgcaacatcaaattggtaaaatcacagtaacgatcagcgagaagaagaagaagaagagcagcacacgtacaggaggtcttggcgccgacgtggccgaggaaggcggcgacctccttcatcccaacctccttccctcccgtggtgccgaacccgcggggctcgaagagcgcggcggcggtgatgaaggcgtggtagtcccagaacccggcggcgtgggcgagcgagcggtcgttgcggtgggcgaagagctcctcgaactggtacgccttgaagtagtcggtgatggtgtcgttgcagcagaaccggctcccgctgcactcccaccccttgtcgcacgccttcgcctcctcgtcgccgctgccgtccttgtgcctcctcccctccgccgccacgagtagcgccaccagcagcagcagcggcagagatgccgccgccgccgccgcacgcgacgtcctcatcgtcgccggcgatgcggatgcggagcgcgtgatcggcggaggaggagcggagaagagagagtgtcggtggtggggtgggttggtgggggcaagctggaagggccgatgtgatatcgctgttcgggggtattttcgtaatttggtgttattgggttgtttcgaacttcagatgggccggtgttctccggctgtctaaaaaggcctcaaggcttaaggcccattttgtgatacggctttcattggagtgaaattgagcaatttcatagaagaagttcattattcatcccccaattatagccccaaattgattcattcaacccaaaaaccagatatggagcatcccaaactattaaaacaagatcaatttatgtccctaagcggtttggtgattttatctaacgtggctgcttacgtcgcatttcattttagaaaaagaataaacaaagctattggtggaccccaacatttcaacaacactcatctctctcctcccttctttctttcactttccattttctgatttcaatggcgacacacattttctttcagacataggatagggcattataagttctgcaccgtttctcttagtacgtgtattcattcatgagagttaagatgtgttattttcgcaacggctattattggaaaaagaaatcaagtgtactatagtattttctattgtttattggtaatccaatgtactaaacaaagagattaagtaaatacaccatatctttttactaatacaaaaagatttatatgttcggcttttggacgtacatctttacatgtaaggataaaaatagtcataaaaattctcgatcgatctagaattgttttcgtatgagtggtaccgtttctgaccattactattttaaacctaaaaaaattggtttttctaagagtgaattacaccttgagccacctttgattaccattgttacaatttggactaggctaaagccaaacttttcactttgggccaggtatctttacatgatgtttcaatttggactcccttcttcttcctccaactctcttccccctctctccccttcaatctgtaaagtcttccaaagaattcaaagggtagtttgcattttcaatcatcgactacctagtgcttgtggcttaatttcaaggacagcggagggtgcacaacaagtattcctactggtagcaactagcatacgaagaagctggccggcaatgacagacagttgctgctactttctgaactgacgataagaactaagtcaagtagcagatagccatgctcaagctcatgctcgacctccgctagtgctacatgttatgctgcacgcctgcgctaaatttccacatgtgtcgctcgagcttcaacaagttttgcaacgctcaagctccgccttcgtagtgccgcctgcatttgagctcgaaatcaacttcggcgggtggctaccctatgaagaagggttttgcttcttgccttttcatgcactacacctgatcgagaaagagaccttgagctgtacagagaaaagagagtaagaaagggagttggaggaagaagaagagagtctaaattgaaaccttgtgtaaatatacccggtccaaagtgaaaagtttactttttcactggttcaagttacaacacaggtaagaaaaaatagtccaagatgcaatttactctttttctaatttcgttcggtgtcgcattaatctcgatacttaatattttaattgataaatattatcaattattaaacagataagcgtcgttttcgaagatacgttaccgattccaaatgttctcatccttattcttatcgacttttgtttttctccatttgaccaaagcgttttgagacggagggctttgttgttcagccagcaaataggggagtgtttccagtgtttttccaccgaagaaaggcgaaaaaaaaaagagaaggcagcgaagatttctctagaaagagagacgattgtcccatatccaccgatgccggattagatccggtggactccaccgatccacgggccgggggcccattccaacttgcccagccactggtgggcccaccggccacctcatttccctcaccccccaaccaaaaagataaaaaataaacaaaaagtttaattcgccgccacgcgctttgccggaaagccccaaaagcccgaccaccactgccgccgcgccgcctcctcctcctccgcctccgccgccgccgccgcccgccggccatctccgtcgatccaccgtccggcgagcagacagcagcccggcagatctgcccccaccacgggatcgaatcggcggggggaaccgaatcggggagcgcgggaggcggggagcttagtttgagctcggtcggcggcggcggcggcggccatggtgaaggagacggggtactacgacgtgctaggggtgagcccgaccgccaccgagtccgagatcaagaaggcgtattacatgaaggtaagtaggattcgtcgacttgtcgtcgtcgtcgtcgtcgcttgattttggtctgatttgtgtttgctggtggtggcgcaggcgcggcaggtccatccggataagaaccccaatgacccgaaagccgcggagaatttccaggtaggtgttccgccattgttctactactggcaacttatacccttataatcaactcggtgcaagcagctcacagggtagtgtagaaccctcgattgaatcagattagatgcttatttagctggacagctgatgcgcaaagtccgagatgttggacagattagatgcttattagctggatagctgatgcgcaaagtcactatcccagcacgctgttctctgcggattggtttcgtaagcagtcgtgtttttgtttgtttggctagttaatcagtaatcactttaagtttaaggttatacagctaaatgcttattagtaaccaccattccaccagtctctattactctgaaaacataaaatgtgtctttgccttttttacgtttgagatttggttaatggtgattagctatatatgctaaactaagtgtttgcctatctaaactgctctgtgaaactcaacatcaggaagtttaatatctaacatttggaatcagaattatattgctgagatatatagtaagttctagttaggccattcaacttaactatgcagatcgaccattccacaaatgaaatctgtgtaataacatgccagttaatgatcgcgaggttatgatatgatatctctaatctacttaaaaaggcagtcgtccgtccgcactcccctccctccaccacgcacagtgagagaaaaagaggcatgcagcgcatgccccacttgccccacttgctccacatcctcgcctccccaaaaaactggatttatttaacagctgacagaaaacatgtaaaaacaattaaaaaaattggctataaacagaaacagggcacaattaatattttataggtccgttgcaacacacgggcatttttactagtattagtaacatatcacattcttctctcctccctaactccaaagcagcaatgaatatatttgaagctgttactgcatagccattgtagtattatatggcattggctttattagaaagggtgctttttttttttttgcatattttcctattccgtactattgttacttataggaattctcattgcaggcactaggagaggcataccaagttcttagtgaccctacgcagcgccaagcttatgacgcacatgggaaatctggcatctcaacgtatgtgctgattttctcaaagaaattatatgatgctcttgcaaaatattgaaaagctttataggattttcatggttattaatttgccatttgtggcaaagcaacgccagtactatagttgaacttctttttttttcttccattcgagagatgcagatttttgtgggatacttagtgattacctcttttttgttttgaataataataccagacaacaatgttctagctcatttggttttgaaattctatagggaagggataattgatccagcagcaatttttgcaatgctatttggtagtgagttgtttgaagattatattggtcaactggctatggcatcaatggcttcacttgataatttcggtgaagatgaacatattgacacaaggaggttgcacgagagaatgcaggcatgctcctttagctggtttattttatatcatcttccatgctcattgaataacatgaatacagtcaatggacattaatgtatgattcttttggcagctttcttttcatatttgttgcatttttcatattcttctgccacaatattctgctgagtagtatacttcaattcaggctgttcaaaaggaaagggaagagaaacttgcagagacactgaaaaaccgactgcacatttacgttcaaggaaataaagaggaatttgtccagcttgctcaagctgaggtgaccagacttagcaatgcaggtttttgtcaatactacccaccctcttcctcaactctgacttccccccttgctctcttcctttcctgcttaagtgcttattgctgcaaggacttgctcaacacttatcttagagaagttggcatatgatatttaaggaactgtacctatttatcacatgattgaatagataactgcataataagatatcttgacaagcatatctcatgagatggcatctagaatcatccacttcagctgaaacagatccaaaaattagtatgctattctttggctacacatacttcttgctgagcttattaattgaagtgaatatacaagcaccataagctcattctttttttttttaattatgcgcatgttgtaaaaggatgtgaatggcctatatgctattcctgcaagtatatgatgatgttagctcgatggcatattaccaattttccctatattaaagtatatttgccaagttcgtaaatagaacccattaaatgttcgttttggtatattttgttgtttttgctctgttgagtgctcattgtgacttcggttggtctttaagctacattatgtgaactttctcattctgtttggtcatgttttgcttcttgtgcagcatatggcactgttatgttaaacactatcggctatgtatattcgagacaagctgcaaaagaacttgggaagaaagcaatattcttgggtgttccatttgtagctgagtggttcagagacaaaggccatttcatcaaatcccaagtaacagctgcagcaggtaacataactcatcaatatatttaacttgaaagtatatgatacagctaatgtcatctattgtgctagcattatattaatcataaagaatttggttgtctcatggttctgtaggtgcaatagctttgatgcagttgcaagaagacttgaagaagtatcttagtgctgaaggccattacacagaggaggaactagaaatgttcatgcaaaaccacaaaaaggttatggttgattccttgtggaagcttaacgttgctgacatagaagccaccctatcacgagtctgtcaaatggtctgtcccagcttacccatcaccgttttactcatggttattttttaacataactagtgtgatagtgaattttgaacattgtatggatgccaggtgcttcaagatggaagcgtcaggagggaggaactgcgtgctcgtgctaaaggactgaaaacattaggcaaaattttccaggtatagcttgttcatttgttcattaaagttttggtgatgctgttgacattttcattatatgacttgtatttacccttcacttagcgggttaagctcaacaatgatgagggggaagcatcggatatgaggaatatagataacatggatgacaatgacgggagctcccccgatacatcaccaagaagggaaccaccatacaatcctatccctaaccctcctcatgctcaggtagcagctcattatgattttttacttctgtcgaatttctcaagatggccatttgccactgtccattatcatggtgccttattgattgactcattgagagattgaacttggagcacagtaattaatctataagaggcttaagagctcttatatagccttctctcatgacatgctaaaatacttttttctcttgttctagagcccatatgtggaggccccacagtttggaggaacctattacccattcaatttcccaatgccaacagctccacctggtgcgcagagggatccaattccatgacaccatttaagcttgcatgtgctgttgttctgtgcaatattgctggtgaaatactagatcatttgtgtgatgcatcatttgtacctgtagtagagaacggaggtttagctatccttcgcaccatttattcggttgtacaatcagagactggtcaggtagcagccgtgtactgttgtgtacagttgttaacgctcgtgttgaggcagtagtaggtcagcattggtgtacatggtttggtgttaatctgcggcctcgttccgtttagcttgacgtgcatcttctatggaaaatgaagctgagaaataaaatcatgtttatagttttgggtgtatttcatggaaatcattgtgaatgagtttgttggcggcaatgtcgaataaccataatgttttggaaatatcatttggatgagaaactgttggtctttctgcttactgtactatggcataagatttatcaagaacaaagaaaattcacagcatccagataatagagggaaaatatattataataattcgcacgaacagtgctcgtcgatgcttttggcgatgttgtcgccgacgtcgaagctctgcgtctcctggtaatctaggttgaagacgaaactggaggttaacatgttggcaataatcttgcaagcgaccgatatctatatgtaaagtttttaactctcaatccgttttttaatctcttcaataattaacgggaagtcctgcctaagatgaaagtagccattggtgacggccaccttcttgaagttgctctccgccatcaagaagttgaggcacttgctctttagctccgggcaatggtacgtctcggcgtagcctagcgtcgtcgccaccgtctccaccgacacgctctcccacagcttctgtgcacacatcagcttcaacctctccaatgcgtacctgtccgccgccacgagcaagctctcgaaaaaaccggtcgtcgtcgacgacgacgacgacgacgtcgatggcgacggcaaggcgtccgtgtacacgaagtgtagtagagctttgaacgtggccggatcgatgtcgtgcagggtgacgcacggcatggcggcctccgccatggacccgaggagctccgccttgaacaccggcgagcgcgcggcgagcacggcgcggtgcgcgtggaacgtctcgccgccgacggagaacgacacgtcggagcagtcggcgcggtccacgatgccgccgagctggccgccgaggttcgaccgcgggacgggtatagggccgccgtcgtcgtcgtcgccgccgccgccgccggcgtcggcgaagaccacgacaccgcagacgatcgtgaccacgccgtcgacggcgtagagcggctcgaggtcgctccgcctcacgaggtgccggaacgcgccgccgtagccgcgggggtggccggggacactcatcgggaaggccctgtccgagcagatgatcgacggcgcgccgacgccgccgtcgcggcgcatcaggaaggtgtggaagatggccctgacggtgttcgatctcgccggcacgccgatgcgcagggagacgtactcgccattgtcctcctcgcggtagccgcgcgggtagcatctgatgacccacgactgctccccgtcgccgacggcgaagctgttcgtcgtcgtcgtcgtccctgggtactcgagcttcaactcggcgaagctggatgatatcatcatcgtatttttggtgtattattaattaattgcaaaaatatgccgccaaacggacaaattaataaagtttatatatatcgaaaatctcacggacacgctctgcgtatcatgacgtgaactagagtagttcatgacgtgaaccatagtacgttgtaggaatttattttcggcaagataaatgattccttttttatgtacgcatttgagtcatattttgattggtaggagataataagtacttggtgttttatgtttatgctaaactaaacatgtctatctttaactattaatttttaagaaaatgtatggtttaacataataagatgttatgtttttagattcaccatgaaatatatttttgtaatatagatatatttacatgttgtcaaactatatgattttttttattgtttgacttcagatacaacaatgaatttgtcaattttatggattagatatgtcatataattggattcgtaatcaccatagataccacatatatacctaatattatacgataaggtatattgaaatataggaaaatagcagataagaacaacaactcttcgtacttgagggaaggggattgggagtttacacgagggaattgatggtgagattaagataggaatttgatttttcatcccagtctcttgtttggtagaggtaatggaaattgatagggagtttagttggagattagatcattaatgaaaatggatggctgagatttgtttaggcgaagtaaaggagaaatttcctcccaattacctgcccctacccaggtattgaaaatgagggagttcatttctcaattctctatccccatcccactaaaattcccatgtcccccaaccaaacaaaacagttaatagcctcatccctctaaactcctaatctcttctaaaaactccctccaaccaaacgggccacagtttacacgagggaattgatggtgagattaagatgggaatttaatttttcatcacagtcttttgtttggcagaggtgatggaaattaatagggagtttagttaaagattagatcattaatgaaaacggatggctgagatttgtttaggcgaagtaaaggaggaattccctcccaattacgtgcccctacccaggtattgaaaatgagggagttcatttctcaattccctatccccatcccactaaaattcccatgtcccccaaccaaacaaaacagttaatagcctcatccctctaaactcccaatcccttctaaaagctccctccaactaaacgggccgctaaggaaatatatataggttgtcaaaatctgacctaaaaagggcaaggtcttatttactcaaagttttaacacgaagtgtagtagagctttgaacgtggccgggtcgatgtcgtgcatcgtgacgcatggcatacggtggtctccaccatcgagccgagggactccgccttgaacaccggtgagcgagtggcgagcacagcccggtgcacgtggaacgtctcgacggaaagcttctggtttttctttcaaggagtaagggcaaaagctctgccgaaggatttcattaagaagggaaaggcctaaggttcacatcatacagattacaaggatcaaaagatcccagacaaaaggcttctggctattttttggtagtcaagtttgtactcgatgaaaccggaggccagcatgttgccggcttgccgccggcgaaggatgaactttctcgagagagaatttttttacccacagcaatgtgaagaagatcgatggtgaggaagcgacggtagttgctgccgataccgctggcggtttaggcggcccatgaagtgcgcagacctagtcaaggcccaagttactccagtctaaagaagtctaaccgcaattcccaagccaaccaaactattcgcaaaataacttttttctttttaaatctagggcctga

SEQ ID NO: 17478 - DNA, 12492 bp, Oryza sativa
caagaagtctacacaatgtcagtatcagttgtagtgagtcgtgcaacagaaggttatttttgggaactaatgccgatggacagcactgctgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggccatgggcatggcggatgagggggagagagtcggtataattgttgatgaaatggagagggaagattcggataatgaggaagcggacgacgacgcatcatccgatgaggaaggtgatgtaatggccactgattgggcaaatgaggacttctctggacttgttatatcagagggtgatcatgtaccctgggagtataaggagaacgaggtaattgacggtgcaaggtatgcttataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagattattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagatgagcaatctcgcagaccacaagttgaaggtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacatagtgacaaagtacatggaagaaaaaatcaaaaaggcacggagacatagagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttacttactcacacgttcttgctgctgccggtgattgtggcatatctcccaatgtgtacatctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcattagaaatgatatggatgagtcagaagcaggcgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcagacgattccatggtgtaacaatgctatcgatttaggaaataaaatgctgttgtgatgtgatgagtgttcggactaaatacttctatcgtgtaatttcaattgaatgttgttgtaatgagtacctccgactattgttgtactagtagtattgcgaactattcggtgttgtatcataatgttatcgtgatgagtgttcggactaagtactcatatcgtgtaactgcagttattgttgtaatcagaaatatttcgtatggtaacacttttgtttgtttgtactcttgtttaatatgtgttagtaattcgcttatgaacatttattacttatgttgaactaattatttatatgtttctgatcaatctatttgatgcaagtatggcgtacgacacaccgacgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccggccaacacccttcctccatactctacagtcgggcctagcaaggcttggttgctctagttcactgtaagtaaataagttgttattatcatacatgcttatttgcgatcaacagagtgttttgtactaacatttcattcttaattgtaggcggaccttctgcaccctgacgctgatgataactcggtccgacgctcccttgaggcgtacctgttgtggttgttcgggtgggtgatgttcactagcacccacgggcacgctgtggacttccggctggtccactacgcacggtccatcacggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctgcgagagcaccgctaggactttcgtcgttgtgcacacgcgaccaggcttactggctcaccatcctgctgatggtgttcgacattttcgttgagccttactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactacctttgctggtacctttctcgcactcgtgcgcgtgtgaccttcactccagacgccccagagccgcacgttgccgctgtgacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcactgcagtccaagtgaggttgaacagaggtttgcacttgactgacgttgagcagagggtgaccttcgaccggatgcaggagaagatgcgtgcggtcatgcgcgtcttctcctgtcgtagcgccgtggacgtcgtacctccagctggtccggtacaaccacggcctcgcgcgcctaccgtcggagcaggacctcgacctacggtacctgtttcgcatggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttatttcagcttttgcacgaatatgtcaccatgttttaacggcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattaatactattaaatacctgtatgaaactgatggtccttgtccagcaggatttgcagccgagatcttcggtactggggcctcttcatctcaagccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccatttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacagtccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaaaatggaagcgccattccttgagcgtctcaactggcgaagcgatccttttgctagttggtttccaccatggtgtgaccgtcctttgtgcgattgtggggatggatgcatactcaagtcttccctcatgatacaaactcggggcaggagattcttccaatgcgcgaactttgatcaggtatgcttcatctattcgaagttcaaatggataaaaaaaactaacttcttcgtacacaattgtaacatcttacgcagacatatcgtccaatgtgcaacttcatcgagtgggtagacatggagaacccacaaaacgacggaacccgtgcttacccacgtagtgaaacaagatcggactacctaaggcggaaggatgagcatgaacgtcgaattgctgctgaggctttagaatggcacgtaaatcccctaggactccccacgtggcgtgagcgtccggagtgtcgttgtggtgactgttgttaggtgataaggtctgtaaggcaccgaactcgaggacaaaggtgtttcgtgtgtccaaacattgtcgacaatgatttcgtggtaattacaactattcttttcatcactcctcagtactatcattaacttaactatcccaaaatggatgtacataggaggatgtaaggaaatgtcaattcgtacaatggattgacacagtcagagttacttcaagtggcgggccgataacgcaacctgaaccgaccatacagttcattcatgcttggatggagtacgaacgtcgggtggaaattgcaagcttagactggaggaacaatccattagggttacctaaatggtccgagcgtccaaagtgtgggtgcagagatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgatttgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagtctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatgtttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccctagggcggcaagggggccgcctgcaaaattccaggccccccgccgcccatttgcaggcggccccccgcatagtacaaaatcgccctagcagaggtcggcaagggggccgcctgcaaatttcgttgacggccgtcgcccgagagcgaacggccgtctgccacgtcactttcgccgccctctgggatggcgatttttaaaaatcgccctcccagagggcggtaggcaaccacttctgtcaattttcaaaatgaaaaattatttttgtaaaacttttaataaaaaaaattaaaaataaaaaaaattcgcgtgatcggcagggggtctaatgcgccactaacctcacgattagtaattgtgtaattaatgataaaactgagaaactaattgataatcgtgtacatattttcctttaatctatacggtcatattgtaacaaaagagaaaaaatattctcatactgttatattcacgccgtttcatattataagttgttttgactttttttctagttaagatttgttaaacccgaacaaattcacatgaaaaaaatagtaacacttaaaatattaaattatttttaaaaaatctaatattaaatatattttgataatatatttgttttgtgttaaaaatgttattatgtttttatataaatttggttaaatttaaataaatttgattagaaaaaaatcaaaacgacttataatataaaatggaaggaatacattccaagtcacaacaaaatgggaagaaatgattgacatggaaattgaatgattgccacgaacaagtatcgcaagcactacagattaacagaagccgcagaggcagattagagacggaaacatacattggtaggaagtcacagtactatccacgtttacaatttttttattcctaaactatccttattgaatcaatggtgcgtgttcatccgagagggaggtactggaggtacctctcaagcacagtaaaagcgttttgtgcactctcttcggtgaagacctgatagtaaaattgagtaccaaaaaagagaagagcgtgccactgattcgcagttttgcaggctaataacaacttatcaacatttagaacatctaattgacgctatcaaccgaataaaagggcgaaatgtagaatactcttgccactaaatatctttcaggtctcatctctcaagtctcaagccgttcttttattggtaaattggaaccatgccattataattttgcaaagtttaagatatgtcatcggtatctcaatgatatatagaacccacatgagtcaatgacacgtgggtcaggatggcatatcttaatttttacaaaattataatggcatagctctaatttttccttcttttatctcttcgataactaagggaaaattctgtataagaagaaagtagccgtcggtgaccactaccttcttgaagttgctctccgccatgaagaagtcgaggcacttgctcttcagctccgggcagccgtgcatctcggcgcagcccagcgtcgtcgccaccgtctccactgacacgctctcccacagcttctgggcgcacatcagcttcagcccgtccagcgcgtacctgtccgccgccgcgagcaaacgctgatgatgaagcagatgatcgctcgtgctcgccgtcgtcgacgacgatgagccctcgatgatctgcagaacgtccgtgtacacgaagtgcagcagagctctgaacgtcgtcggctcgatgtcatgcagcgtgacgcacggcatggtggcctccgccgtggagccgaggagctccaccctgaacaccggcgagcgcgcggcgagcacggcccggtgcgcgtggaacgtctcaccgccgacggagaaggacacgtccgagccgtcggcgctgcccaccatggcgccgagctggccgcccaggttagagggcggcacggctatggcaccaccgtcgccgagaattacgagcccacatatgaatgtagccatgccgtcgatcacataaatcgactcgagatcgctccgtgtgatgaagcgatgccatccaatggagcgatgccatccgatgaaacgatgccatccaaggaagcggaagccggaggatgttcccctaattacatctatagagctattctttgcacagagtgaagatggtttaccatctttgttcatcaagaagacctcaaagataacattgatcttggggtcgatctcagtaagcagcaggaagacagcgatgtactcaccattacggccctcacatccacgcgggaataacaaaatcgtcgcattgtgctccccggccgagattcttattccgggcaagcactcgccgatggcaagcttctgggtttcgaggtaatcaagtttgtactcgatgaaactagaggccagcatgcttgctgccgtgtactccatatttgttgtatgggggcactggtggagaaaccctttgtagtcccggttcgtaacccccctttagtcccggtttccaaaccgggagtaccaatccgggactaaagatcgagctgacctttttttttttcatggccctgttgctgcatggtttatatatatatatatatatatatatatatatatataaaccatgcatatatatgtttcaatacatatatatgcatacatatatatatgtatatatatattatattatattatatgtatatacatgcataatatatatgtatttatacatatatatgttatgcgaatgcatatgtatatagatatatatatgaccaaaatatatttacattatagaaaatgtgtacacatgcatatagaaacatatgtagtcatgtattaattacaatccattatatgtcctagctagctacgattttgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcactacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacagaaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctatgttgtatggcaacagtatgaacgtcttgtaatgctgcgccttcaggagatggacgagattgtcctctgtttcttgtggatattggtcgagcattgcgacgtttacttttcgagggtcgatgaatccagtatcgaaaaccctccgccgtcgggccctttgaatctccattctacaatgataaaagggagtatattattttctatagtctacttatatacaaggacctaattaattaaaggaggtgtatagtaagaaatctaactgaacgatatacttacaaaatccagcaactcataatagagacgtcgagggcgtccagctggtatagttcgtagattcccctgaaattgttccagagaatgtcatctccttgcaagaagtccgtgtccctgatcctcgctccgatcatctctctaccggtggcgctcatctccatgtacagctgatggaacttgtacatttatgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcatcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactgggggtctataggaatcttcttttctggacttcgaggcttgaattgtctcttgacttctgatgcaacgtaagcgtcaagctcctcttgcgtgcaatcgtaccccgggtccttgttcttggcggcgtcaactt

SEQ ID NO: 17479 - DNA, 2409 bp, Oryza sativa
gaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcttgtgtttgcatggcgtccatgctctgtgatcctacctgccccgttgaggcgcagctgctatggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctccacatccgactcctgtacgtgtggatgtcctccttgaaaccaatcttccaaggaatcacccctttccctcgtgttcatcctggatgctctggagtctgcagggcgagtgtcagctcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctactcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatccagcacaacctaaccgttgtgacgtacatagttcttggcggcttcggccggggcactaggacgtccatcttcttccacttccgttatgatgtgccgaccctcaagcttcttcgctgcacctcgttgcccgcgtgccctcttttgtccaacggagggttgactaccactagcctcctcctcctggttcccctccacatccttttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatatatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatatatatgctaagtgtttcgtgcgtatatgctaagtctaattaagactacaatagtcaattgctacttgtcgcaccaattccgtagtcaataattacatactaagtctaattacaaataaagtaatattatattaaaactcaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaatacgtcttttctgcaagatacaaaaagatgtattaggataaatgcgaagtaacatatatatatatatatatatatatatatatatatatatatatatat

SEQ ID NO: 17480 - DNA, 768 bp, Oryza sativa
gacattgccccacttcattcggaagggcttctaatctatccggatcgatgaccttctgcgaaattccattcatgaatgcacatatctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttctttcgtaccgggtggtttgctgcaaggaatcgacgatgacccatgtatacaaccttcctacagtggt

SEQ ID NO: 17481 - DNA, 1355 bp, Oryza sativa
ctcgcggcaacgtacgttgacgtgttcgttctcgctctcgttcgttcgatcgttctcgttctcgttcacgttgtcgcggcaacgtacgttgacgtgttcgttctcgctctcgtttgttcgatcgttctcgttcgttaacggcggtgtggcggcatcggggcggcggttggcgcggcggcgtggcggcggcggcggcggcgtggcgacggcggtggtggcgtggcgttgcggggccgtggcggcggcggcgtggcgtggcgtggcggcggcggcgtggcgttggcatgcggcggcggcgttgcgcagcggcgaaggcggcggcgtggcgcgtcgtcgtcgtggcgtggcgtctcgtggcgggcggcgcgacggagagagatcgagatcggagagatcgagatgcatgaagggagatctggcggcggcggctctcaccccagagatgcggcggcagcggaggaggtggaggcggcggcgaggacgacgagctcgagacgacggcgagatacggcggcatcggcgcggggatttgccctaggcagtggcggcgaaggagagaggccgagagagatcgatcggccgaaaacgtctaagtgttggtgaagaagacgagggcgcaccgggaatatatatacccccggatctttacgcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatctgtttataaaatagaagttaatgcattaacattatttaaagtacaaagattaatgacaattacttcgaaaaattatttttgtctgtaataaattaagtggataaatcgtaataagcaaatataattaataaaaattcaaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattg

SEQ ID NO: 17482 - DNA, 613 bp, Oryza sativa
aaagataacattgatcttggggtcgatctcagtaagcagcaggaagacagcgatgtactcaccattacggccctcacatccacgcgggaataacaaaatcgtcgcattgtgctccccggccgagattcttattccgggcaagcactcgccgatggcaagcttctgggtttcgaggtaatcaagtttgtactcgatgaaactagaggccagcatgcttgctgccgtgtactccatatttgttgtatgggggcactggtggagaaaccctttgtagtcccggttcgtaacccccctttagtcccggtttccaaaccgggagtaccaatccgggactaaagatcgatctgtcttttttttggtgaaagaaccgggagtggagagggatctttagtcccggttggatatacccatatagatataagccctgcctagtatatgtttcaatacatatatatgcagacatatgtatatgtatatatatattatataaaattatatgtatatacacgcataatatatatgtattaatacatatatatgtaatgcgaaggcttaggtttttagatttatatatgaccaaaatattttacctttatagaaaatgtgtacacat

SEQ ID NO: 17483 - DNA, 561 bp, Oryza sativa
ccccgccgccgctgggggcatcgatctcagcgcccccgcccccgcccccgccggcggcgactggcgctcccagctccagtctgagggacgcaccaggatcgtcaacaagatgtatctactcatcccccttcccttctatgttcagatgcctccggtttcttattagctttgacattcttgtctagttcacctagtctagatatccaattgaactctgtttacatttcatcggacacagttacatagaaaaacacatacatacagtatagaggtttgcttaccttcgactggaagatgcaccccttcccttatgttcaaatggatcttcccttcgaggggattatgatggcaaggcaaactgtttgatggagaaaccacctacctctctcgtttattttacttctttatgttggatcatgtatgtccacttttggtcatagccactagtagtatgatatttgagggacatttaacttttttttcacttttaagatgtggcaattaattatctgccactcgctgtgtataacatgtgagccctcatgtgtatatgacatgtgg

SEQ ID NO: 17484 - DNA, 282 bp, Oryza sativa
ttgcgtaatggtaaccttgatttggccttggagtattatgcacagtctgctgctgcaatgggtggaggagaggtatcatggattggtcgagggaatgctgatcagcagcggcagcgaaatctaatgttgaagcaactgctgacagagatattactaagggatggtggcattcaacttttgcttggtccaagtggaatgggggaagaaggagaattaaagaagtatatgatggattggagaagcaggcagcaattcttacttgaagctgcccatcagtgtcat

SEQ ID NO: 17485 - DNA, 673 bp, Oryza sativa
tttatgcttcgtttgctattattaatatgtatctaatttctcattattttgacgttgtgtgagtctgtcttatttaatcgctctatgcaaaatgatctatgcataaaatttcgctcttatttgattcccttatttgagtcctttattgctttatttaaatttggatttgagcatgcattgatcctactcctttgtcttctctagatggccggtcacccacccaaccaccgcggagaaggcatgatcgactttgttgcagagctggcacgcatgacactggtagtgggctaccccgacgcgccggagtacacgacgattccgccgctcagtggcgagcttcctcaccgtgtccgcttggaggtccatggttacgtggggacttgcctcgctaacatggcggtcgaggcgtcaggaggcacagcagatcacgcttgtcaggaggcagcctacctgatgatggccagactacgggagcgccacaactacattttccacgacacggcgtaccgctaccaccccagtcgagcccacggtgatggcgtcagctccttccgtccaacagctggcgagaacgacaccacctttggccacatgtgtgcggtgatgaggggtttggacaggatgcactcggatctgcacaaggcgaccaaggccttgaatgatgggaagctca

SEQ ID NO: 17486 - DNA, 627 bp, Oryza sativa
  unsure (1)..(627): unsure at all n locations
tttctgagctgactgaatttgggatgcattgcaaatttgcaatagagttggagggaaggataacttcttccactgcgaaaaatgtggtgagtcagtgtgatcctacatctctcgatactcggtactgaaatcccaagctattactatttactggtgagatggttgaatctgaatctctcaattccacttttaaatatctgttgaaacacaggatcatgctactcggtcagcctgcgcgacaagcactgctgcatcgagaactccatgaagaacaactgccccatctgttacgaggtgtgtgttctaatgtnnnnnnnnnnnnnnnnnnnnnnnncgctaccttctgcatactgttcatttaaaaaaaatgcagtctcttatgtacgaaactgtcgatcgtcatcacaaatgcagtatctgtttgactctctaagggagacgtccgtgctcagatgtgggcacacgatgcacctgcaatgcttccacgagatgctgaagcacgacaagtaatcgcccatgctgtgttgatctgtttccatgtggctctttctttctttgtttgtttctttactttgtgtgctagattagtcatctctttcgtgtgatcttgttcttcttgatgcctga

SEQ ID NO: 17487 - DNA, 659 bp, Oryza sativa
tttttttttgggaaaatcccagacataacctgtgtccatcgtgattctcatttaacttagcttctctggtgcctatataaacctctccatggtgtccatctgcagtgcacacacagaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtatatatatatatatatatatatatatatatatatatatatatatatatatatatatatatatatgtaatgaagttagcagcaggaaagggtaaacaacctcgagaacttgcatcatataattgttaaaactccttaagttgtccttttgtgcttcttgaatggatgagacgattgccatttcatgaagctgaaaacacatgacatgtttcaggatatattccatgaaattaggagaaaatgcatgtaaaagatgtatgacggtatgaagtgtgcacctgctgcaggtactcctcga

SEQ ID NO: 17488 - DNA, 5840 bp, Oryza sativa
ttttgttattgcgttatggtaggggaaaagagaaaagaaagaagagaattaatataatctacccttagctagtatcagtcagatacacagatccaggggtgatccaacgtggggacggtggggtctcgatcgagcccccagtactggcgcgagtactatgaagcccccataaagtccccgctaaaattttttgatatatgtagttgagaatgagggctgtagcttttagctactttattcagaccctcctgctatctctttctagatccgccactgcatagatcataacgcttgtaatgttcaaaagaaaaaaaacgcttgttagctagatgagacatggcaccacatttttaaaacacatgcgcacttcatgcataaaagacaccacagtggtggttcacctatacccactgtcatatagggctcacatatatagcgaatgacctgataatacaaaacataaagaaatttgtttggactatatgataaaaagatatacattgatctttgtccattctttgttagaagcaacgatcgtacttatacttattaggcacaattttaagaatgaggaatgaaaacaaagaaattaactagccccttccactctccaaaattatttttttaaaaatatattcctgcacgcataaaatctctatcttattggttgcatgtattatatttatattaggatcattcaaaaacaaagtgataataattattttctggtctttgaaattactaactagctagttgtgccttatatttgggatgaagagagagtataatagtgtgcgagtgttcatagagatgaatgtgcacacgttatgagcatctgcatttgtattgtgtatctaaaaagaaaaaaattactcatatatacattggtttatgtcactagtggaaaaaggatctttgctcccggttcgtaacccccatgtactcctgcttttacaagcaggagtacgaatccgggactaaagatggatatctttagttctgggtaaaataaccgggactaaaagatggatatatagggccacgtcctgattgatttttttcttttatttttttatgcttgtatatatattcccccacccaaatccatgcaaatcgtgcacaataaaattatccaaaaatcatgcacaacaaaatcaatcctccacaatacgtacacatctacaatctacaaatcaatcacaaattcatcctcatcaacaaaaataaaaaaactccaacaaaattaatatagaaatcattcactatcgccagtcgccgtcgactggccacctcctgccggcgcgtggagggggaggagaggggtgagaggagaggaggaggagatggggaagaaggagaagaagatggaatgagggggtgaggaggagaagagagtagagataaggttgggggaggggaggatgaggcgggtcgctgatttttttcccaattgttacaactgggactaaagatagtggaggggtctgacacagcttcccttcttttaaactgggactaaaaatgatcaccaaccaggactaaagataaaaattaaagtgacatcaggtcttttaaccgggactaaagatgggactaaagaatagatattgactaaagatatattctttagtcccatctttagtcccagttcctattcaaatcaggattattgctgaatttggacaaccgattaaagatggtttctccagtaatgtgtgtttccataggcataatacacagaagtaatacaaaacgggcaaaacatgtgggggcctgatcgattcttatctaatgggaagtagacaactagtatacagtaaaccctgactcttaagcaggcccgatcagtttagttcttatccctatgagaaatgatctactataattggacaactccgatttccttgttctagctagcctgatcaagtaatcagtacatgacgcaaccatatgaaggccccttgtcgatccgttcctatctgatgggaactattcgaagcttgatgtgtgtgtgtatgcacggcaatacatgtgggtaatgcaggcccttatccaaatgagaaattatatactccctccgtaactaaatatttaacgccgttgacatttttaaacatgtttagtcgttcgtcttattcaaaaaatttaaataatttttaattcttttcctatcttttgattcattgttaaatatactttttttatatatatagttttacatatttcacagaagttttaaataaaacgaacggtcaaatatatctttaaaaagtcaacggcgttaaatatttagggacggagagagtcggttgtacagctcatatttgttgcagtacctgtcactgcatgacaccaccactgacatcgttatacgtgtgtatattattgatgccgtggatcgattggatcaccgatccagaacagcagaccattgtttggtagctgtcgcaaattccaactcttgcactgatcgcaaaagcaacatatcggacaaatctcacaaataatgtaacataaagtggacattttgtccacaaccaaaactcttgcatgcatgttgattggatcttaataattaatcatagaagaattaagctgtcgatctctcgcgtacgcgctgcttcagctttgtcgtcctgagcccggagaaggatgcaggcgtgttgaggcactggaccgcgcgcccgcataccaccgctggcaaggtgggggcagagagatgaagaccgccggagcacgtgatttcaccttcactgactgtttgggaggagttttagattctgagaagcagctgtttgatagtcagtttctgagaatctggaaaaactcaaacccagcttctccagtttctggcttcttagttcatttttcagaatatgtaactatagattctcagaagctgtgaactgtttgggatagctttttccaaaagctgcagctgggacaagctcccccaaacagggtttccaaaaactgcagttgggacaagctcccccaaataggacccaagtatccagatcgatcgatcgatggatcgcgtgcgcgaacccgcatgcgtgagaagtgcggacgctcccggccgtttgctagcaaagatgctttctcgttacatatggcccgatttgcggagaccaagatcgatttgatctacgtccacgatattactctcgttacggggtcttacggccgaatttgcggagatggatcgatttgatctacggttgagatgttaacctccattgaatcgacgatcagatttttctaattaacatggaagctcataaaaagtaaccgattaatatagatatagatatagatatagataaatagatagattgatatattgcagcccacttctattccacgctagaagcttgagtaggcctcgcgtgaaggagagtgttggaaaataaagtgaattgtccgtcttttctcatcagattaagcttttaggttaaactgctcaataatgtcgccgccaacgccaacttcgattccgccaccaccgttggaatttaatcttgttgccactgccgattcgatcaatttctccgctctgctcgattttgatttcttcgctggccactgcctgattcagcctaccactgcggcactgcctctagcagtctagctacctctggattttggccccaacatagtagtatctccgttcgatttgattttatcgccactgtctgattttgattctgcccgggatgttggagatagagggtagattgaggaatgttagactatatttggcatgtaccttgattggctcccttcaataaacctctcgatactgtttctataaattggttgagtgtgctatggaaggttgaggcctatatgtactgatctccgcatatcaatatgattatcgtgttgattcatattcactctcatggtatcagactactgatcactcgcttccgctctctaacctcccctccccgccggcgaacatcaccggccattcttccttctccggcgacatgtcgtccgcctcctccaccccaccgacaacttggagaagataacatatgatcatgatatcatgcgggatgcttagcctaaagaacagtgcacgtggttggtgagaattccatatggcatacgatagatatattgtgtgcatactggatacgtagtcgaatttggagagagtccaaatttggtacgatttgagtttgtaaagtttgtttcttgtatgggaaggtttcctaggggattatgacttcgtgtacaagattggtttgtggctttaggctacttatcatggatataaatagagagggagggtatgtcctcccagtatcaatttagatagagttgagtttagagaaaagttagggtttcgagtttggtcaagatttttgtaaatgctattgttgcactttatagatacagagaggtaataaagttttaatctactttgagagatctttgatttgtgtttgctcgggttcgacggtctatctgacgggacaccaacggacagatcagtggcatcgcactggtcagaccggctgggacacgacggtcagaccggaggcggcgacaggcgatagcgacgtaatgggcggtcagaccgaaggtcttcaagcggtcagatcggcacatctactccagtcagaccgatccactattagagaactcatcttttatccaataccccaaaccacaaatgtactggatgtattaagaaccgatactaataactttttagtacctgttctaaaagtgcaagtctccaaaatatgtttagtcctggttggtcttaccaaccggtgttaaaaatgtatttttaagtaccggttagtatcactaaagatatttttaataacggttggtgttaccaactggtgctaaagatgtcttcggggttagttcaaaaagaaagcatctctatccaagttagatgtgtggagttggtgggatggttaataggctaaggtgagagatgttgagttcaaatccaacatcccacatatttttttgactttaatatgccacatattttttttgacttaatatgcatatttagtactaaaggtcacaaactttagtctcggtttccttatctcggttgctacaaccaatactaagagggtttattaaccgatagtaaagatcatttctctactagtgatcgtcatcgaattgagtgtaaattttaattccgctaaaagttttggttttggggttttataactattcacctctctggttggcttgattcttactattcgatccaacaatactagtatatttgtgttcgcatcgaaaagcaccaacacacggttcatcataaacaaattaataaaaagatgaccatcacgctcttgcgacgacgagcgactggtcatttgcaaataaaactagactaatatactcctagccataaagaagaaaaagaagaaacaagaacgtagaatgaatttatatcgattgaggtagggaaatccttgccgccgccatgccgtaacttcatagcactcgaacggtgaatcctcatcagccgacgagtctgtttcactttcccttgtgtgcagccaaacctttccatctccttgctcagccttgattcgcatatagcatgctttccatttgtgtcgcatgaagcagcaaagtttttcattcgcatctctgagcctcccaaggtaatgttgccgctaattaatctccattaaacagactgctatcaaagtgcatgtgcatatccattcaatgatccctccaaacgacctgatcatgcatgcaaacaaatacgagcactacatgcaaaactcataggcagctacccccatggctactaattaaagtgcatgcacaatcaa

SEQ ID NO: 17489 - DNA, 8177 bp, Oryza sativa
ggccaaatctgtcttcccatacggataggcgttccgcttgcaagcaaagacttgcggcaatcatttttacaggcggcaactatttttgctatttttgcaggtggtagatcctccccctcccctcgatggctctcctcctccgaccgccgccaccggcggccggctcccctcttcctgcggcggccgttgtcgtcctgtggtagtcattgttgcggccggcggcggaggagagtagagctgagggagagaagagggaggggagccgcacctcccctccgacagcgccaccaccaatgcccctcccctctgccggatctgggagggcagggaagggaaggggcagcgatgcggccggcggtagtcatcatcgtcgcgtgcagtaggcgctgtcgtcgttgcgcggctgacgccctccgcttgcgccgctgcccacgaccccctccgcctgcgcagccaccgatgcccctcccctttgccagatctgggaggggaaggaaggaaggggaggggagggagccagaaaagtgagagagaagggtgagggaaatgagtggtgctggacaggataagttgtggaggagaagacaaggatgggataggacttagattttttttctgtaggcattatttttgtaggcggaccacataaggttccgcttgcaaaaatcatatttttctatgcggaccacttaagaggtctgccagcgaaaacaaaggtatttttgcaggcggatctcttaagtggtccgtctggaaaaattgattttcgcaggaggacgacgagcttcaccccggtttatatttttataggcatccatttggctccgaaagtcatacccacctggaaaaaaaaacccttacatctgcgaaagtgctttttctagtagtgttagctaattagtcctatgcaaaatgagataagccataagtatataactaactaaatgatcatcacgactacagaaaccctaatcggtgctggttgggatacccccttaggtgccggttttcccaaccggcaccacggaggtggcacaatgactttggtcatcggtgccggtttcaaaactggcatctatctgtgtaatagatgccggtttgtatgttagaaccggcacctattaggggagaaaggtgccggttccatataggtgttggttttagcaccaaaggaacacgtggcaagcacataaggtggctggttgtaatgaaaaatcggcacctatatgttgggtaaaaaaaaatagcagtacctgtcaatttcacatacagatcacacatacaattccaatatgctttatattcacatccacatcatcacaaaaacatcattcacttacatatttcaattttcacatccacatcatccaaatcacacaattcacatacattcaccaagaaagagccacattcacattcacattcacattcatattcataggcaatatattccccaaacatattcacataggttttccatcacacattcacataagcagcagcagcagcagcaagcagcaacagtagcagcaagctgacgggagcgtgggcgggaaaggcactatgaatgcatgttttacctactttcggcacctatagtgccgacttatattagctattatgtagtagtggatgcactgcgctttgctgtgggatatatgttagaaattgtagaaatgattaaatgacttagattgaaatattatgaaaatagtttgagaatgatgatttagcatgtgtatgtttagttttagaatgaaataaattatagatataattactatatgcttaatgttgagctttgtgtgtttagtgtgttaatatgccatgcttgcatgttgattttaggagtgctaataaatactatgtttgcatgttaagcttcaggtatttagtgaatattagttttatagaaagaaaatattaagtacaactcctttataaacttgaaaagtgaaaatttcatcctttatcccaaatactcgtagatgaatatatatacggtcacaatcctatttggcataatatattgagattacctaaaagtttgaatttatatatgaaggattgtaaatgttcgttgagttttccaacgggacaaaattatggtgagtaaaacaatagtaaaatacaaatggatttctttttttacaatcccttatctgtagggatggcaacgggtcgggtcgggcatgggtagagcaaaaccatgcccgaacccatgcccgtcgtcgcccgtccaaaccctacccactagggttagcgggcaaaactttgtatctgtacccatgcccgacgggcacggatataccggcgggtacccaatggatctcacattaatagtaactcaaaaatacataatttaacaaagagaagtaaaatcaataatttaccaaattatcagttatcaacaataatttgaattacatcacaacttattattagttagtatcacaaatgaaccaagagaaaggggtataagaattaagagataagtcgaaattagctaatacatatgtatcgggtcgggcatgggttacccacgggcaaaaaatgaaacccggttgttgcccacgatgtctacgggtttcgggcgggcgtgcccacggataaaaaatcacacccacgctcgtgcccattgggtcgggtatccgcggatatccagacccatggacaaaattgcctttccctatttatctgcctgcaagattctctctctagacatatgctaacaccacaagacgggcacacaaaatctaatttctacacgagccacgctcttttaggctgcattcagtagctaattagtcctatgcaaaacgagacagagtatgattaattaattaattaagtactaaccattatatacctgaaaagtgatgttttgtggagaaaacttttatatcctttttacgaaacccacaatttaaccgtttagaaagcatgcacaccatacacaagaaaaacagccgagccgataaactgagagctgcacataccaaacttcagaaactttgaacaccgaagcactctcagccactggtccgacataacgacatgggtcccattcgtttctccaacaaaagttacatgaagatgaagatttttatggcacgcttttcagactgctaaacaatgtgtttcgtgcgaaaactttatatataaaagttgttctattaatttatttttcaaatttataataattaaaactcaattaatcacacgttattaccacctcgttttgcgtgaaacactttaacctttatctttatctttaatctcagaagattcaaataccttcctgatcaagaagtttagggtcgattgtcgtcatttgtacaataattaatacagggcctcctgctcaacagtagtattagcaatcatgcattggacgaaaagcgacaggtatccccgtccatctcaaaatgcccagtgcacatcagccactagcaatggagtactctcctcttcagttccatattgttttgagtagacttttaaagctttgattatcaataacttgaaaacaatatagcaatgtatatatagattaaaattagaaagtgctacaacaaaaaataaatatttatttatgtcttgtatatgttataataaaacacatagtcaaaatatgttttgaagatcatgcctctattcaaacagccccaccatatactatctccgtctcaaaatattgctacttagtactgcattagatgcatcatagtaatacaaatctgagcagatgggacgcatcctaatactatgttgacggttcttaagtaccaaattcgaccttcaattcctacataaaagcaaatgaaagaatacaaaatggaatatcaaacttagagataatggttattactaaccatttccgcaagtcttggtgaatatttgtatgcatgtgaattttggatgaaaaccacctgacatgtctggccaatcagatgcgagtacacggattggaaggcccacaaaccaaagtaaaatcaacatatttgaagccaaccaccatgcaccatcatgagaacccaccaggcagtgtcccaggcaaaaggcgacgtgaggggctcgaccagggttcggtagaagcagctggctccccttgcgctcagcttccacgtggcgacagatatcgttgtcctaaagtcggtggtgcaaggctcaaggtaggaaacctccatccaatgatggttggaggaatgcggaggatagttattaaaatcggaccggacagcgggctgatcggaataaaccgaaaccaaaatgtcggtacgcaattggaccggtaaacactcgatcaaaccggccagttttctgtatcttttgggccggctataagccggtgactgcccatgtaggcctatcaggcggagtggggcttgtgagtaataaaaaattggagtggggcttgtgagccatgctcgtgcgtaatagaacattgaggaaaaaagagtggaggctgagatttgaacctgtgaccccgtgaccaagtgttcaacaccaaaatacccgaccgttgagctatgaaagctattgtgattttaatgcatcatttatctatttaaaccaggttaaaccgatggtctaaccggttagaccagtaaactagtgaaccaagtccctcaacggttcaattatcggtccaatcttaataactatgatgtggaggcttgagaggagttggaggagaatattcccttagcatctctactctctcaagtcatcttcacactataaatatcccttctactcctcattctcaacacataacaagtggagtacaactcacttatacatttgggctactctctagtagagttataatataggaaaagagaggagggaagctttgaaaggagtgcccctaatatcggaattctctccggtgaagttccggagacgtgcaggagatattgacattcttccatgggagttccggaggaatgccggagatgtcagcactttctctgattttgtaccttgacggatgtctcttttatataagtattggtgattacctttggtatttacttttcttatttaagtaagatatattttcattgttatgggttcatcgctctgcttaggtagagtaccttaatcttctagcgtgacatcgagattagcgtagtaatcaatagcatagatgcgatgtctaggctgaaggttacctttgtttgttgtgtgctccatgggttgtagaggtaggcggcaagtggtaacagccatgtccgtcctttgtaatccttcacgtttgggagcatcatagagctataggccggagtctccttggcagaccaggggtaagccaatgcctgaatcaatagatagagttttaccataacttatttaagaattttaacccataagaatcttctctatcccaagcctaccatttagtcgttgtccttggaagaatcatgttcttagattatacacacacgttccctgtggatacaataccctggaatactcttgggtgaaagctacaacggtacctgtgagcttgcagattattctgtgctcgtaataaataccagcgtactacgaatctagacaggatgattcatggtactagaatgtgtcacataaaaaactaggtagcaacaatttaggacggtagtttgcgttgtagagtcatatgatgattaatcttggtgatgaagaaattatcaaaggtaatgtttattgaaatacgatgaatagtattttcggattgcaaatggagttatcagctcagggaggccagttagaccagtagtgttgaagcggtctgactgggtagctcgacagttagaccagcaaactccggaagagagtcggtttcaggttgttttcctggattttctagattgcttcatggttgtgacttctagatggtttctattcgtatatgataatattttgtgctgatgtgacttgtgagtcaagttggtgcaaactttataaaacattaacaaagtaactaagaaacaaattagtgatagatcaatataactataacatctgaggattagtagcactcgaaaagttgatctcttgttccaacttacactaaattaaggaacaaacctggtattctactcattagaagttacaactcacaagaatacaatattttgagaggcaaaataactaacaaactcgccgtttgttataggttagtgattatataaatttgctcatgctatagtggctcgctaagtaaaaatagcggccgctaagttccaacatgctatttccagtctgctacatcgtagcggtagcggtaggaggccgctactgctatagcacccgctatgaacgctatttattaccttgatcacatgtcactgtggtgttcggggtccaagatggcttgaagaaagcatacatagtaatgacctcacctattcctaggaagggatagagaaaaggttggttttacttcttcatcgataccagttcttgccacctcaaattctcaaccaccaagcctgcccgatagaaaacgtggtcctctactcgattggaatccaaatccctttatcgagataactcgagagttaagggagtattctgatagcgcatgaggttatcagcgatttcatgcgtcatcggaaccatcctttataagagcatgatcaccatgtgcacgagtacatagctaacctggatgatcttgcggagtacggttatttttcctcttcaaatatctacattgtattagttgaaatataaaacctaaactgaacttcaatgtgcagatattttcaaggacatggtatgtcagagaagtaggaccggaggttcccactccatcagcaacatggggaactgtggagcccacaatggtcaaagcgagaactaaaacagggacccaagtagtgcccctggccgaagaaggtgacccgaggacaactgcttctcggggccgagctagcgtcaacttagggccaccacggtcactgcacgtgggccagggccccgaggtctgttacgagcgagtttgtctttgggtagatgtgactcagtcctgccggctgcctgaccccgtcattcagcattaattacggtatcatgtgcacaaccttgccccgttattccacattaattaccatgtgatatggttcctggggagagatcacgggcggcgtgggagatgtggcggtgcatgtctctcctcgttgcccatgtcgccccggagaaaaagtaagtgacccagcgtgtgctccatgctcacctggctataagggcccacttttctcctcctctgtggttgatatacaggcccaatgactgctgggtgatggcttgggtgactctgctccacgcatcaaccagtaggtagaccctttgcatccagccggtcctcttagagggacaatgagaagactaagcataccaacttcctgtgggctgggtcccacatatgtatacttgcatgggcactgtagtatccccttggcatgtaaaaggaggaccaattccacagagaaaagggttcaattcagaaatttggtttagttggtctaagttagattctagacacaagaaagtgaagaagggttcatcatctcccacttagaacaacatccacccaataacacattgtaatattgatcgcatatagcaagaacacaatagtagggtattgtgctttcaaacatcatgaacctgtatatatcttttatctacatcctttcatgcgatccaaacacaacctcggtacctgcaccctggccgaacttccaaagggggtcagggtactttgccttcctgctagaggagcttcctactttgacacggtcgaaagactgtaccaagaaggtggtggctgttgacggctattaaatgccaattttatatcgccaatacatgcataaatcaaggaaataaaacatccaacatagtgaaagggttaaattcttacatattccacaaatattggtgaatatttgaatacaggtgacaaaccgccaatgttggatgaactatagacttaagtgaaggagaattcctatccatatcacaagcgggccaagaattacactaaaataccatcaaatgggccttccactcgcagaaatggatagaagaggaggaggagagacaacaggccaaaacctgggcctgttggaccaggcctgggttcggccgaaccactcccgcaaccgggctgcaggaat

SEQ ID NO: 17490 - DNA, 12725 bp, Oryza sativa
tgagatttacttcttgattagttcctaatagcatacaggatcatcgttcattataatcaattaaaatatagtgattgctttagtgtgtagctaacattaaagtaagttattaactacttagacgcggtgtctaggtagttgatttccagtgtttgctctgcatcccacagtaggtgtgaggtggtgacagccctcaagatcactaaagtcctcccagtccggatgcgtagtagagcgatatttcagagcaacaggctggccagtgcccgaagtatcgcgttaggattaaagttaagctttccgtagacactgtttctcacaggtgaatcctctctatccttagcctatctttagctttgtgtccttggacgaaactggtgaagagctgacacacacattccctgtggaaatcgatacctgagaatactcccgggtgaagtgctacatcgttttattccgtgcgcttgcagattttatctgtgaggttaagaattaccaacagtggccaacaagctgagcattgctgaagatatccccagccccttgtgcaacctagcccaagttgattgggacaagatcatgaatgtaagtattcaacattcctttcttaccaccttattgatgccataggattttaatgcaaatacttctaggaacgatccctcatcaattttgtcgagccccttgtcaatcaccaggaagctcctggcaacagcggcagcgccttgctgctaatcggtggcggtagcattttgctgctcctcgaggtcagcatggtccagttatatggaaatattgaacacacaattgacccactttggaccgctcaaaccggcgggttgttaggtgaaccagtagtaaaccgtcttcagtcaggccaggactaagacatgtcactgctttaaataggctagaaaaaggcccggctaactcgtgggtccacaagcacttgattttgaaaatgggcatggtggggagtcaacccgaggtggttgagctaggggtaaactcccataaccatccgaccactgcgttatttgtgattgtattggaacataaaatttatctctacgttagtgaattgcggttcgattggctagatagtcggataggtgaaccgagaggttgaccaagtcacccaccagtctagtattttcaactatgatgaaggtgagatcaactttagttcatgcgctccccattcttttccgcaaggaataattagtgtgtatcatatatatatgctggaattaatgccaccaaactgcacacaaatacaactcttaacaaggttcaaatagatggaaaccaacggcgaatctcttacgtaccccacttaattttattaaaccatatttgcatgcctgtgatatttgttgggaccaggatttgaaccctggtggtaggtggagtgactcccactgcatcgacttcccaacttaggaatatggttgcggaagtaataagaaaagaaaatcaatcatagtgcacatatgatgaatgatttcgaagcgcatgatataactcgttatatacacaatccaaacgcttacacgctagtacgtacatggacctacatgatgacaatacatagtgctgcatatgtatcaacgcaagttgagaggttcaataatgaatctctcatatgatcaaaacaggcatcttaattatcattattgtcatatttaactaatatcccaatacataataattaaagtagttcacacttctacgtgcggtacctaaaggggaataggtttgacaaaatggctctccatcgtccttttgaaatccttactgtatgtgtatgcatctcttttgtcaagaaacaaaatagccatgctccttgataggttggtgacccgatgtacaaatggcaacagttcacggcgatcaatatgagcttggtttatggttttccatgcatcttcgaccaaagaacctatcttggctagggcaacctcactggtaacattgtactccttgatgtagcactccacggagctggctacatccaatttgttccttccattctatgaagaaaaatgacagatttagcaatgtgcatgtgtatcaatataccatggtaaagttagatttgatatttacaagagagatcctgatctctagcactgctgttgcaatacgacatattgacacatggatctgacatgctctaggatctatatgtcagtgactcctactataaaagcaatacagtagaggagtaagttctatttacaaagcttaaactcataccttaaatgcagccatgtcatccatgaaacgtgccacctcaccgccagccctaacggcatcattgttgccaatggcccactcaagtgtctcctcggttactatatttcccatgccgacaagtatacatacacttagtgcttgaatacctgcagacatcaccgacacttctatttgctctttgaaacttggtacgtagttatgatggaaccattctgcctcctggagataatacccagataacaattgaaactgcataggagaaaacagaacaatgctaagatctatgaggtaggggtgtgtgtgtatcacatagtaagtgcatgctgatactacctctgttctttacttgtccaaacattgatatatatggctgtgttctttttagatgtttgaaacagtaattagccgcacgtaaaacgagaaatgatattagcatatgattaattaagtattaatatataaaaatttgatgaataaatttattagatttttttaaacaacttacacacacacatatatatatatatatatatacacatatacatatacatatacatatacatatacacatatatgtatgtatacatatatataagttttcacgtaaaatacaccgtttaacagtttgaaaagcgtgccaacgaaaatagaggaatagctaagccgccatagtctccaatgtagttgtctcatcattaatattttttaatatttctaaaatatatttaaaaaaaaccatataaaatattttttttctcatcacagatctatcaatgctatcttcacatattaaatcttaatatttttatccagtaatgatttaagaaatcaaggtattataggacgatgtccttaacggaggtagcgtttcattttttgttttatgtgcgtttagtcccattacaaggatcggcaaactttttttttaataggatacgatgactctatgggggacggggtagagaggagaaagagcaaagggggagaccaagatgattgacatgtaagaccatattgtttttattttttttctcactgacaagtaggtcatatgagcattacataggatgagactgctatccaaacggtcgagggaactgattggctctagtttttaaagattggggagacgttatactcggtatgagggaggatcaagacttgaaggatccacaatagactaattccttttctggatgacgaggagttgctgccttgctgggccatggcccaagaggcccatgggctactgccactccgatccagccctacttagcggagtaaattatctgaaacggaaaaaaaaagaaagaaaaaaaaggggcgcacgaggccgaggcggcaccggcgtacggtggcaagcggcaggagccaggaaggatggggaggctggcccgggaagcgcggctcggtcgacgccgcctcgacggcggagaccgccgacgaccagactggaaaagcgagcgagccaacttcttctctgatttctcagctcatctgacattctgactgcgatcgatttgacttgagaagatggagagaagctgtataaaggaaaaggcaacggcatctctctcgaagaggtgtagatattgggaattcgaggacattgcaaatgtgtgtgttgtgcgcggacttaaggacagatttgagcggccggcacatatataattaattggttaagattgattgctcgtttgtttgtttgtttaatcataatcttgggggtctagtgagaaatgttgcggcagaggtggaagagctaggcgaatggaagatgtggaggtgccattgggttatgttatattgtcatttatctcaaatatcgttctactaattttttttccttggttccttttttgtttggcagattgtacctatttgtatgctctacaaatcaatatattcaataagttagtcatcttttgtggtggatattcagtttttgaggtatttttcagtgccctactttttcaagcaactttatatgtggcgggtctatttaatctcacattgtggttaggcaaacattgtttttgctttattgtctttactatccattccaacagtccgcaacacctctctttttctttttaaagtccttcaccaatccatccacctatttgttaaatattgtcttaattttcagttacaaatagtaatttcatttcaaacacctagtcaattaattcaaagtttgaagtatccgtggatttttaaatatttacattttgactcatgaaagtttgatcacatactttagtagtttccttgaaaattactccataatattataacttaaattgttacaaataatataaattagtgattgattaaaaaaatagcatttggaacaccatgtcaatatccaaaattatatatacttgtaactggatcaaaggagtaatatgtaagcaccatgaagcatgtagggtttcaaaaattacaactgtccaaataccaaaaggagactggttccaacttttatcaccgatttgctttagggaaactaaaattttgtttataaattagttcacgaaatataagcaataggaaggtgagccaaaaatggtggggtccttgccagttttttggaaccagcataccattccaagttaaaaacttgggccagaagatgttacttaatttatctttggtttcagttacatcagtggtccttgcctgtttttgggggacctttcttttaacttaattccaaaattgggttcctgttacatgtaataaaatatggttgatgtttttaaggaaaaatatcgtagcaccatgaaagatgatggcatgtttacttgatcaattagctatagtgcgaattttacatgaatattagggaaatgaacatacttgctatttaatttgtaaaatcaataatacaaacggaggtaaacgtaaaaaggtgtcataccactttcctattgtaagcattgcggtgcctaatatgtggttccaattcattctcgaactccacgaaattgctcatcaccttgagaaagaatttcttcagataatctggtagaacagaaatatcactctcatcccagctgcatggtcattttttgcacgaattagttagtcaaatttcacctcattgattatacccatgttttgttctctagatgaaagttaatcaaaaataatagtataacctttgtatggccacattgagatttcgacattcctccaaagtagcatgcgtatcataagtgtcatctaacaatgatgttaacatgaaaaacttggcaaggatcatccgggcacgtgtgtactcctcctcaaagtacatagaatatgaccaaaagtagcattcaacaatgcgatcccttatgtagtctagtcctatgtcatttgaaagatcctcccaccacctgaaattaagaaaggatatgtgtatgttgttgtaagtgatagtaaaaaagttctagtcattgtcaaattccatttatattagggctcatagatattgagtttgatatatttagagcatgctccgaaaaattactgagtaattgtcttgagctccctttggtgaatatgttgaagaaggttaaagtctagcttggcaagctccagtattgaggggttgtatgtttgctcgtgtacattgtactctaatatataagatagggcctcaaccctcttcaagtttctggacaatggtatctgaagagcacgtgaaacttgctcagctaatggggacttcaggttacttttcattaactccaaatgatgccttgaaaataagatagcttcctggagggcttcctcgttgtgggtgagaaggttggcagcattgtataagcttaagagaccttttgggtcatttgttatgtcaatgataaagcttccatctctgtgtttgaatttgttgaaaacatctgcaaagtacacacatgcatgttaaaatcataatatttgttatataatattctttttgttaccagctcttttcagttattactaagcctgggaattttgttaacattaactttcaaaaagtagagttgcctagttgaacctaacttccggggtggaaggcaatcgaatttggcctagagcttcttaagaaaggcattatctagaggattgataatggccagtcagtttgcatttggcgagatccatggatcccgagagacctctctcggaggccgattaccacgaagggacactatcgtttgaaatgggtttctgatcttttgagcccaaatggttcttgggatgctcttaaggtgtctcagaccttcctgccgattgacactgaagagatccttagaatccgtacttcagtgcgtctggaggaggattttcctgcgtggcacccggataagttaggtcgattctcggtgaggagtgcttacaagttggtgctctccttagcaactactgatgaaagctcaagttcttcaggacaaaactctaaggcggcttgggatatgatttggaaatgtgaagtgccacaaaaggtgaagatatttgattggcgggctgcaactaatagcctggcaactcaagccaacaagaaaaagagaaacatggagcgagttgatgtttgctgcatctgtgggaatgaaaaagaagatgttgaacatgccctttgtcgctgtcctcatgctgttcatctttgggcagctctggagaattcagggtatttgtccatgggcgtagtcggaaatggtacaggaagttactggtttctcaaccaagttgaaaaaacaccaaaggaggagagaatgatgctgctaatgcttctatggcggatctagttcgtccgtaatgagttatatcatggtaaaattcctccgcctattgatgtgtcaaaaagattcctggaaagttactgcagttctctgcttgaagttagacagtttccccttgtcgatgtggttaaagggaaacatgtggttcagtctggtttacagaattgtgtagcggcaagaccagagaaaagatcagttccatgccgttgggagcgtccgcagccaggctggatgaagttaaatgttgatggttcctttgattcgagctctagtacaggaggcataggggcggtgcttagggacaggttaggaactgttattttttcagcctgtggctttatagagagatgttgcaaccctcttgaagctgaacttctagcttgcaaagagggaattaatctggctttgcaatggaccttgctgccgatcattgttgagtcagattgtttggttgcagtcgatatgatccaatctaagaagaaggagtggtctcagcttgcctaccttgttagagacataggagagatgctgtctgaaggaagggaagttagaattcggaaaattcagcgtagtcagaacaatatcagacattacttagctaatagaggccggactaatgctcgttcggagttttggccggatggaagttgtaatttaatctcacaagctgtttgtaaggaggctttagctgagtaatatatctgtcttttccccaccaaaaaaaaaagtatttgcaagcggatagcatatatttccttcgtattttaatgtttgacgttgttgacttttttaaccaaaatttgaccattcgttctattcaaaatttttgtgcaaatataaaaatatttatgtcatgcttaaagaacatttgatgatgaatcaagtcacagtaaaataaatgataattgtatatattattttaataagacaaatgatcaaacgttgattaaaaagttaacggcatcatacattaaaatacaaagggagtattagcatataaatatttcacttttacagcatacctgatgaaacccataacccttgctgcctcagcaagcgaaaccggagggcaacgtcatgaaggctagggctgtcaaattcagcaccatgaatggtattcaaggtggtggctatctcttcctcaaagagatgatctatccccaggcgttggagcgtgtcaactagattcattttttctgccacaccatcgaaagcgtcgaacagctgacttacgtcctttcttaactgatcggatctctctctcatccatttctctggccgctgctaacacgaattaatacatatgttaggtaaaaatatgtggaaaggagaagcaatttgatgacaatttatttatctctcatggtacatgagaaaaggtattatactgcaagcatcatgcatatcgatccatgaaaaatttatggtttcagcagatcactttttaagcaaatcatgcatgcatggtaacctgtacgaatcgctaaagaatgctatatatgtgtggaaagagcttgttgacatgtagaaatactggaacaggagaacatgttcatgaattcgaatataaatgagatgaagtgctagtttaagtactttaaggaagaagttatgccacctttattgaaaaaaaaagggaaagggtttaaaattgatcatgcatatggatcttatttgttttatcatttttatatttaataaatattataagttgtcccttgtcatggtgaaatgtctaacatgctcgatttttatgcattataatccacttggatttgtagattgcgaattcagaaatttgaagtaaagtacttgaggcatttccaaaaattttgacgaagtacttgatttagttaatcttggttaattagcatatccaatactcaactggttaagaacatgaagcccctagctaaacaaaaaagatgaaaagcagcccagtgtgtttgtgtaatggcgagactacgtgtgtattctcttgtaattataaaacagaaaaatattagaaagggaagatttagatacaaaaccatttggcttcaatttgagataagtgtactctgcactaggtaagggaatagagtgtacgagcatgcatgcctgcaagggttgtggttcatagttgataaagaagtcaccccaaactgtggggtgaaactcaggtgctgccttgggagctgtacaacttgaagaggccatgaatttgtgtgtgtggtttgtctgcagctaactggtttctgttttagttgtgactgacctgcaactacagaaactgtgtgtgcactgcagatggacaccatggagaggtttatataggcaccagagaagctaagttaaatgagaatcacgatggacacaggttatgtctgggattttcccaaaaaaaaaaaggttatgtcttgttatgagacatgcatctttcgttctcttcttttcttttctttttttttgttttttgttttcggcgaggattctctttttgtttttccaaactcaaaggtttccatcttttacaaataaatatatattaccaactactaattaatctccgaaagtgattgataggtcaatgtatggtgtatagcatggttcagttatgccttgcaacggtaaaagacacaagctatcttttcatctcgcttttggcacgtgtcactacattggtttgtgaagaccgatgagaagtagaatctggcttttgtgaagaaaaaataccacattgtagagctgaaatcaatttatttactcaccatttgccacaatcgtaagcatgtatagttctcaacccctcaccatgttgtctcgtccttccctccgatttgttctctgtactatgccaacgcctctgcttggagggatcatccatgtcgatcgtctctttctctcacatggatcttttgtgattcataatggaactcaattttgaggttttgggagacatttcttttgataagttatttacctcgttgaataatcttgctagcaagaaaaatgtcgtgttggccaatgtgttcacaaacgtactacttgatgtctcctttagaaaagccctaattggagataatcgggtgactttatatgatagggcaattgcgttttttaccctactttgaagactaaccactgatttggtcatttgactctcttttttagaaacgaaaatggggcttgaccctattctgtgaaggcaacatgacggtgttaactcaagacaaaaatttcatttatacccttgtgaatttaacctagtttctcaaagttttttattcagttttgtgcaattagtatatattaaactgaatcaaacaaaatttcatggcacaaatttatgtccaccaaaaacaaaaagaaaaagaaaaagaaaaaaaacatgtcaagcagcaggacaccacgtcgccgacggcaaactcccgagcccatccgtgcggagcagcagccaccaccactccctccgccctccggctccactgctcccaccctccacgagccattgtcgcctcactgtgcgctgatgctccctttctctgtgagccgccgccgccggtgctccctccctccccgcagcaccaccgcctccccactaaggcccgccaccgctgcgtgcgtgcctcggcgccactagatccgtagccgagcctccgccaaatccaccctaacactgttgcccctcctcctcctcatcgtcaagccatcgccactgctcctcttcgtcaagccaccactcctcgtcaagccaccgttgtccctcctcctcctcgtcgagctgccgccaccactcctcctcctcgtctagccatcatcgcccctcctcctccttgtcgagccgccgctgccgctcctccatctcatcaagccgctgccagccttcctcctcgtaaagccgccgccatctgtggacctctccatttgcccccatctgtggacctctcctaattcttgttgacagtcaatgtcaagaaagtggggtaataactaggtgtgtaggtaagaaggtgcttcatgtgggtaaaatttccgtttaactttatatattcatttcattcttaaaatatagcaatttagaatccagattagaatattctagtactacgaatttagacagacgattgtttactagtggtatgaaattgcatgctgcaaatagaagaatatatgccaatactatcatatttgatagactaatttctctctaggcttacatattttctggttcctgccataattaatcctttttaataccacaattaacttgtaaaggaacttttaacaaaaggcattaattaattgtgtgtgtatataaacctaaagaaaatatcaaaacggtgatactacccctatgtcttagaattattatttttaagagaaatactattagacctgcctagtagttatatttaatttactcatttgcctcagacatttatttgctttgcatgcaaccaacttggcaccctaaattccgttaaaatgtgctgccaaacagcaagattattcgctagacatctgctcggaaagataaattaactaataatgcttctacacaagccatatgatctagttgaatatctattatattattaaaggaatagaaaaaggagcctccacattcgctcacatggcctagaaattttcacattaatcgggaaaaaagaaaaaacagagtccatatagaaatacaatttagaaatagcagaaattcgaaattaaaaaataaggaatattagaaaaggagactagagtccatatagaaatacaatttagaaatagttgaaattcggaattaaaaaataaggaacattagaagcaaggttgtcagtatcccgattcgtatcctagtatcttacgatactacgatcctaccaagccgaaacgatactgatcccacatagtatcctaattttcatagtatctcgatcctactattcattactacacgatcctacgaaatcttaggtgtatcccgattctacgatcccaacaatactacaaaatatgatttaaaataacatgatttgaaaataatgtaaataaatatgctcaaatttaaaatcagttaaatatatcaaaaccaacatggattctcttgataagtctccatttgcacggcatatatcattactatattttttaatatagaatggctatatataattaatataaatataaattaaacttaaaaaaagaaaatctcacagtatcccgatactacgatacgatcctatgatacgatattactttgagcaaaacgatactacctagtatcctgatcctgacaaccttgattagaagaggtgactagagtctatatagaaatacaattaggaaatatctgaaattcggaattaaaaataaggaatattagaagtagagtatagagtccatatagaaatacaattaggagataatataaattcggaattaaaaatacggaatattagaagtagagtatagagttcatacagaaatacaattaagaaaaaaaatagaaattcggaattaaaatataaggaatattagaagtagagtatagaatccatataggaatttaaaactaactaaaattcagaataaacataataaaattaaaagtagagttttgagtccgtataaaaatacaatttacaaataactaaaattcgaaattaagaaaaacatgggaataagagtttaaagtcaatataggaatacaat

SEQ ID NO: 17491 - DNA, 2044 bp, Oryza sativa
caaaaaaaaacatgtcaagcagcaggacaccacgtcgccgatggcaaactcccgagcccatccgtgcggagcagcagccgccgccactccctccaccctccggctccgctgctctcaccctccacaagccattgtcgcttcactgtgcaccgatgctcccttcctctgtgagccgccgccgccagtgctccctccctcaccgaagcaccaccgtctccccactaagtcccgccaccgccgcgtgcgtgcctcggtgccactagatccgtcgccgagcctccgccggatccaccctaacgctgccgcccctcctcctcgtcatcgtcaagccatcgccactgctcctcttcgtcaagccaccactcctcctcgtcaagccgtcgttgcccctcctcctcctcgtcgagctgccgccaccactcctcctccttgtctagccatcgtcgcccctcctcctccttgttgagccgccgctgcgctcctccacctcatcgagccgctgccagccttcctcctcgtcgagtcaccgccatctgtggacctctccatttgcccccatctgtggacctctcccaattcttgttgacagtcaatgtcaagaaagtggggtaataactgggtgtgtaggtaagaaggtgcttcatgtgggtaaaattttcgtttaactttatatattcatttcattattaaaatatagcaatttagaatccagattagaatattctagtactatgaatttagtttagacagacgattgtttactagtggtatgaaattgtatgctgcaaatagaagaatatatgccaatactatcatatttgatagactaatttctctctaggcttgcatattttctggttcccgccataattaatcctttttaataccacaattaacttgtaaaggaacttttaacaaaaggcattaattaattgtgtgtgtataaacctaaagaaaatatcaaaacggtgatactacccctatgtcttagaattattatttttaagagaaatactattagacctcgcctagtagttatatataatttactcatttgcctcagacatttatttgcttttgcattcaaccaacttggcaccctgaattccgttaaaatgtgctgccaaacagcaagattattcgctagacatctgctcggaaagataaattaactaataatgcttctacacaagccacatgatctagttgaatattcttctaaaaacattagtgtcagctgtctcactatcatgctagacatgagaatgcacacctttgattccaatgtggactacggagcaaactcggccacgagaatctgatcctctttctctctcttcgtttgttttcttcttcttcttctttatgggattcttcttttgtttttacaaactcaaaggtttccatttttataaataaaataagtccctttcatatgaatatatattgccaaccactaattaatccctgagagtaattgattggtcaatgtgtggttatttctaccttgcccccacaaaagatacaagctatcttttcatctcgcttttggcctagatcacgacatacatatatatttggtttataaagactgaagagaaacagaatgattgctgacaggtgcttctcctagcttttctgaaggaaaaataccacattatacagctgaagtcgagctatttactcaccatttgccacaactgtaagccccaatatctgtcaattaatgtcaacaaggtgggggtgagcaggcaagaattaaggcgcttcatgcgggcaaaactttggggttgcagagcttctatactgtttactgcaaaattgcatgctatggatatccctaaatagaagagtatacggagttactgtcctgcttgacaatagtaagatagtttagaagtatgaaaactatatatagatgttaatttgttgagcaacaatagtaaaatgcaaacaggaaattttgggttgacatgggacttttaaatcctttgtgaatatctgaataagaaaaggccctaattaatcgtgtgtgcacgtaaat

SEQ ID NO: 17492 - DNA, 4720 bp, Oryza sativa
attcatagagctactgtgcctcaaccatatcctgtcctcctccttctccctctactcgctcagatcgatgcattccagtagccagcctcccacaccaccgccattgcactcgttccccctgatcttgtcaacgcctacgaggtccctctctcctgctcctcaatccaacgggggtgacgtggccccgttccatcatcttcctacgctaccactttctcaccactagctccactttgtccccgttgttcaacccatgtggcttagcttcaatgacgatgccgtcataggaatccctccaaacccataaaaccccctcccctgttgcaactaccccacctccaaccctacaaccgaactcatctggctattgccctccccccctccggagggatctgggatagagaggaaaatgagggaggggagggccctccggccgctgttgttgcatgcggtggcccccaccaccacccttccctccaccggattcaggagggagggaggtctccgccgaccacctctgtgccgcctctgccatcgctccccttcctccggccggatctacaaggggaggtctctgccaccgccaccaccatccccgctccttgctctggctggatctaggatagggaggggaggggtgctgcctccgcaccgccaccgtcgctccgtgccgccgccgtcgctcgggaggggagtcgcctctacgtcgccaccattgcacgccgccaccgtcactccccttcgtccggccggatctaggagcggggaaggagggagtagccgccactgtcgcttcctccaccgtcgtcaccgtcgccgcgtctgcgccaccactgtcgctccccctcatccagctagagagagggggaaccgcctctgcaccacctccacgtcgcaccaccgccaccctcccctcctccgatcggatctggagggagggaggggagggggaaggacaacacgcatgagaatgggggagatcgggtgaggcgagggagggaaggaataatggtggagacttggtaatggggtaggttgcgatttttgtaacttatgaacttttttgttggcggacatataatgtctcgcctgtaaaaatcgaggtccgcctgtaaaagtaatggtattcaattttcacatgcagacaatgatctcgtctcacggttgtcatttttgtaggcggccatatagctccaaaaggcctacgcgtctggaaaaaaatgtcaccgtctgcaaaatgttttttaatagtgttacacgtggttgcagaacagcatcagcatgataaacgcacctcagcatgcaaggtcatcgtccataatgatgatgagtggacacaagacctcaagacgaacagaagaagataaagatgtcattatgcagctgtgcatcagtgagaatataataatgtcaataattcagcatttttgcccttatgaactatactttggatgcatgacgtcaagataaccttagcacaagatatgccataactcttaccacatctagaaatgccgcatgcattttctgtttctaaattttgtagaaataccagggaattatatacttccttcattttaaaatatttttggaaacatggatttatatacttcattcatttcaaaatatagcatcttctaatgatttattttaaaatatagcaatttctctacctaaaatcttatctcaaccaattacagtcatctctcatttattttttttggtgacttcctcatctcaacaattatagtaatcatccagtaataattttcttgtttccttaatcacagcgaaaaactaaaaaaaaccattaaattttagaacagagggagtagtattcaaagtaaatatataacatgtatgatgtataaaattaaattaaatttattttacaataaataaaattagaattgttctatttcattgttacgattgtttatgtgtcgtcatctggtatattttgggatcaatgactgaagtcgagaagattagtcgtcgttccactatcgactaacttttatatagcaaaactgatgagacaattggatcagattcagacatcaaaacggaaaacacaaaacaaagatttcatcagcgtgcagaaaaattcagagaaacaatattgatgatgagataaattcagcctgatctagatgtgtttgtttgtaggatggccatatgctggaagaaccgatgaagtaaaaaactgatcaccgaaccgaccttgccagcagtcagcattgggagtcgtcatcctccttgtacaaggcgtagaggcagtggtcaatcgcctctctctaggctgttgaggtgagagacagcgcctagcgcgtggcgacgctgtgggtggacggtggacacggcacagcgccacagcctgacctgccggatcagcaactcgtcatcagagacggaggccaccgacgccgccaccgccgctacaagagagaggaggagatcgaagacgaaatcaaatgtgtgccatcgtgtgggtagcatttggcaacagtgcacgatctctcatcggcaatagaatcggcggcagctccaacaacgtatcatccgaggagggcgcgtctaaggatgcggaatcagacgcattggacgaaatttttgtgccggccgggggaagaaatctcagattgtggcgattggaaaattccaattttttaagtaggtaagataagataagataagataaaagttgcccgtgcattgtaatgggaaaaaaactaatgttataacgatgattatagtttattttaagaaagaggaaacataatcttcacttattggataacttacaaattcaaaccattttgcatttccacgtatcctaaactgtatgtatggttgattcccaccagccaacaaaatataaaccatcgaagcttcggattttatcaacccctttcaacatgaaactatttctctcaattattttagaacatttcaataaaaattgaatttagcaaaatttatttagttgtgaccaaattttgtttaacattttaaattaatgtagaccaaaattgtcataattccaaaatttttatcctatcgatgttcaagagaggaataggtgcaaacaaatagcatgtacaatgtcggtggttatgtaacctatttttttcttagctgctcggatggatcataactgatgatactaaacatgtaggtgaaccaatcacatgtaaatagtagtaaaaaatagacacaaggaaagacaagcatgtgtgtattcttttttactttacaccgctgaatgcaatgggcccttcggtttgatggtcaaatctttgatgcatcaatggtcgtagactatagcaccacaaactcttgcatccttatctcttcagttgtagggtgctccatcactcttgcatccttatcttctttttaagtagtactgttgccaacctgactatggacaactacctaaaatgtataatacgggttcggataaaaatcatagttaccactgctccaacaacagaaatgtacttaataatattaacaatgcgtatataactaagatgagcacacttaatcaaaaaattgccagtcaatacattgatatatttttggcaaaacaaggcagggtttaatgttttggtttgaaatttcaggaaatttgttccatgatatgaaattattttagctaaacgaattaaggaaaaaaataacaatacattgttcaaatttcttttttttttctcagatcagaaatttctgaacttctatcagtaccccgaaatataatcacgattcgtattgaggtgtttttctaatatgtactttctaactctgtatgttctactataaattcagtagatgagagagtttttaaggcatcagcgacagagtatgctcctacctgaaaggttaggtattgcaatgtagcacaaatagtactcctatttagcaagagatttgcaattgggattctgccattttataacaagtaccttggctatagttttttttttctttttgggagaaatacctgcctgtaacttcatggtcacccaacatacagccatacatgtcctgaaactggaagcatacaagcacatgcaaggggcggcaatcagttatcatgcacagttgagaattgcatcgccccggaccagaaaatccttacctgagttacaaacaagaaagaaaccaacatggcagcaacaattcctgacaggtttattgcaattcataataaacagaagtatagaacttcatgcataaatttgacactgaagaaagaatcaactgaactacgtagcataggttgcatgcaaattcaattggtagtagacgattctgaacatcatatcagaaattgcagtagcctacagagatgcatataaaacatcaggcacattgatggatcagcagcaagcatgattcgatcatttaattggacagataacaaaaccatgcatcataattcatactcctattagtttcgactttttaccaatacatctgtggacagaaaatctcacctcccatcttttaaattttagaccgttggatgtgctttaagattcataaagaggcattaaccctagctctcctcccttttccctcacgtcgcgcgtattcagccgccacccatcccatcactattatccgcccgatccccccgccgccaccgccccaccacgccgccgcccgcctcgccgactggccggagggcgtcaacggcgccggtgagacctcc

SEQ ID NO: 17493 - DNA, 3390 bp, Oryza sativa
taaaatttaaaactttcatctcaaaatttgaaactctaaactcattttgttaaaaaaaattcaactcgaaatttaaactttcaagttaaatatgaaaactttcgactcaagatttaaaatttcaagtcaaattttaaaaactttcaactcaaaatttaaatttgtaagacaaattttgaaaactttcaactcggattttaaaactttcaactctagatttgaaactttcttcagattgaaaaactttcaaagttaaaatttgaaaacattcaactcaaatattttgaaaacacttgtgcgaacgattaaaaaaatggggaaaaaagggaaaaaagggaaaacgcatgagaggagggggagccaaaaaaaatgcgaaaaagatgaaaaaaaaaagaagaaaacacaaaaaaaaggcaaaaagaaaaaaaagaaaacgtgtgcgggagggacagtttcactcgcacgccaatttctgtaaaaaaatagtcgatttttagaccctaggatctgtatcaagattcgtgctaatgctttccgagaaaaatgaaggtgcggtgcggtggcggggagtcgatcccgtgatcgacgagttacaggcttacaacaccaggcttttgaccaactgagcacaaagattctattcgttatgtcctcaaagtaaatcataattaatgaaaattacactatagtgataatttatgcaattatatgccacttacattgtaattacatattaaatacatatgtaattttgggacttacatatgtaattttaaaacttgcagtgaaaatatattaaaattacatatgtaattttaagggcacttaaatatgttattttggaacttacagtgaaaatacattaaaattacatatgtaattttggaacttacagtgaaaatacattaaaattatgtatgtgattttaaatttatttaagtgtaacttttgtgattgttagttttctatcgtaaatttaatttatattgtgtattataataaagttacttatttgttatattgccaaggctcattaatggtcaactttgtgtttgaaatggcggtaatcagtatgtagtccaatccgactgttttggactaaaatttgtggcgccatatatatagatggacccaaaatgttggtctgcacgtgtggttggtctgaaccaagtatccccgagagttcctgccgggaattacccagtttcacatgttccctacgaactgaatgttttgggtgcaaggtattgaatcagcacttgtgttatgccgagtaaatctatggatagttttggtaaatattgtcatcaacacctgagatctgaatatgtgaattcatcgatagtgtaaaaatcacagtggtgattaatgcgatcaattagacatgctgaatctattttctaaaaaaaaggctccaattataaaaagtggtgataacatcacaactccttgagccttttcattgttgattgacattgcatgctagatttaactgcttctacagtactttgtagaaaattgcagtgatttttgcgatgcatgcttattgcagaggtccaagaaggatgagctgcattatggattccatccccgcatcagctgttcaagagggtggaaaagctccaacacagactgaatttcctcttagtggcctcgactctttcccatcgatttcattcttcagatcaaaatcacctcgtatagagatagtgcaactttacaattatctactcagaaggaagaaaagctggttccgaagaataaatctcctaggtggcatgagcaactgcaatgatggtgcctcaacttccgtggacggccacgggctactcttgcctctgtgaaaaactttcagctggtgtcgtctgatgaaaatggaccaactaaccaggagcaggacaaggtgattcctccagtttggaaagattgagaaggacttgttcaccatggactaccgttatccgatatcagcatttcaatcatttgcaatctgtctgagacctcccacggtggcctttctggactcactctgattgcaccttagactcagatcagacaacgcgctcccgcttagacgaaggggcaaaggaggcgaacgaaagcccgaacccgaatcatacgaaggaacgatgttttttcgcgaatgtgcaaaaaaattgcacgtcaatatattagaagaagatagcagagtttgattacacaatgcacacggtcagaaaaccgttgacagggggtcaaggaaaaaaaaacaaatacaaggaagataagctactaagaaagaaaaatactcctatcacaagagggagggtgggttagggggtcccactacactccggcttgcacctgagacgaggagctagagaagagtgaagatagggccatggcgtgatccaaaggaaagagctgcgtgcatgaggttgtatcactcagcacagcgagcgcgagcttggccacaatcctcttgctacacttcggcactattccacggtggcaatggcaggcaccggaagcgggggcagcggagagacgtaccaaagattgtggcaaaaacatcttcaatttttataatagtagagagtaaagatagagacagagatagagaagagaaacaactagccttgaattgttgtgtacttcaatatcaattaatctataccagcattacagaagaaagcaatatctaaaaatttacagccaaaactatatatatagagataccatcagtgagttgtgttcacaaaacgcactttcaagttgcacaagtacatacggtacggctacctagccgcaactgctatctccgaaccaacaacctgcacaccgtgatctctgacgacgacattgacgccgccgctctcgtcgtcgccgccggcgagttgccgtgcgtgctgcagcaggagcgtctcggcggcgctcctgcccaggacgatcctgcaggtgctccagtcgtcggcctccatgtccactccaaggtatgtcaggtggtctgacgcgctccagaacagcaccagcacgctcctggaatcaatggatatacacgcaaaatgttcttcaggatctctactagtacagcacagctaggcacaacaaattaagccattattctgaagcactgcgctggattgagatgccaaaggatgaacgagcgacgatcagtcagtcgtcagatcagatgatcacctggagcagtctggatcttcgccgctgccgtcgcagacttggtagactgtgctgccatcgacttcatgttcccagacctgaaatttcagttagtgcgtatgtataggtgatatatatgcgtaagtgagaacattgtttgggtggtgaaacgatgatgtatgatatatcagagttcagagggggcgtttggtttctgctatctagcaagaa

SEQ ID NO: 17494 - DNA, 1429 bp, Oryza sativa
acaaacgttgtgactgcagtttagtagtacttcctccgtttcacaatataagtcattctaacatttcccatattcatattgatgttaatgaatctagctagatatatatgtctagattcattaacattaatatgaactaggaaggtggcccgcgcgtatgcgcgggcacttatattattgaaaggtaagatttttattatttgtttaaagattttgtctcatagattaagggaaaactaaagttcggataatgtaattttataataatttaaggtttctatttttcttaaagtatcttaaaaatccattcacaaatttttaagtaggagatggattaagtacttacgacttttgaaacatgttattttctcgagtaaataataaactatatattgcttgtagtatggctacaaattaaaaatgtgagagcaagatactcaaaattcttgtgattaaatcgtctcatgaaggcgcatgatatagtaagaaagagagggaagcgtatatatgaagaaaagaagaaagggaaaaatgataaaagggaggggaagcataggtacccacgcgtacgtaggtgcgtatcgaaggtggagaggtgggaccttgtagtatttagtttcttctaagatcaatttaatctaatggtttataatattgaacccaccgatttaagtgaaaatcaagtaatagataatttgctttttttcttagaatttctaatatgttctctaatttattagagcaccaagtggtagcttgagggtatttgaaattttaatggacttaccacatgtaatgagaatattaacatgtaatatatatgtatgggatatatgttaatattcattctagctttgtccatgtttatatacatgtagagagaaattaaatatgttgctagcaaaccattagatgtctaattaatagcaaataattttgacacatatttgcaattgttcatagtagctcttaagattcatgttaccactttgattattcgttgatcaccatgattcgcacgaaaaaaatatgtactacttagggtttaggaaaactgaaattgatgaattatctgatttatgtgatagctatttgagattataaacaaatgaattaacttctaaatagttaaaaagtcgtttaagaaaagcaccatttataaacttggaaaagcgtggagcgtgcaaacgaaaatgcaaaagatggaatcaataaaaaaaataaggccttaaaactcccttattactcttatcctagtacgaattatattaatatgtgttaatattatgctgaaaatagggaggagattggagaggaatgaatagcatacaactcgagccagagatgggttggcagtgtaacagtgttatgcacatgtgattggagagggaggtggaggggacattgtttttctaatgtttctaaataa

SEQ ID NO: 17495 - DNA, 2991 bp, Oryza sativa
gtttgtaaattatgtttatttagaatatatatatatcaattatataaatggaaaaaagaagagagaaaaaggaagaaataattggagggaggcgtacatactacataccaaaataattggaaggaggcgtacgtactgcatacccatgtacgtacgtgagttaggtgggacccatagtatttggtttattttagaatcaattttatctaacggtgtataatattggacccaccaatttaagtgaaaatcaaggggtagatgttttgcttttttcttagaatttacaggattttctctaatttattagagcgccatgtggtaacttgagagcgtttgtaggaagtttaatggacttttagtatataatagatagatagatgtggaaaatgctagaatgacttacattgtgaaacagagggagtagcaaatttcctgtttttatgcaagagctagcatacctctgttgggaagtgatggtatgtttggtctggaaaaatgaaaaaatatgggggcaaatgcggcacaatgtcatgctcatgtgtcactcgaattgtattgggcacatatttggtaaagtaggatgcaaatgcagcgttgccaacgcgcggctgcccaaaagtcatcaggtaaacattgttgcctccatgggtaatctgcaaatgtagaaagcatttcagagtttaatgaatcagcggtgaaagaatatctactgtcgaaacaaggtatcttcttaattataacatcatacttaaaaaaacttgtgactgttttttagcaattcccttgcaaacatgcaacgttagtgaaactacattacaatcaagctttctgaatttgttcagttcggattgttttggcctgttcattgtgattgtggtgatatttctccctatttcctttaactgatgcttaaattcagcaagtatttggttgaatttcagtagcacttaccgcaagatcaagtgcacagaaagaagcaagcgctcctcccattgaatgccctgtaactattatgctaatatctccatataacttcctcgccttgtgaacggcgtttgcgatggctggacgtaaaagtgtgttattgtaagaagagtaaaatccagtgtgaacctttaaccagagtagaaatctcatcagacccaaagaaaaaaaaactcatgtcctattcttcagcaaaaaagtataattacattaacaggtcagtggcaaaaacctttgcgtcgggcatgtccgggtagttcagatcagattgcttccatagcatatccttaatccaattctgtacactgagcagaaaatttaggcatgaatacagagggatatcataactcccgtagaagccactaagaacaagaaaattgtgtagagttatttcagaacctgttctcttgagttcccctgattgaaacaatgatagcgttgagattgtgatcgacaccaacaaatgcctgtcatattgtttaatgtcatgtagtagcattttatttaaataggattgatgagaactgtattgtaaaacagtattagcatttagatatagacctgcaagcagttctggacatcaacgattagacgtctcatctcgaacccctgttttcggaaaacaagcgcccatgacaaaatcaattttaatcgtgatcaaaatgaaactaattaggcaccaaagtgttgggtatcttacttggattaagtcattgcattttgagcatgtccatgtatagagctctgttagatctgtcatatagacctatatatacgagaggaaatcatttttttagataatgggtaacgcctggctctgcatcctaaggtggatgcacactgccaaatacgagaggaaataattgagggtaacttcatgtcgagaaaaaaaaagaataaactaaaaaggggttgactctattcactgcaagatacaatttactcttgaattacaccaaaaaaaaaattggggggtgggggagtggtgcattgagtattgtatttgtatatgacacatgacacaatttggaaagaataaggtgatgataacttacagctgaggcatactccacaatagtcttggcaagtgtaaggttgaaaccaaagctctgctcactattctggacactggattctgtggagattggaacatctagcctttaggcatgctgatagatatcttatcgaaaagaacagggatgctgatatgtgcaaatctcagttacacatcatacattcatactcatcaagaataaatgctatcagacaagaattagaacataagtaaactttagtgttgcatttgtgtattccttagattgtctgggtgatgaaagcaatgttcctgctagggtaccattccttcttcatgccattagatgaaagaattgagatacaaaggccctgtactttgctatacatttgaaggttcaagttcaactcacgcgtgcaaaatatcctttttttttttgcttccaggtacaatagttattgatttcatataccctatccgtttcacaatgtaagtcattttagcatttcctacattcatattgatgctaatgaatctagacagatgtgagaaatgttagatttacttacatcgtcaaacggaggaagtaaacaatagtcaacattattaatcgtcttgcagaaagccagaaacaatagtcaacaataacagtcaacatcactgtcttccagaaacagccacactactagtgattaaatctactactacagtacaagcaaaccttgcatgagcacattgagatataaaattcgcctcatttttccccccttctcaaattgaaattaaatcgatgaagagaaatcagttgcataaaaaaacaaaattgcatcaaagaaaacaaaaaagaacagaaagaaatcaaataatcaatccatcagctgccgcgctagcagcaagtgataaggctgaggcagagatgagctttacctgttgctgctacgatcccatggggtgggcgcgatgcagcagggatg

SEQ ID NO: 17496 - DNA, 7838 bp, Oryza sativa
  unsure (1)..(7838): unsure at all n locations
tagtactagactactacggttgccgcggctgtgtttagattcacccaaaattaaaagttcgaacaaattggatcaatatgatgaaaaagttgtaagtttgtgggtagaaaagtttgatgtgacggaaaaattggaagtttgaaaaaaaaaaagttaaaatctaaacaaggctgctgttatggcgcaacaacgaccacgtttcggcttcgctaaaagaaaataatgtttgagcggatgtcagaaagggtttttgacaagaataaaataattaattttataactcgtctgaaaaccgtgagtaaaataattaatttcataactcgtctgaaaaccgcgaatcttttgagcctaattaagccattgggttactgttgcatttatagctaatcatggattaattaggctcaaaagattcatctcgtatttccatgcaaattatgcaattagcttttatttttatctatatttaatgattcatgcatgtgtttaaagattcaatatgatgtttttggaaaaaaaaatttgggagctaaacccggtcttcgttttgttgtaggccatttgtgtctcttgcttttctccttccaactcctacctaccaacatctacatggcatgcaaggataaatctagaacgaaatatatgatgtgtctacgcttacaaataatcataggtataatataatgtttaatttgatctaatacttatgagatttcaaaatttcccctatgtcaagtgaacatcacctaaactttggatttattcacttcgctgccaatttcaatcttactaattttagcaataccaaattttgatacgtttttacgttgtcaaattttgatagcgctggatttatttagtttgatttctttccaaaattcggtagtatttctatgagagaaaagttccagagctaccacgatttgataggataatgttagtaaaaggtagtgtttagtttgttaccctattaaaatttgagaacaccaaaatttgctatggttaaaagtggtgttaaagtgaacaaacttcacatgtacatccgcccctagctgcagtaaacccacttacctctaaaaataaattgtggttgtaaactgagcatggctactcatgctttttttttaacttgttgcacaacattatattaatagtacatactcgtaagggtgtgtttgataaagcgtatatacttatcggaagagggcttctctgacatgggtcactagcatgtgggtccttgagctatggggctcgcatgtcaaccccttaaagtcagagggcaataagttagagaatctctttccatatttacgttacttatggctatgttatgtctctaatctggttaagacgtgtgcaaggcacactcacttgtgacattttgaccaaatttgcaaaactacgaatttagacaatctatcgtaaaagctatcggtttagtaccaaatttaccgcaaacctacatatatttttttagataatggcaaacctacagatttagtagtgaaattctaaatatagattttagctcctaggactactattatgttagaattataaacgttgtacttttgcactaaaatagcactaaatctatagattgcggtattatgctttacatagtttcatgataagctcaatactaaatctctagttctgtgagatacccgctttaaatctatagttttacgacagtttgatttatacgtagttttacgaatttactatgaaatagaaattaatctatatttatttaaagtagaattggctaataagtatccatgggcttagcccactcccacctctctaatccatcgccttggcctcttggggtgggatggtatggtcaacaggccgcctgtggccgaatgaggcctgaacaggcacaaaggcaatacgtaccctttttcaggcccagaaaaagaacagaaatgccaggtgtcctttagtgtttttagcttggatctgcactctgcagaccaacaaaaattgggcacatccctaactgtttcttcgcctttcaaattcaccttgctttgttacataaaacgtgtataattcgcatacaagatgtgacccatgcagttcatgttggactgaaaatacacttaattggctacttaaaataacccagccaatactactgaatactaagtataaatcaataatatgatgctgcggtgctgacagcatctgcagctgaattttatatgaaatttactcaatttaattaagcagggagcaccggggcagccaccctgcaggtgttgtgagactggcaatggcagcacttgtgccctgccaccctcgcgtacacctgcgtcgtgtccctgcagtcgttgcacacgatccatccctgcaaaccaacaccaatcagcaacattagcgtcaaagtgtatgtagtattttatactgtcaaatggcacagggtgagagttcttggatggaggcaagcttacctttcccatgtaatctatgtgcagcatatttgcttcaatctgcagaggttaaaaaatgaacatattatggcagtattcctacaaattaattatcactaaggctttagattggtgagactactgcaactctgcaagtttgaaacctttccaaaatgtaattgaaatgatgagccaatatctggtccggttttttagttcctttgcatatgatttgtattttggtttattttatattcactatttctgaacctacaacaggtctattaaataaattgaaagatgaagtctagttgtataatgctattgtgttaagcaagctcactaagaaatttaatacatacctcagcgtccaaagccctcaagaacttgtccatgtcaaagataggcatcgagcatatgggacaagagaacctacaattatcaggcatccaagaagaacaagatcacacgaaagagatgactaatctagcacacaaagtaaagaaacaaacaaagaaagaaagagccacatggaaacagatcaacacagcatgggcgattacttgtcgtgcttcagcatctcgtggaagcattgcaggtgcatcgtgtgcccacatctgagcacggacgtctcccttagagagtcaaacagatactgcatttgtgatgacgatcgacagtttcgtacataagagactgcattttttttaaatgaacagtatgcagaaggtagcgnnnnnnnnnnnnnnnnnnnnnnnnacattagaacacacacctcgtaacagatggggcagttgttcttcatggagttctcgatgcagcagtgcttgtcgcgcaggctgaccgagtagcatgatcctgtgtttcaacagatatttaaaagtggaattgagagattcagattcaaccatctcaccagtaaatagtaatagcttgggatttcagtaccgagtatcgagagatgtaggatcacactgactcaccacatttttcgcagtggaagaagttatccttccctccaactctattgcaaatttgcaatgcatcccaaattcagtcagctcagaaaatttgaaatgcattcccactttttaagtgatttttttagatggtgtggtaaaaacatacctgcagatgccgcaatcttggcagtggaagtgttccctgtcaacctgcagaacacgaacgtgcatctcatcaacaaccaaatcgaaaatcaccagatccagcagaagcaaagcaagcagcatcggcatctcacgtcgtcgtcgaagaatttgcacgcgctgcagaagtactcgcccatgcaaacgccgcagttgtagcacacttgcgcaacctgctcaaaaaaaaaatcaccggtcagaaacaaaaattgatccaagaaacggaaaggaaagcccagtggattcaacactaaccggctgttcggtgtcacagacgagacagataacctgaagagcagataccccaagataagttttttcagtttttttcagatcaagaaacaggatcgaattgatgtgatataggagcacccaccgattcaaccgcgtgccgatcgagctcgtggccgtctttctgatccaagaacagggagcggcacatcagaaaggcaggagcagaaaaaataaaaataaaattcaggattggtgatgcaatgcaagcaagcacgcgggggagacgaaaccgtggactcgttgtggcaatggcggcagtggaagacgtcgttgcagcacggcgcccggatcctgcacctcctcctgtagtgcttgcatctgcgcgcgcgccaacgactcgatgagctcaaaaacaaaacgaagaaagaacacgaaagcttttcttgtccaagaacagcagcggcaaggaggaggaggagaagtgcagagcagaggaatttacccaaatcccatcctgccgaatccgtggcgagacgcgtcgtcgagctccatcggttcgatggccgcggcgagatccgagcagcctcgcgcgccgctgttgctgcggcggcgcgccaagaaggggacgactactattttatactagtgaggaggcgagctgtgctcgcgagtgtgtgtgtgtgtggtgggggcttggaaggaagggctgccgagaatggcaagaaaatggattgagatcagctgcagtggtaacttccactgtaacttaggactgcacgtatcttcaaccattcattttgatgatgaatggtccagatttatcgctacagtgatcaaaatagaatcataaaactaatattttattctacggtacttttgctatagtgctctgactaacctgtgccatccgattcagatcaaacggtagcaactatgactgcataagttgcagtcagtactactactgcagctgatccaaatctcaagaaaatggagattggggattgggtcgccactgtcctgtcagacacacggattctctactgtaaaaaggaaagtcctgattgagatgtttagtaaccaaatttatgagaatctaaaaacgttaagagttttttagcttatggcttttaactcatatctttaaattctactactacactttctataatctgatggtcctatagtagcaaaacagtatatttgtaaacggaaagtaatttgtgaataaaacttttatatacgtgttcttagttatctaaaagcaaatactgaaaaataaatttcgatgaaaaaaccaaaaatcagctttaaaattaatgttgaaaattttaattttgactaataagtataagcataagcgaaaagatgatgttgtaagttatttggaagagttcgtgattctgaaagaagctgcaattgtttttccaaacagtccaaaagttgtcttcagatgttgcatctgtttggagtaaaaataaataacttctctctctttgaggttcttggtggtcgcctaggaggagccttaaatgccagcactgttttgtttacaactcttcttttttttcaacatcttctgcttgggaaattcggagctatcttttgaaagtgtacttttttaaaacttatcaagatgcaatggcctttgcatttcttcctctcagagctttcaagaattgtagtatataccagcaaggttggattgaggaggtggcgtgcaggtagatcaaagtgacatgctgcccgctccgctccgcaccaactgtattcaagatgacgattccttgcttcctccggcagttcattcccacgatccacgcatcaacccatgacaaactaaccgatcttatcagtttattttcatcgttgtttattttatggcattagcttttaaatcattaaaaatatatatacagaagttttataccaaaatattattttttaataataaatgttaggccttataatcaattgtaaacgaaatgactgaacggtaggactcgatgacctctaaaggtctgcagacacgctacattatcttatctttcttgtaatgggtgaaatttttagaaacaaatccacagaaattgatttattccttctataaatttttaaatttcatgtattcgaaaggagtcctaccgtttagcgagccatctccataaaatttgcttccaggagagtgtttgtgcggttcccctggagcttcttcacctgacactcgacctgcaggctgcagcaaccatcgcgcttctctgcttaagcatttgaccgaacaaaattaggtcgataaatcaatcgatcaaaacaaaattaggtcgatggctggtcgaaccggcaccttccctgatttttttttgctgcttctactggaaattataaacggactttttttcttctcatcagggggtcacatctgggaggccagagaggatgggggcaggagtaaattattcacgaggatgagaggagtcagcataatgcattcaatcactcactgccgtgatgttccgcccaatctccagttagcgaatcatgtgtataagcgataatactccaagatgatcttccagcatcttctttcaatactgtatggagtaattccatgttgcatcatgcttaggcttgtcgatcctgagaaagtagtacgtgcaaaaatagaacattcgaaaatgacgctgttagatccgagataggacgcgggattaagtgggataagccaacagaatgacagtacaatagagccgcagataatctcctcgaactaagcaacagtgcatttggatattcagaaactgctttacaaccatggattaataatacagattctgattggtgccattaagtttcacatttcacacactacacatcagatgacccccgggcatggcatatatgttctcttttggctgatatagctgagtgatcaaaaggatttgcatccaccagtctgaaacattccggttcggaccataagcacatcaccagcacaaacacagaaaagcatttccgcgtgctttcggaagcttttgatagtgtcaggtatatggccggacagatccccatcatatgcactgcgccaccttctgatacaaatcctgtggccagttcctgctcatgttgcttgccacgaggtttgcgatctgcccatcatgaaaaatattgcatgaaaaaaatgcagggggttgcattttatattatagcgagataatatcagaataatgctaactaaaagaaattaaattaatgcatgtctaaaacgtgataacacagcatggtgccctcctctgcggtcatccagataacttatttgaaataaaaatgtattaaaaacaaggttaatggacgtggtcaagcttgccatttgacaatgaaagtctccagaaggatgtgtatatgtggcagatagctagcatttagcagcgtagtgcgtcatgatatgaccagattttacactaagattggacattgttggaaaactttcttgtgcaagctctctatagaatattttaagtgcttcttgggcccacaggctgggccgcaaggtttacggccgtgacagcaatctttacaactacaacagctaaagacatgtatcagcataagactgcccaactgcaatcagccatcaggtacgtaactgtctgtgtgcacacacaagagaatgcttgcgagtggtataacctgctagttaaggtatgtggatgtgttactaaacaggttcttcaaattatttatagtttacttatctatggtagtttagcatcacattttctctgccattatgaagtgcagtgcctacatgctcattgtataagtaaatgcgcaaaagagattgaatacctttgacttgactgcacgcaaggtcccatcagtatctctaacattgtccatacaatttagagcaacttcaagagatctggcacacaagcttgaacatgcggtgacaagtttctgaacacatcaactgtcacatttggagcctgaggatcca

SEQ ID NO: 17497 - DNA, 7985 bp, Oryza sativa
aaaataaattaagatagatccaaatttatttttcttttgtctaaatttattttactattagatgttttattttagattgcttttacgattaaatttttcatttaatcatatattactatattatgggataaaaggagatacatccttttctttcttactttatcagtttctcctctccttttttttaaaccttttctgtgatgctgataataagtgaacctagctactcgccatcttgtagtttggttctttttgctgtttgactgcatgagtgcgacggtcagatctatcgtcctaccaccaattcaatgatgagagggagctttacctgcaggtctctcatcaacgacaaattggcatggaccatcgacgcacaatgtatctaagtcgttgattacgtggacaactgtatggtcaaagtttcaaagaagttttcgatcgaatctgcgttaaggccttttgttctgtagagaaaacataaaatagttggggattcaatccgaaccaaaaattcataggaaagtctttttaaaaaatgattcaatcatgtctttttttaaaaaaaaattctttttttagaatggattctgaaggaaagttagtaaagagctccaattaattaacctatatattgaagataaatcatttgggtcaatcttctcatctgatttctatatgtttcctactaaacaatcatttcacgcttcgcaattatatgtttttcttttactttatttttcaatctcgcatttcaaaagagcactaaatatttatgaccataggaaatatttggcacttaaggcatgaacctacggtccaacttttaaaactttgttcatcaactttactagaataaggagtttccaaagaaaaatattaaatacatttataaagttattggtactttatgtattgtatatttcttatgaaaggtttttgaaatctatgatagaatatttcgaagatatggaataattggctgaatattttatattttaagtatatcagataatttgccaattcccctaaagagtctaaacctacttgtggtgaatgacaaatcactgcaaaagataagctagccgtgctcttaggaatcactatgacacttagatcaatagaagacgcacaactctctagcaagcccgtgatgctgcagtattgtaaaaataaggatgaagccaaagttgagcctccctctccagcttctataaaagaggaagttggccgaactagaagaatacaaagaagcaagatcattcaactaaatcccagaagccactttctaattctagtagtaacatgttaagagtccaccttgctagtatgttggagtaaagattgtgacataatcagtgtaaggtaagcaaatcttatttgtattatccctcagagtttctgaaagggaaaatcagaagtacgatattttgtggatatgaagtagtgttgttaagcatcacttacttgatccttgaactatttatgtgagtttaagttctacgctaaggatcttgtagttctcacacatcatcctacgttcaaaacatgcaagaaaaacctttatctgttgaggaaatgtttcctttgggtagatctacctagggagataatagatttttttctctcatatatttagtcgcaaagcttaagccatttctaaagcaaaacagttagaaatatgatgagcaccaagtaagcttacacaactagtatcgcacaccccgttgtcccattggtctcgacaacctgtatagatccttaaaaatgaaagtaaaatgatattattaaaagtttggtatcagggtctggtcaccactgaaaaatatggtactacctactgttttttaatatatgacgttgttagctttttataaacgtttgatcatgcttaaaaaatatttaatgataaatcatgtcataataaaataaattatagttacataattgtttttaaataaggcgaatggctaaacgtatataaaaagtcaacggtgttatatatttaaaaaatagttacataattgtttttaaataaggcgaatggtaataatgttatttgcaagttgtcaaactttaaactttggttatcaatttttataagaaacttgagagtgcaaaacactgccctcctcttgaagcaccttgtaaagtttacaaagctgcagatttgccatgggttaaattgatttcagaatcatattatacttcaaaagtcccacatttaatcatgaataaaggatctttttggtggagggatattattgttctgacagatgtcttcaggggtatagccaagtgcacaatacagtcaggctcaactgtcctcttttggaatgatctttggaatgaggaattcaaatgcacaagcttcccacatttgtacaatgtggccaagtataaggaagattcggtcaaggatatgtgttctaggcaattggaagattctttcttactccccctatcgcctgaggcatatgctgagttcctacagctggaagaaaacttggatagcttaaaaatccaatctggaagaggtgacatctggagctttatatggaactctgatgtttacacaccaaagaggttttacaaaccaaacttcactgctttgcaaccccccagacctctcttgtggctatggaagacaaagtgtgtcatgaagataaaagtttttgcatggctcttgttctgcgatagactcaacacatgtgatatgttggacagacggcactgcgccaaagaagatgatgatcttacatgtgtcttgtgtgatactggccagagagagacaagactacatctttttttcacatgaccatttagtgcaacttgttggcaacacctagggatccaatagaaccgaaatttggaatttttttcagatggtggtcctggcaagatttcggtttgtacatcggggatttctggagatcttcttcttggctgcatggcatatctggaagcaaaggaatggacttatctttgaatatactcagcccaccttccaatcatggagattgctcttcaaaaaagttcttctgcatatgtgcaaaatgaaagatcctctcaaacaactagtttccgattggatacaaactatataggaatcctgtttttctttcacttttgttcttttccctgtaactttgtaaatattctctttcattttaaaattaaactgctaggcaaagccctggcagtattcctggatttttaatgaataataaattttcaagaaatatcttaaaataaatttataatatttaataattttattatattgtatttttaaatataataaatctatgtataacatttttattttttttaaactaaacaatatatgggaataaagtttgacctaatcatcctaaatgccaactatttattactgggatgaatacctttttcatttcctttttatatataaaaaataggtttaacaaaaaaaaaataggccttgtgaagcacatgttgggcttcaagtgctatgagcccaatcgaaaaggtcaatacagtttgaattagaagcttgcaacttttgttcttgtgagattgggtcagtttctgttcagaagtcggcccaacacagcccaagaaaggcaatgcaaatttgcaatgtaaatctagaaataggtctttttggcaaaattagttctatagcatcgaaagttcttgttttcgtttttatagcattgaaagtttgtggttcactttaatagtatatctccgctacttcttttagcactccgttagaacttccgtcacttattccccctgcccctacgtcttcttcatcctccatggcacagcggtaggcgaggtgtaggatggtgtagtcgatgaactcggcagcggcagacggcatggtctattgtggctgcgggagcgaactcgagggttgctgcaggggcatgttggagggcgacagtagtggtgctcaatctcagggagaaagagacgagggcggaaccatggtccgtggaggcgagatggcctggagccctggagcacggagctgttagattgagcatgccaagctggtggccttcctcgcacactaacatctagcgtggaggaaaaaggctgtgcttccgaccacggtcgattcaaatgatccagtgagagaatcaccggggggagagaatccccacctgaatatattaagaaaataggtaatttttgagaatctccttgcgtaatacataatgaaacactatactctcaggggtaatttatcgattcgtcgagcgaatttactctgttgatagtgcacctctgtcagaaaaaaaatataaaaataaggatagaaataaaaggacaggtagctggagtagctcagatggttagagcgtgtggctgttaaccacaaggtcgaaggttcaagcccttcctctagcgatatttttttaaattttttttagacttttctgctttgctgtttgaacaatttgtgtgagagaatttgaccatttgttgcattgctgtttgaacaatttatatatgtgataatttcaacaatttctgctttgttgatattttttataatttttttagacttttctgctttgctgtttgaacttttctgctttgctgtttgaacaatttgtgtgtgagagaatttgaccatttgttgcattgctgtgtgtgagagaatttgaccatttgttgcattgctgtttgaacaatttatatatgtgagaatttcaacaatttctactttgttgtttgaacaatttattttccgatttgctgtttgaacaatttttttgtgtgagaatttcaacagttagtatgcgtgacatgttttaaatgtgttagtagctttgtactctcagcaagaggaagaacaatcagccatcttatacatcacagaaacttagcatatgatccataatctgcacattaatttgtacacctacatcgaaatcatccatccatccatcaataacaatccccatattacaacaactgcaaattcgcatccaaatcccacaaaaattcacaacaacaacaacatccaaaaattcattaattgcaccatcaccatcgtcgtcaccatgatcaggagatggagtggcggcggcggcgctggaagaggaccttggcgtcggcggtggccttggcgccgagctgctggaggcccggctcggcggcggcgccccggaagtggaagagcgagccgagtcgccgcgcgaggccgcggaggaggcggttcgccgggccgacgcgcaccagctcccgccgcatgctcacctggtccttctccaggtccgtcagccgcatccgcatccgcgccacctccagcttcagctcccggttctcccgccgcaccgacgcgtagctgtcccgcggcgacatcgccccgctacccaccccgctccccgaccgcggcgccgcggcggcggcggcgcacccgaagaagagcgccgcgtcgtgcgcgccgccgatgctggtgttagtggttgtggtggtggtgccggtggcctggatcgcgctgcggaggcggagctgctcgaagtagagcacctgcacggccatctgcacggggaggcgctcgttctgcgccgcgtggctgcacgcgtccggggtcaggcgctggcagtcgatcgccttgcacatcctgtacctctccgcttccttgatgttcgggtgcacctgctcgatcaaaatcatcgagagttagtcgtatcggagaagaagattgcaatgtcgcttgcttgcttgcttgccttgaggaagatgtcgacggcgcggtagaggccgtcggtgacgaggcgggcgtggtcggggaggagctcggcgagggagatgaacttggaggggaggaggttggagtcgagggcgatctcggcgaggtagctgtcgagcagcttcgacgccttcacgaggaggctctgcttgggggacctcgggctgtcgtagtcgaacgcgccgcacccgccgccgacgacgacggcgtcctcgtcgttgctgtcgtcgtcgaggttgaggaacaccgcgaagatcctcgccaccacgtccgtgtcgtacagcgtgtgctccaccgccgccgccgccgccgcggcggagacgggcccggcggcgacgaggatgtcctccaggatggcctggtcgagctgcatcccgatccgcttctccaggtcggccctgcagatgctcgacgccgacgccgccatcgccgtcttgaggagccccgacaggaaggccatcggcacggggctcttcttcgactgcgccgggagcaaccccacgatggtctccaccacggcgcgctgcttcttgacggcgtcggtgtcgccgccgccgccgccgcatttggcggcggccgcgatgtccctcgccatgagcccgtggagcgagttctgggcgtagtttatgaggatgcgggtgaccgtctcctgcttgagccccttggacttgacggcggagagcagccgctggaagaagtcgagcccgaggccggcgactgacttgccccaccagtcccccggcgagtcgaggtcgccggcggcggcggcggccaccaccaccgcctgcggcggcggcggcggcttgagctggtccagcttggacagcccggaggtgagctgctccttgcagacgttgttggcgatggcggcgatgaggcgcgggacgaggttgacgtcctcggcggccgggagcagcgcctcgcagctgcggagcacggcgacggagccggcgatgctggggagcacggcgtcgcggaggaacgcctcggcgcggagctccaggttcttgtcggagaagtcctccgtcatctgcaggtagtgcgcggcgcaccggagcatggcgacgttgcccaccgtgacgtccacgcccacgccgtagcagaacttggcggcgagctcgaacgccgccgcgccgcccggcgtgccgtggagcccgaggcgcgccagcttgccgtccttggcctcggccaccgcccgccggatcttgccgctccgggacaccagcgggaactgcgcgagcagctatgccgtcgccattagcacaccattcttaatctcgatttcttcgtgcaaccaacaagaagaagaagaagatgaacctgctcttaccttgtgcagggcgaagctggacgtgccgacctcgacggtgaggtcgctggagacgtcggtcggaggcctgcatgcaagaacaagacggccaccatccatgtcacaatttagcatgcaaaatcatccataattcatctgattgtcatgcaaaatcttccataattcatggacaggtgacatgaacaatgatcaaaacaatggcgtactcaccattcattggcatggcggctggtgagggttggtcttaatgccctcttcccggagaagctctgcctcagctctgtcaccgtcgccacgcccatctctctctctctctctctctctctctctctccctctctctctccacaaatcacaatggagtactaacagtaagtgtgatcagtgcaaaaggatggcttgtttggttgtctcctagttcagctgcaagcgtgtgctaagcttcttctgtgctttgcagacttgcagttgggtgtcaagaaacttgtagggagagagtagagagagagagagagagagagagagagagagagagagaggtgaagtgaagagaaaggtcttaaatcttataattaggatttaagggctaactggcgagtgtgcggtgtgggagtgcgtgcgtaaagctagagctacatgcatgcattacaactatacaagctgtgactctgcatgagtgagtatctgaaattctgaatatctgatgggctaagctagctctgttcaaaagttgctactagtagtagtagtagtagtagtacaaaataacaaaaacactgctgctattgcaatttgcatagtcattttggctatcttgatgatgatgatgatggtgagggcacacaagctgctgctgcagagtcattttggctaggaaggattgatgagccatgagttacaatct

SEQ ID NO: 17498 - DNA, 2252 bp, Oryza sativa
ctaggtatcaattataagctctagagttgcaaataataagagcaattatcctcaagtgataaaacggtttttcttctaataatgtctcctttggaacacaggagttttataggaactgaactattctcacatctgagcttaatgtacggttttacactcggtcatttccatgagtagaacattaatcagcttcaattaataaactgagtgtaaaactccagaaatgcttatcgtcgatcgaccttgttattcttgctaacctcaagcggcattttgtgatgaacaatgtgatgctcttgttgtcaccttatctcagcatggttgaatctaaactttggtctgatatctcatcataccgctggcctcaagattatctcccaattttgaagtatgtgtgtggggatcccagggcgaacaaactttctgccataaaaatttgcacgggcaatggctttctgttattcttctggtctaaaagctgccccctgctggttgaattggtgccatgtgaggtgcaaatcatttgtggcactgactctgtataagatatggttcacaatgtttatatcttaaattaccatgtggagtactccaaagcaggcttatcatcagcagggtagtttgcataatgcacattaagtcatgagaaatgttaattttaaggcaaatcttgatgtgctattcttttgcttgttgagttttgtagtcttaaagttttgtaatttccttttgctaccaacagaggatcttgattccatattgagaatagcctgctacaaagtgaaggggaataattgtatttaatatacttgattgatatcttagtttcttttgagatgagactactagtatcttaaattatgtttgatcataaaacaaaacaacaaagattgatatcttagttgttgcatgcaattactcgctggattcccgtggaccagcattggcgtttaacaagaaagtgaaaattccatgatggtgcatgactaagccctgggttttttataagccaaaaggaggatcaaaagagggggcttaaggcaaaagagaagcaaaggcaaaggccaaggcttagttaaacaaaagggtaggtattctttggcacccaaattgcctggaaagcttagcatgccagcatatgcattagctcctctctgtcatgtgggccatgcaacctaattaaattgccaatctatatactctatgtagtaggttgtcaccaaccggtttattttaataaactacctaatggctatattggctaagtacatttctttagtgtgtgagtgtaaagcattttgtcagagtcagactggaaatcataaggagggtggcaaagagcagaagaatcttgttgttatttgaaaaaatgacagagccgacactgaagcttgcttgctcccattcgattgtgttcagcctttcttcttcagaaatagagactattattattatcctcatcctaatgctactctttgcactgttaagtaggagtattactaaacaagctaggacacacatgcaggtatcatgaaaagcagcactgctagtactgcagttaaatatacactcactagcttaaagtttactgaattctaagatgatctctctcgttgtttcaagtactggctcgtagtataactttgatgcttgatcacattcgtaggctatcaatcattgagtagcagaatttcactttgtgaacagcaacctccactaaccattctctctctctattttttttagtaaaaaagaacttttacacaaatcatccttcacattttgttccctctctccatttattttctctctgatcgatcgagctttgagcttcaggcgtttattgccagacacagacaacgtttgagttcccccaaatgccggactgctccccatgaccagcaatgcagggatatatagcaacttgtccgggagaagatttcagagctaatctgaaacgacctgacgtgagagagaggacgaacggaacacatgacgaacacgcgagagagggagaaaacctgcgtctcgccactggcgcatcgatggggactgcgactctctcgcttggaatcattaggcgttagcgggttagcgtaggccacaggcgccaattggtcatgtactcctatgcagtactatgctcatggtcatggcaggccgaaaggaaggcgtctcatcatcatcaccatctttaatttgcttagactcatcactgaactactcgatctcttttggctaacctatcatgc

SEQ ID NO: 17499 - DNA, 1617 bp, Oryza sativa
ttcaaaaaatttaagtaattatttattcttttcatatcatttgattcatggtaaatatacttttatgtgcacatatagttttacatatttcatatttttttaataagatgaacggtcaaacgtgtgctaaaaattcaacggtgtcaaatattttgaaatggagggagtattatttactacttgatgatgatgatctgtgctgctgggtacgtagtaggagtacgcatttacgcaatgcggttgccggcggaaaggggcgcagtcggccgcgcgagctgcagtgcaccgcattgcttgatggagcaaaaaagggcacggcggttcggcgctttgggggctctttttataatctccccggagctaagctaagagagaggctaataatcgtcgccggcgccgcccggctgtgcttgtgcatgcacatgaacgaatgatatgatgcaacttttggccagcacaagcctttggaaattggagtttggaacgtgggggatttacatatcctctggtttccatgaaaactcaactgatttttctgtaaatccccatgtatgaattttcggttaaaagtgatttgtttagggatgtcaaacgagctcgacgtaaagttgagggataataaggccctctttgtttgggcttaggcttattagcttagacttttaagtcagtttattggcttatatgatttataagccggtggatttaatgttctaagtttaatggtggagtcatgcatctatctcacataagccaaaaaagcttctccaacctagcttttggcttaatagtgttagagtggcttatggcttaaaaaaaccaaacaaaaaagctgtttgtttgtttaggtttatactttttgacttataagttggcttataagtctaaacaaagagggcctaagtggacttattccaaaagtaaaatatactggtccaaatcggcccaaacccagggagaaattgcaccatagcccacagggcccaacatcctcgccggtcgccgccactctcgtccctctcccttccccgagcgccgccgcctccctcgcttccagctccgaaagcgccttccccccaagcccagcggcgtcgctgcctccctcctcggcgatcgccgcctccatttctcgcgctcgaggtccgcctcctttgcgccggcggcttgctggctggttgcttccccgccgcgtgcctcggaggggaccggccgtttcttgttgccctccttgcttgcttgcttgcttcctccccctcgtcgccgctcactccgcagcgggggtccccgccatatgtaagcagcatctcgacgatcttgtgtcgcgtagcctctaaacctgtgtgatttacaaggattagggcgtcgaattagacttccccgtgtaggtgtgcatcagagctgttcgacgtaatgcccgtgccgcatggcgatggttagtggcgcgcttccttccatgattgccatgtgtattgccgtattggcgttgaatgagcgaggcttattaatagtccacatcattttgattgctatgtatactattgtttctgttgtgtgtccgaaagaataatctggtcttctgctgcagactgccgcatctgtttttggatctggtggatg

SEQ ID NO: 17500 - DNA, 2741 bp, Oryza sativa
tctatttcgtgtcaactcttggcatggtttaatttttgtccctgaactctaaaacccaaccgttctggttcatggtttattgccactacttatcttccaacagttctgtctcctcttcaagccctcaacaaaatcaattatgtttttgatgaatgcatgaatgtttcttatggtgctaattgaatcacaatgatttgctaagaaccatttccccctaaaatcaattatgtctgagctttattttggttggtgcaaccaaaatcctatcagcaatcagatattttagttgctatgatttgaacttgaaatctcaatacagaataaaatacataccaatgtctgttttggttagttctgtgtcttatttatagaaaggtcgtgtataattcagcttgtagaaatttctttaactggaaataaaaaaatggttataatacactgagcctgatctgatgactattggtgataagtccctttttggcctattgcaggttgggccacttgctgcctattataaattaccacttaatcgcgtccttgtggttagtattgtaatatctaatctttatgagcgctaagttacatggcaatctgatttctctattgtgagttttaggcatttgatgacatggacctgccctgtggagttcttcgtttacaacctaaaggaggatatgggcgccataatgggtctgttgattttataatcatgtgttttaatgaagtaatttgttgaaattaatttgtcatttaaaagactgacctgataagcaactttctgacaacctcatcaggaagagacaacatattgttcccttctaatatttttacttaataaatttttctcgtttgtagtggcaatttctgcatgcacctttccattttccccatatggacatgttctttttttttcccttttacatagcctgagacagccatagttctcttgaaaggtctaccagatataatgacactcttattagtgttctcttattttactcatttattttactattagctatatgatcctattttctgtttgtaaataagttttttttttacattgacaaaatatttacctttctagcttatcagggtgaagagcttgatataccattttcgtaagaaccgagaatttggtcgattaaggattggtaggttcgacatctgtgttcatttccctcccttaatgtggataaatattcttatactttaacttattcaggaattggacggccacctggccaaatggaccccaaagcttttgtgctccagaagtttaataagaccggtcgagaacgggtaaatatctatatggctagtacttgttagcgtcatgcccttttctgagtttttgtacagtaaccattggatgatttactttcataattctcaccggatgatcgtgctcatttgctgggatatatccatatgaccaaaaccatggctatattctgcatggaagtgagccgcacctagatttattctacttcagttaaatctgaataaattttgttgtgctatacgcaaatgagagatgatttataggcttgcaacatgtctatgtttagaagattaccttctggtcaacttccatgtggtgtgccaagccaatcctgtgaagtttacagcccttgagatctcttaaatctcaaattgttttaggtaataatgtcaccatgtcctcaaaattgaactgctggggttcctgaaggtacttggaggacttgttatgacaatctctgtcactcattagcgtttttttccatggaatcattctggtacatcatatttctggaagcaccatatttgacataattatttcactgtcacagtttttattattctgtatgtagcgaccctgaagaattgtgctgtgacaggtagtcttacgctttgcatgttttgttttatcctagattgattcagccatagaagagggtgttgagattcttaagttggttgttaccaagggtttgacagaggctgcaagatcatcaaatgtggatcagaagtataagcatctgacaacacacgacatgcaactgtaaagatgatgacagacgctgcttgtccgagagcgatccactattacctgttgaatgcctgatgggagaacctggtaacatctaaactgcttgattcattgatttgccaaacttattacaagggctgtcagccgtctcctttgcattggatttgtaagttttgatgctctcaatcttttttttttatacttttgaacaactgattcaataaataaaaacttgacggttctgtcagcttcaagattctatctaccatgcgctttaaagataaagctgatcatttttctttaaaagaagatggatatccattttacgcccgtattcagacctattacttatacaaggtgctaaaactcttcagcttctaccccatggactgaatggacggagccgaagaaacagcaaaagtacacggaagaggatcctctaacttacttccctctgactttgagtcattgacatgtgtacccgataggtaaagagcccacatatcaatgacacaagttagaggaaaataagttagaggattttaatccaaagcacacaagagtaagtagtactttccgtaataccatacgttctctgaacaagctggtaatattaggaaaaccacatgagcactgagcacacatatacatgcgccaagcagccctagattattaactaattttatttgctcttcagtccaaactc

SEQ ID NO: 17501 - DNA, 1314 bp, Oryza sativa
tgaatgataataaaaattaatgcgacaccttgatccaagccgaatatataatatgctatgtttgttagtggttttttagctccaattatttcaacggccactaagtgaacaaggaaaatccacttcattggattaattagcattcaagtacttgaacattcaaccgatttatattttttttgtcagctcaagaaaagctaaatgtttgagactctgctaagtgtatcttgagcaacatggtcaagtggagcagataagtcactcatttttggcttacaccatggagtcacacccaggaaagggggtggaccctacactacggatatcgtgttgtaagaaccccttgtcatctcgttaagggccaagtggcattctcacatatagaagattggtggatgtttgtcaccacatcacccttgggagcgatgcgcaggctgcagagcccatccatcgcattaactatagattccttcaagttgcctctcagcaatgctaagcgatacggtgtattcaagacgaccaagcctctcttggaaaatggtttttaaagactgtagttggactcgacgtggagccccatgagatatttattgttacaatagatcatacgaggagttagctacttagctcaggcttatgattgtataataggatttttgtctctcgtagtcgtagaagagagagccgatagccgtagggtataaaaaacacatctttagatcctatagaggggtgaaatgcatgatatgggcaagaaacctagtttcctactatctcaagagctcctaattataacttttacgaatttgcttgatagtgatgaagaacaagactagggtcattatcctttgggaggcccaaacctgtattggtgatcatgtctttctcgctcccgggcacactcggacatgctgtttagcctatttgcactgagagctcctagttgatcccaaatacatgttttctcttgtctgccgatgctcggacgtctacactttttttttctttctctcccttcaaatccaaatatagcggaaagtactggtccttgggcttccgttagctttcattcaacatgttttgtaccaccaaaaattcgaagataattctcacaattagacattactaatagctttggtaaaattggtttgatttcaacaactaaaatttggcacgtcaaataaatcagtcaaaacagtcaaatttgaaaattaattaaaacctaattggggtgcatcaaactctacggaagtatgcacgttaaataatttattcaaatattagtttatttacggtggattaatgtaaattttt

SEQ ID NO: 17502 - DNA, 1686 bp, Oryza sativa
attcctgcagcccaccatcagggagaacaccatgatcagataaagcaattgaaatatgcacagcatctacatggtatccttcctctcaacttctttagacaaataaagaattgctggaagcaattggatgcttaacagcagaacatatggatagaccaaggggtcttttccattctttgtataatatgatggttcaaatttgtttaagtaactttgcagatcctccagagtataaggcaccaagccttcatttgaaacattagaagaagatgcactggtgtactcccgcagagctgacaatttgaaccacaagaaatcctctatagtattgaaaagtgttggcagatctttaagcaatctgtcgatttgacgtcgacaaccacagatcatggcataaaggagcaacttcttcctatcataaccaggacggccaggtcgatcacccattctcagcattttgtcacattcctcagaagctgtcagagcagtctctggggatacagcaccattagtagtaatccattctacaagctgcaaagaacatattatttgcatgtatggtatcaagaacaagaactcatcgcaatttatgacatgtcaatagtttaccaggggagcaaagttgaatgcagcacgagatgattgggcaacttgtcttgcctcatcatagtatccggttctcaagcagaaataaatctaaaaaaatgtcaaacaataatacttcaatgttagcagtacaagattaacaagttacatgaaaatcaaagagagagaacattccatgaaggcgcaactgagaaatatttgttgataaattagaataaagcacatgtacccacagaaaactttttatgcatcagatatggctttactttagagtattatagcctacacttgaataaagtaagtcatagaataagccgaattgacctagcataggaatgataccatgaaaagcctaagctagagttgaaaaataatgaataataaaaacactcatggccccagtgttgcactatattcaacacgatgttctcataaaagctccagtattcttcagttgctgcacttactgtattttggtggcacggttttatttgaatgtaaccaattgttttttcatgattttaatatgccattactagacagattgaaatggcaccaattgcaattttgtgttaaatacccaaaactaaaaagggaacctgttgccatgttgtgtccactggtggctgtctacgcagatcagttgcatcaaagtctagcacaccatgatcccgcaaacggacctgccagtcataaggacaaagatgcatgaagctcatgtagaacccaaattgtacagcatcatttcacttgaaaataaaatgatgtacagaaacaatgaaaagggagagaagcatcaaatttaaaacatacccgaagaaatgcgcgaatcttctgaagattgccaacagatccaccaagagcagcctacaaccataaagcacaatcacagcttaattaagatctattgatacaacagaaaagctcttgcatgagtaggtttcctaaaacataagccacatagtaaagtgagagtagggaacatcatttgctaaaagactaatggaagatcacaaccatgtgttaaaaaatcaaaaaataatgaactattctgagttgctcactaacattaaatattat

SEQ ID NO: 17503 - DNA, 10655 bp, Oryza sativa
attcctgcagcccggaaaagggccaacagatgtcagcatgagtgctacacaaaaatcaattttattacctgaattaaatgccacactttatgcatggtcactgattttgtcccaatagcaccaacagataaagactcataagcagccctgaatgctgtagcaggctaaccaaaagataactttaataagcattagcagaactacaagtacatcaatagaatttgcttatgctctgatgataacatgtcgaggctacataaaaaaaaaggcacttgatctatttctcaaattaaattatttggagaatagaactatggatagcaaaaaccacaaattcaatctataaatgaataaatgtccatagagggactaagtaacatgttgaatcatagcatatgagtttaacacttacaccaaaaggtaggctgcgccctctagcatcattaagatctctcacaactgcagcataaactgaagatttgttttcaattatagttttgttaggtatgggcatgacttccttagatggcagaccggacgaagattggggactggaagctgaagatggcatcagagcaggacgagaaatcccactggccatgagattagtgtttcttttcggtaatgtagagagtcggcttagactctgcaagaagtctcgcttctccttctgccaatcatcctacaacatagatgttatataagttgagaaccaaaccgtaaaataatttgaaacattcaccactgagcgacataggagtacaagaccaatataacactgaaaaatgtagacatcttagttacctgaaatggtagtactgtactgttcaattaaatcaaatcacaagttcacaaccctatgacaactgattttgttttctaatgtgcaatgcaataatacatataggtaataacatatacaaacccccagatgatacagaaatttgccgagaaacttttaacatataccaagatgatataagaaagtgcaatctgaaaagcacttcccacaggcttgcaacaactaaaccagatcatatatatatatatatatatatatatatatatatatatatatatatatatatatatatatatatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccacaaaaataggaaacaaactcccatctgttataccaagtcctattcggttagcatcaccaggagaaccgacaccattcacagagagagagagaaagagacgacgccgccacctctcccgcccccgtcggaccgcagccgcctccatgccgccgaatctggcggaggcgaggtccggcccgccgcccctcccacccccgccgggctgcagctgcctccacaccgccggatctggcggaggcgaggcccaaccagcgttccatgacgtccgccaccaccaccactgccgcacctccccaccatgcacagagagagagagaaagagacgacgccgccgcctctcctgccctcgccggaccacagccgcttccatgccgccagatctggcggaggcgaggtccggcccgccgcccctcccgctcccgccgggccgcagccgcctccacgccgccgttgttcggggagagggcgccgcgccgttggttgtgggggagggcgccgccgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaattataagttattgaatgtgtttatttcgaagcaaacctaaaaggaagtattttctttctttttccaagtaaataattgttaaatgacgtttgtattaataaaattaacaattaagctctgaaaaattcaaatataatttcaaagagcgtaactaatcatggagaatttaaaaaaaaaaattaaatttaaccatgtcattttatttctcacacttgctttacttgtaaatttatttaattatacacatacctacttaaaaataccaaatatttcagcgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtatatatatatatatatatatatatatatatatatatatatatatatatatatatatatatatatgtaatgaagttagcagcaggaaagggtaaacaacctcgagaacttgcatcatataattgttaaaactccttaagttgtccttttgtgcttcttgaatggatgagacgattgccatttcatgaagctgaaaacacatgacatgtttcaggatatattccatgaaattaggagaaaatgcatgtaaaagatgtatgacggtatgaagtgtgcacctgctgcaggtactcctcgacagtagttgcttcagatggaaaaacatcctcaaatgtggtctacaaaacctcaattttaatcactatgatgtatattcaagtagtctagcaagatagagtagaaaacagaaaatatacaataagaagctgcagattcacatacagcaacagagttgtaaatgtattaaggtatactgatgaattaggagtgaattttagagaatgggacatggggcatacatagtgaacagtaaagttatggtggatatataaggtgaagtgcgaaaaatcgtgcgctgttattgagtaatgatttccggtcaagttttttatatcaagagcccgctgatccaagcaaaaaatagtagcatttacccaataggaaaggactgattcttacactattattataatgaatacatgctatcgttatattagctgcatttaaatacacaaagagaacattgcatagataaagcatagaaatatgagctatcaatttcttactcaagtagataactgtatgttaagtttcttctacaatttaagtagaaaattgaacgctaatctggagcagtataattgaaagtataggaccaacgagatcttgctgcacctcgaactctagagtcgtttcttgtttcaacatagttcatgggtaactatttcaccaaagctagctcacagatactaactaaacatttcgtcaaaactactgaactaaactatttactagtaagttaaactgctcttccaatttaagaagacatgatgtattggtaacaaacaccaaactatcatcttcacttcttcatttgaaattgtaaaggatgtttttcaacaatttggtgcaaggaataaaacatggcaatgcttatgacttgttataattttattacgttttaaccctactttgtgataaccctaggttttaaccagcagtacagtaaaatgtctaatctcaaaccggacaaactgctcgatctgataatcagcaaatgagattagtataatatcactctatgaaatgggatatccctcgccggccatcaccttaagttcgaaggatttgaggtccctggcgagctgctccgcattgatcccctcgcgcgccaacaacctgcagaaagcaaagcccaaaaccctaagtcccccgtaaacccccaacaaccgcctacccccgacgaacccgacgcggagaaccgcgctgcgagcctcgccgaggcaaatcgaaggggggctccggggagaagacaccgacctggtggcggagagcgactgcacgggcgcctcggcgcgcaccgtcttggccttgagcttggtggagagcacctccagctggtccaggttcctctgcgcgcggggacaagcacacgggggaacacgtcaggcggaagaagctatggcggcggcggaggaggaggaggcagatgcgggggggaggaacgggagaggaaagcggcggcgcacctggaggggagggaagtgcggggtgggggcggcctgctcgaggagcttagtggaggagtggaggagctccgaccacccgcccatctccacgtcgccgccgccgctgctgctgccgccgacgccggccatcgccgccggggggctaggaggagggtttggttggtgtcgtagggcgtggtgcggcggagcggaggggggagtggagcgggtttttcctttttcgggggtagggaaaagagggctttgttcttgttgtagatgggcctgggcctaccggctcttgcgaatttgtgcccgattcaggtcagatcggcccatcttctcttctgcatttttttttaattataaattgtgtctatggtatacgaacttgtgtgatggttggaaggctgtgtttagttccacgttaaaattggaagtttgaagaaattaaaacgatgtgatggaaaagttagaagtttatgtgtgtagaaaagttcaatgtgacggaaaagttaaaagtttgaagaaaaaagttggaatcaaaacaggccctaaatcggtacaataacatgcaaatcgtttggcccggtaaaacaacttgcttcgtcagtgcgaattggggtcaaatctcacagtgaaaattcacttcacgtcagtttccacgtgacacagttcgattgcatattgcttttctcgaatgcgtctattcttgtggtggttgtggcataaaaactactccatccgttttaaaatatagcaaccttatactgaatgggacatatcctagtacaacaaatatggacatactcatgtgcaagattcattatactaggatgtataccatccagtataatgttgctataagataattattatgtaatgcaaaactagaaattaaacatcaccaaaaaaaagtttgagattatttgcaaaagctaccagaacagatgaaaacaaatggaagcaagctgaaactaaattgtgctgcatggaaaccaagtcagcgatatatcagttcatttagattgtgacacccgatttgtcctgaatcttgattcgcatgaattcagcaagttattgtatcggattaaacgattcgcaagttgttataccaatctatacccaccacacaacgcaagttagtgtaccgtggtgtgtaatttactactccctccatcacaaaatgtttgacgccgttgacttttttaaaaatgtttgaccgtttgttttattcaaaaaatttaagtaattattaattattttcatatcatttgatttattgttaaaaatatttttatgtatacatatagttttacacatttcacagaagtttttgaataagacgaacagaagtttttgaataagacgaacggtcaaacatgtttaaaaaaggcaaacgccgacacgcctgctcactatgatattgtgaatgtggtgtatagcatatgcgctcttaaagagatgaagatcagcaacaaataactaaccttgctagattcttaaaattcttattgaaagtagactgggagtccgcattttcgtttttgtttcatttttgaaaagcttctgcatgctactacgatgctatcaggtaattgacagttcacctctctctcataaaaatgaaatagttcaaactatcatatcaaaaatgttgtgtataggttgacgtgaattcaagttcaaattaacaataaactttccccgagaaataagagcaatgattcattctaaaagaaagaaataatattgattataagcattaaaggtgtaccatctttgctgcagtacaactggaaaattcaggtcaccatgcaacagaccaatcaaaacacaagatttgctttggatcgatgaggaatgattacacaggttgcaattgaagaaaggtgttacaatggaaggggatgtcctgaaatgctagagatctaagcttccactcaaatgaatctaacaccaaatgcaccagggctataagaattgaaaaacagaacctaatgtacacaggtaaactacctgagctccctccacagcctatacaaccgatgttcgaaaaataatccaatgacaataagtcaagaagaaatcaagttatcatcgcatgcctcgtttgcgaaacagcgcatggtagctgctgaggagtattttctccataactgaagactctgtctataaatattactcttcagttccttttccttaccgagcacgggcagtggatggttgttttgatgagcggccaaacttgtgtttccatttctgtttcccaactgcagagagatcagccaaaggaccggaccaagtaggaacagagcttttctcttgtgtaaatacagtgctaaacgaagagggatcttggggttcgtataacgggtccatgtgatttgtagaaaccaaagagaccgcaccatcctgatgcggaggaggaaacttttcactcttgctttttgcatttgcatgtgttactaatctccttttctgtaagatataaataaatgggacaaattagagacattgcaaaatttacattaagagagtgccgggctccattttgggccatagtaaatcaaatgagaccagtataggtaagacaagaaaataaagtggtgataaagtgttactgcgacggagatgagactaagcaagtggtttcaccacctccaccttaaatttagatcgctagcctagtctttaagtaaaacagctcaaagaaacaaaaactaaaacactactggaattagtcagggagcaagtatgttcacatacatcgatatttatttgaagttcagcatttgcctctggagccggtactgccctaggtcgatcgcgcgtctttgtcttcttagctccatcattagtcctaccgccagcagctctcaaactgttgatcatgccatgaataggtcaggtagcaatcaaatatttctatacacgctcaactcacatgagagcatggacagaaaacatgaatcaaacatcaaatatactaggatatgtgggcatttggatcacttagtgagcaaaaattctaaatagctgagcccagatggtgagagactgactatcagcccaacgatgaggcatgtgtcagacaaattctgtgaaatccagggacattagtaccacagcagtatgtctacttaaagtttcacctaaatcagcacttgcattgcactaaaattacatttgggcaatgctttcataatttgattatatataactttgctgcatgaacattgtgtgccatctctttaggatatatttctatgctaataatattgcttacgggaaaaaaaaacatccatattaataccaaatatcaacaaacttttggtgaactttactgttttagcacttattagtcattttcttgtaatccgacaaaagagagtggcttccattctttttataaaaaaaacaaaagaaagagagagtggccctgttatctgaagacagcactttgtacaaatgtttctttcgaaaatagtgaaattgtttttagtttattgaactattccatatgcatacccaaatattagaataaatacatgttttttcttgtcgtaggtattaaacccgagcaagcactcaagtatccaacctaggtccccagaaaaataatgtgccatttgataagcaacagttatatgtttaaagttaaagatgctatttctcaaatgccaatttaaaaagaaagtgctacaaccacagagtgtccagtactagagagacagccaaggaccaaagcgaataacaaacaaataataaaactaatgagtatcaaggtgacaaaccgtctggcttcttcatctcttcgttttgcatccatttctttgcttggaggatatgctgggagacttgatggttcacatgcataaggttcagttgtaaagaactgcatagattgtaataagcaattctttagtaaaagtgtaaaacaatgctacataatttcaacaaagatgacaataaacagatctacttcacacattatccagtgagatatgtcattcaaaccaaatgtatgctattgaaattcgaaaatcagacttgcagttatagagtgctactatagcctagattgataatatctggtaggaagatgcttccatgctctttataaatcaaaaaatcatactttattaagcaaatagaaggcctaaattgcagccacctctaaataagatacaatggtccaaatgagatcacaagcatcatagtgtcatattgcacaaaagaattagtcatgtcatacttcttggaatatgggataggatgcagaaaaaatatagtggtcataatgcttgcaagtaaattattggatattggctaaatctacactagtagctacccagaacaaaatctagccaaagcaccatgttctgaaaccccaattgcaaactaagttattgcaatgaaaacgtaaatcacctacacccaagattttctaaaaatattgtgcttatagagggcaatgactttgaggcaaacacagaatcgcagatttcagaacttcaaactgtgtcgtaagacaccaaagccaacttacatcacttcttaatgcagaagtcgctgttaaacgatcagctggatcaattgcgagcagtgtttcaatcaatcgcagtgctgactgtggaaaatctttgtaagtctctgatattcgccttttgtatggttgttgaggcttaaatattgttgcatgaggtagcttggactttttccaatattcttctgtgggggagccgcacagcttaaaaattttatgcagctgttccacctaaaagggacagatgattattaaattaaataaacatggaacataaatacaattggcattcattagattggctggaatgaacaacattacgtgcatgaacagtgcaacaggtcatattggatctagcataatctcaagtacgaataaaaaatatagtacaaaataagggttcctttggaacacgggattgaaaaaacgaaggaataagaaagtcacaagattgcaaaacacgggaatcagatgagtgagatagaatcaaaaagaaattttccaagaggttggagctcttgctaattttcctccgaaatctccataggattgtacattccataggaatttcaaaggaaaagataggatttaatcctttgtttcaaatgccttcctaggattttttccaataggatcgaaatcctccatatttcctatgtttttcctacaaaccgaagggggcctaaaagtgtaatacgttgaacatgtggtactacagataaagttagaacttttggtagagcaacgtttccagtttccacatgaaaagctactggttttatcaaccactatgtttacctaaattgaaactagtttagcactccaaggcctccgaccaaattgaatactgtttcaaggcatttcaaactgataattagacaaatcagcatgctgttgctaacctcagtacggcctggcataataggcctcccagccaacaactcggctagaatacaccccgcgctccacaggtcaacgcccaccccataatccgtggagcccaaaagcaactccggtgggcggtaccacagcgtcaccaccctgctcgtcatcggctgattcttgttgggatcgaacaacgacgccaggccgaaatctgcgatcttcagcatgccattgttatccaacagcaggttcgaccccttgatgtcgcggtgcagcactccattgttgtggcaatgctccagcccggacagcagctggtgcatgtagcacttaacctgcatgtcagcatgccatggaaaacctcaattaatttcacgacattgcgtgctggaacatgaggctgcacaaagatcttggcggggggagacctgtggctcggtgaagctgatgtcggggctggcggcgaggccggcgaggtcgtgctccatgtactcgaagacgaggtagaggctgcaggacatgcgggaggtgacgaggccctcgagcttgacgacgttggggtggtggaggcggcggaggatgaggatctcgcgggccatgaagcggacgctctcgggctccaggttgtcgaaccgcaccttcttgagcgccacgatcttgcccgtcgccgtgtcccgcgccttgtacacgttgctgtacgtcccctgcccgatctgcgccaccgacaacaccgcgcgctgttgatgagctcagctcgcgacaatggcgagcgcgagggcggggggagctcgtaccttgtcgatcttctcgaaggagtcggcgcggcgaggggtccagccgtcgatggcctcgccgacgacggcggagagccaggcgggccagccggccgccacctgctccccgcgcgccctgttggcgaagctccccccgagcccgatgcgggccgcctccgcggcggaccgc

SEQ ID NO: 17504 - DNA, 2817 bp, Oryza sativa
cggccgtggacgcagcccatgggaggggaggggagtcggggggtcaccggcggcggcggcggcgcatggggtggaggcgagtggggagtggggagtggagtaaagcggaggagtgaggtgtgggggaccgagctggatgcctggctggcttggttggctgggctgcccgtggaggctttgactctctcgctcgctcgctctacgtgactctgtgcaagtacagtgtcagctcagctgtccgtgccgtgcttccaggcctatttttttcattcgtaataatttattattatccttaaattaaataaatagtgatccatccgtctcatgaggagtgtatttttagttttttgatacgacgtttggattttcgtcttatttaaaaaattatgattagtaactttatacgtaactatttttttaagttttttttataattttttaaaataaaacggacggtcaaacgttggacagaaacccaaaaatatgtttttaggacgttggacggaaaccaaaaatatgttctttgtaggacggagggagtaagtattaatatggattttcacaaacaggatggacactgaacgaacgatgtccaggtgtagactatctcatgaatgacaaagggtgtccaggatgatgcggcctttgactagttcagtctatctgtccggtcgccccatctacgatctatgatgaaagaagagaacacgaaaaagtaatgaaacacgttcctattgggatatgtcgatgtggggctataattgattgggtgtcgcgcgtgtccttttacagatccgccttcagtaacgtcatgctgctatcgtaaatttgtacatacatagtgaataatatgatctagctttatccttcatgccttcattcatgcatggcagaagacacttgcaatataagctagcccatgatgtgctcatgagcatcggtcaatctagtcggcatccgccaatgatacaggtggatgtgaaaaatgaaacctatctacatgcaaaaaaaaaaaagaagtgcagtggcaagcctttgacgatgacagcgatgacgcggacggagccatggagggcgtggaggctgccacgactggagcgctaataaacgcactatccatatatgtcggacgtggaagacatgtgaatggttagggcaagcagccactacatgacttgcttgtgatcataagtatgttcggttctgaattgtttgtgatacaacaagtctgacccccgccatatggtggacgccgtcgacaacaacgtccacagcgggacgaaatatgtaatagcatccaagactagacgttgttcgtcccagtatccaacctattttttaaaatgaaaattaaattactatttatttaattcaaggattattatttattataaataagaaattcgggttttgaggtgaacaattttattttctaaggggctaaaatcgtattacttcatctattcgtaaaagacaactagcagtacaggacacatatttgctgacctcacttaccagctagatcgatctaggaatctgaaaggacacaagtttcacggtaatgtgtagcgttaagtacctgggaaagacacaaagaggatacatcctccacaatgtcgccgcacacctctctcctcacagcgcacgccctcatttcgcttggagaatgagtatcccattttagctccatgttcttggcatggaaatggtagatgcgaacatggtgtggaatattttctacgacatgctcaggcaaaatgacacatcgacgcattgtgatgcccaaaataggagtataagcatttttaatgaggtagcaaaagtcttctctctttttaactagaggagtagaagtaaaacaatagtttttggacaccgtttatgtaaaatattgcttcctttaaccgtaaggatgtgcataatttttcatttttgaacttttaattgggtaaaaaagctatatcttttgggaaatgttaaatatgtttaaaaaatattaagaaaagttagtgtgggattgattttagaaaatgaggataattattgatgttgtttctttcctccggctgtttgtttagggtatatttagatccttggtaatttttttcaccctgtcacattctaatgtttggacatatacatgaagtattaaatatagaaaaaaaaaactaattaaacagattgcgtgtaaattgcgagatgaatcttttaagcctaattactacatgatttgataatatgatgctacagtaaacatttactaatgacgaattaattaggcttaataaattcgtctcgcagtttacaggcggaatctgtaatttgttttgttattagactacatttaatacttcaaataagtatctgtatatccgatatgacacgacaaaaaatttcacccttaatctaagaacagccttagccctcctttattcatgagacaatggtgattacgagctcctatacctcctactactagtagcttggtgatgtgaattgatggcagcatcaaaccaggtgaaggtggcatggactcacgcgtagctcgcccttgagggcttgaggaggcaaacctgacttgccccttctttcttaagacccaaagctaatatatgtggttaagtcacgtcacctcaaattaccatagccattagatgaaatagcaacagtttagattgcagtctctacttagcttcccttccattaacagtagcccaatatacatgggcaagcccaatccactgcctaggcccaattcgcccgttcccactacactgccgagcgtttccatctacccgcgccacctgaataacggcc

SEQ ID NO: 17505 - DNA, 4267 bp, Oryza sativa
  unsure (1)..(4267): unsure at all n locations
tggaaacggcctctccctcccatgaaacctggagcagcccctcacctttaagaaatcacacgagtatacaatcttctcccaaaggtctgcttcctcctcttcttgaatcacatatatgttcattcaatttatggcctttatttctttttccatggacgctagatttatttgttcctcttgccactgaagttatcaaagaatagaaaaacagacagatggatttggttttgtcccttctttatgtttctactagcaagattgaaatttatttggtctgtatacttaaaggagtcaattcatggtatttataaggtttctactagcctgttcatggtatgtaaaccattttttcaactttgctgtacctataatttgttgtgtttctaaactcctattgcagttcgtccctacacctattgcctactatcattgtagcagcagctatgggctattactgaggtcagtacccataacattcccatccaaagcagcgactgattgggtttttccatatgattcctctatcaagaaaatatcccaatatattggtacctcatattcgttcatggtcaccggctttcaagatattattatatgatcatcctacgatatcttcttttcaagatattactaagcatttcttctgtaaaaacaccgtcaggattttcatgtatatactatcatagattgcaagtgcaaggttatgtgtgattattttaacaatgaacttaatttaggtacatatattggttcctggatctgtgcatgctatccttccttgctatatgatgtttctactttaagttcagaattgtaagctacagttttgtgattgatgtaactttattcttcggattttgttctgtctgaggtttcaatgtagtccaagaatgtaaatcacatcagccaatgtgatcaaccacaaaacagaaatgcccttgatcgccatcggcagtaatgcatataataatttgattatcccggtgctcaaaactttttctcgccaacttctagatctcagattttttccaaccccccatatggtaagtttattgatattatggtcattaatttctgtttatgctacatattgctttctccttgctttccggagtcatccgtcagatatcacattttctctttagttcattaaaattgtattaaggtacaatgttgtatcaggaataatttcagttatatatctgtttagtcagtaaaatatatatgtggtactcaagcatgaggtaaagctgaccctttcaaaacatgaaaatatttcatggaattgcactttgttttgttgttattgcatatgttctacatgttgcaggcacctactttttgtgtcatcttaacacggtgtttcatctgtagacttgctacattgctccaactccacagatcaaagttagtactttagatggcagcttaattagttttaaggcactagccctagagctaaaaaaataattacagtttaatctgcttattccacttagacatgatttataatataattcacttaaaaaactatttcctttaataatctaatctatatatgcattagattataccacaacatcaccaatcttttgcacccatgaatggtactttgatgcttcagactatcacataatatttctgtactatatgaatcatgtatttttcttattacacaaatgtacttttgatatagtttttaagtttacacatattgcacatgagtattccgcagcaacgcgcggggtatcatctagtattctaaataaaaggtgttaattatctcctgaggtcatactactcttttttttaacaggccaaattatccaataaatttagtgggttacatcccatccaagtgcactttcaagtcaacatagaaatctatttaagggcatttagttttgtgcaaatacaagcaatccggctgagtttgaaaagcaggggatcgagaagatacgtaaaacgagacgatcaattagcacatgattaattgagtattatctattttaaattttaaaaatagattaatatgattttttaaagaaacttgtctatagaatttttttgcaaaaaatacattgtttagtagtttggaaaacgtgcgcgtggaaaacgacgtgttttctcactcaatgtcccctgaacgaacgtgtccgtgtaggagggtgaagtcttactctaaaccagcggcttctttagaacaaaagaaatttgtatggttcaaatcctataataaaattcatacatgcccatttgaaacaaacgaatagccataccaaaatcatacgaaattccttatatttcctcaaatcataagaattttaaagggttttcaacgtaagatccaatctcttgaaaaatccaattgtgtctaactcccatcagatgacaagacttatctttgtctatccatgtgtttctaaattcttacgttccggaggaagctatatattttgatgcatctctatgcattcagcttttgctgttagagtgcgtagcccggcccaccaaccgtgagccgtctaggtcacattgggtctgctacagcataggcctaaccggagccacaactttaggtcttgtgtctacacaacctaaaatactagtctgatgggtaaggactgcccacaccttttaagtcgtgctgtcccatcatcaattaccgatgtgtgactaaacccaacatttgcagccttgaaaaaagtgcatatcaaccatttgcttttttttctgttctgaaataaaccaacctactccctccgtccaaaaaaactcaatctaggaggggacccctcctagtacaatgaatctgggttgagttttttttaacggagggagtatgttctgtctatagcagacttcctttttctgctctaaattttattctttttttttttttgccttttgagatattgcgtttgtcattcatgtgtatcactaaacaaatctaacctgccacgctcctgttgccggtgttcgagaaaagcaagaccacgaacatgttacctacaatagaagtagggttgtgtttagttcaacgcaaagtttagattttagtagaaattagagatgatgtaattgaaaagttgtgtgtgtataacaggttgatgtgatggaaaaggactgaagtttggatccaaactttagatttaaacacagcctactacgaggacttgtgcaagaaaatgtttctgaggtatttgtcacatgtcagtaacttggacttgtgcatttcgaggtatttgtcgctgagaaacttgttacatctgttcccttgcaagaccaagctgttaagtctagtgccacaatatacggctgtcaggcaaagcagttcacaagtaaaggctgtgattttcatcatgcagttgcgtagttgcgtcttgcgtcagacaaaaaaaggctgtgattttcatcatgcagtgtactggtctgctttaaaccaacaacatgtgtatatgtaaaaaatcagttactattggaacttcgtcgatattagagtcatgtagcgaatctacttactattaaagtaaccgctgagataggactcttaacacaacgaattagataggtcctcccagtacgtagtacataacaaatccaaacaagaagttgtctagattcattgtattagaaatcttatctcaagctcggttgctttattttggatgataagggtaataactttcatatggacagtgacagttcacgcatgggatgcttaacaagttgaacctactgttgtactctaaagcctaaaaggcagtagctttttctaaaattgttgtacggagggggacttctgcactacaatagaaagttgttatagctaaaaaaggcaaaacacaatcgagttcactgatgcacgttaatgataaagatttagttagtggtgtactgatctaatgcacatcaatgataagatttagttagtggtgtactgtatttcccgggtttggtttggttacataacatgtgcttaagttgctgtcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17506 - DNA, 633 bp, Oryza sativa
ccaaatcagtggttagtcttcaaagtagggtaaaaaacgcaatcgccctatcatataaagtcacccgattatctccaactagggcttttctaaaagagacatcaagtagtacgcttgtgaacatattggccaacacgacatttttcttgctagcaagattatacaacgaggtaaataacttatcaaaagaaatgtctcccaaaacctcaaaattgagttccattatgaatcacaaaagatccatgtgagagaaagagacgatcgacatggatgatccctccaagcagaggcgttggcatagtacagagaacaaatcggagggaaggacgagacaacatggtgaggggttgagaactatacatgcttatgattgtggcaatggtgagtaaataaattgatttcagctctacaatgtggtattttttcttcacaaaagccagattctacttctcatcggtcttcacaaaccaatgtagtgacacgtgccaaaagcgagatgaaaagatagcttgtgtcttttgctgggggaaggcagaactgaaccatgctatacaccatacattgacctatcaatcactttcggacattgtttggataataggattggaaaatgatttcccacccatcaaaagg

SEQ ID NO: 17507 - DNA, 1139 bp, Oryza sativa
ctacgttaattagaggctatcacgttacaatagttaagacaatacggtatctaatcattaatataccaaaatactttcttactagtcatcttttctttattagactcaatgcaacaaagagagaccgctaataaagaccattgtacatgccctaaagcacaccatacaagtagtcacatcgtcaaccactatcaattattatctattattatctagagtattttaaagcatatgcaagtatgccacatcatgacccactagcaattattatctagaacattttaaatatcatgcaaacatgatatatcatttacaatttgttgtatttttagaacttaatatgcgtcaaattattatctctacgtcattttcatattatttaaacatacacatctatcatttctataatgtataacatgcatttattcacatatcccgctgcaaagcgttgggtatcaactagtaaatcatacaaagagaaaccacgtagaagtcagaataatagtgtggaatttattttttgaaagttggaaggcctttttatatatcctgcactagtagtacaaatctgagttcacgacaacttaaataatgaccacatccccgcaacgttattacaaagaataccatacccaactccgaaaatttaatgatatttgcctatatacttatgtgacaatttgagatgatgtcattgactagtatatattggaaaagaaattaatttatgatattgttagtgatacacaaacaaaatatatcgtggcatcctacactagaagggataccatcatcttaatcaggcggtaagccccatctcaatcgagcacggcgtccgtcacaggctagaagtcacagatgttcatctgtgacgggcaataaatttacctgagaagaacttcctgatcggttacccatcttaaaattgcttcaggccaagcacgcttaacaccaaagttctttggagatcggcttccggaaaagtagttgtaacttgttggtatgagtattctattaatcctattaagccctaggccaacatgtcaaattggggttattaaatgatttcaaatggaaaagtcaccaaaaccaaagttgtagaactcatcgaggtgcaaaatttttattttggtcatttc

SEQ ID NO: 17508 - DNA, 1534 bp, Oryza sativa
gtacttaggaaaattaaatataccgagaaaattccttgagctccctcaagtgaagaagttgcagaaggttaaaatccagccttgcaagttggagcacagagggattgcatgcttgctcttgattgtattctgctatataattaagcgcctctatcctcttcaaggtccgtggtaaaggtattcgaagggcccgtgttacttgttgagataatggtgacgacttgagatttcttgctattattgtttcgagttgatgccttgagagcaaaatagcgtcttccaattccacctcgccatgaattaataggtgagctgcattgtataagctcaacatgcccatgggatcatctattacttcagcgttgaatctcccatctgggcctttaaacttgttgaactcatctgcaaggaatcatgcgggatctttttatcacaagaatacaaaatcatcgatttcaatccaattcttttacatgttgaaaaaaaatgacccattgcatccagcctctccacttcatgagatacaaattaatttagagttaatgccaattatatatgttaggttaatttgcagtttacacacatactatacctggagaaacccatagcccatgctgccgaagcaaacggaatcgaagcgcgacatcatggaggctggagctgttgaattcagcaccatgaatgtcgcttaaagcaacggcaatacgtctctcgaagtgatggtctattcccaaatgttggagcacatccacaagtttcaatttttcctccacatccttgcaagtttcaaatagcaaagttacctcctccttcaattgatcagcctatccctcatccattcctccgacttctgcacacacactgactattattgactaacacacaaggggatcaaatcatatgaatttctagcatatttttttatgagggaaaagaagtccattgtactctcccgaactatttcactaaagtagttaaccccccttaactatttttttatcattttacctcataattaaactattaaaaatggttcacttcatttatctccttttttttactctttatacgagttgtattttaagctaaaactttttagagccatagatgatatcattatcaaagctaaaatattttcaaaatgtttcatgactatttgcttggattttaaatcttgatgtttaaataagtcttaagtgcttcttacctctctattaaactgtaagaaaaatcgaaaaaaaagttgagatgtatgttttaatgcatctgtcatcctaccagaattttagtgaaaaatgtcttatatatgtagagggaaacataaaggagaaatagtgttaaagcgtaaagtgaaatttttcaatagtttggggtgggaaacgagtaaaaaaatagtttagaggattaagtgttccgacgaaatagtttaatggattttttttcttcctacaacatactacttagttaattgtcaatcccgacgtatgtataattaatcatatccttggtaggatacagtaaatgaatataacac

SEQ ID NO: 17509 - DNA, 47812 bp, Oryza sativa
actgttccaatccaaggccacttggaccctgccttctccagtcgtatctggcgcaggtggcgatccttgatgatgatgaatcggtgacaaccttgtggagatttgcagtttgcagatttgcagatttgtgatgatgatgatgatgaatgtgagcttgagtaagttgagtttgcagagcagcatagcatacggccatggcagctgcatactccactatgcacaagttcaatgcatgcatttacaaactcctcgtaccccctgtgagtgtgacagaagaagagagaaaaaaaggatgccatcttgcattcttgcctcttgtcctggtccaggtccaggtgcagtgttccatcagatttaagacaatttgttaccattatcatactagatgacatatcattaatttcatgaaattactccaagcagatgcaactcgtagtatggccttgtttagttggagaaaatttttggctttgattatcatatcggatatacggacacacatttgaagtattaaacatagtgtaataacaaaacaaattatagattccaccaggaaactacgaaacgaatttattaagcctaattaatatgtcattagcaaatatttacggtagcaccacattgtcaaatcatggtgcaattagacttaaacgattcgtctcacaatttacacattcgatgtgatggttgaaaagtttttgtcttgggacctaaagcagtcctatgtatactaagtgatgttcacttgtttgttagccatcaccaaaagaacatttacggcagttgaaccagcttcagaatctctgcagttaaatatttaattttataaatatttcttcaaactaaatattttaaacattattaatagtcaaggttgtactccctccatttttaataattgatagctataatttgtttccatttaaacttggaccactagatacaatttaacaacgaaatgagcaaaaaatatttttatatttagggtaataacatggctttatatctagtttttgtaaatattagaagaagaagacaagtggtcttagtttgaaagtgaatattccaaaaaaaacaattttataaaaatggatcttttaaccttaatcttattcaaaacaacaatagttattgtcgattctagaaatcgacaccgagaaaaagggtagcatatgagatctaaagtggatgagtacaaagacaaagatttcgacatattcagaccttctcgatgagaaataatacattatttttattttggggattgtatccaccggatgttgtattggtctgataatcttggtgttcctatgccctcaggggactccctccctaggttcgggggcaaggttacaaaggggaaaacctagtcagacacgatatggattttcttattcagttattcaattgcataagactaatactacggactatgccttaaaacaacttttaacactcaagacttatcctaaaatataataacttctccaccaacattctgttccaaccaatcaccactatccatcattcgctttttccacctacctccatttcttaaccaatcacgacctctccctatttaattctacctactttcttaaaaatcatgtctaactctaaaacttcttatattctgggacggatgtagtaatatacaaatctggtccacctcctaccttcagtcggataagctgtccgtgtagatatatattacccaaaatctccacagctatgtaacccgagggagaactagcatacagctgcgtgtgttgtctcgtcatctaggtggtgtttggttgcaaggatgggatgggacgaacccactttgaggagtatttggtttatgggttagtgggttgggttggtccctaaagaggaatattcctctcaaaatctaggaccaagccatccggtaaaatcaaccggacgagctcgtcctacctagacggagtacacgacgtcagcttgtctctacatccgctggcgctcatccgtgctgtctgccacctccgcaactgccgacgcctctctgcaagcggctgccacctctcctccacgaccctccgccacctctcctccacgagcggtcgacgaccctccgcgacccactgctgccgaccctccgcgacatgttgccgcttctcctctgcgagaggccaacgatcctccgcgacccgtcgtcaccttgtctccgccgcctctcctccgcgagcggccgcctcgcctctcctccacgactggtcatctgccttctcgctcgtccgcccgtctgcctgttggtcgccaccactcctccttccgcctgctcgctcgtgcgctcgtcgagtcatcggccacgccgtccctcctccgcttgctcgctcgccgagttgctggccgcaccgctcccaccagcttgccgccgggatcgaacgtgggttgacggtagccacaaatggcgtccatcccatacctccctcatcctttctaccaaacaaagaactgggatggtctcatcctatgaaccaaacatgcgagtagaatcatcccatcctaaaaatcagggatggtttcatcccaccccatctaatcccagaaccaaacaagtgttgttcttggctttgatgatgtgccgattaattttccaacgactttcggtactccaaatactccatcaatgcactggcacgccatatcgggggtgtttagatccaggggtgtaaagttttggcgtgtcacatcgggtattatatagggtgtcgtatggggtgctcggacactaataaaaaaactaattacagaatccattagtaaaccgcgagacgaatttattaagcctaattaatccgtcattagcatatgtttactgtagcaccacattgtcaaatcatgaagcaattaggcttaaaatattcgtctcgcaaattaatcgcaatctatgcaattagttatttttttagcctatatttaatacttcatgcaggtattaaaatgttcgatgtgtcagggtaaaaaattttgggtgggatataaacagggccaaagccaaagtctgaactttcgaaatcttctctcctgcatctgcacaaatgtgacagtttttaattatacatgctttgactatgactggtactagccgggagaagaaaggagaagagaagatgagagcaagaactgaactgttccaatccaaggccacttggaccctgccttctccagtcgtatctggcgcaggtggcgatccttgatgatgatgaatcggtgacaaccttgtggagatttgcagtttgcagatttgcagatttgtgatgatgatgatgatgaatgtgagcttgagtaagttgagtttgcagagcagcatagcatacggccatggcagctgcatactccactatgcacaagttcaatgcatgcatttacaaactcctcgtaccccctgtgagtgtgacagaagaagagggaaaaaacaaggatgcaatcttgcattcttgcttcttgtccttgtccaggtccaggtccaggtgcagtgatccatcagatttaagacattttgttaccattatcatactagatgccataccattgttttcatgaaattactccaagcagatgcaactagtactagactactagtatgtataccaagtgatgttcacttgttcgtcagccatctccaacaacatttacggcagttgaaccagcttcagaatcactactcctacctgcagtagatgccatttcagatagattggcaatcaattaagatggccttttggccgctcaagaaactgtgtactaccaatgaattgaatgcagatggaatttctcgcaagatcttcagggatatgttcagtctgcatcggaggggagctgatcctgcacagtttctcaattcttggcatattagtagaagtagattactagcagcggcatcgacgatcaatgcctttgttggcttttttttttaatacgcaaggagcgcatctttgtattaagaaggaataaatatatgtacaaagcgggaaaaaaaacaaagcgaaggggacagggtacaggaggagaaccaagaaataaaagcctaatctccaactaaattttgcgacccttctccactaacatgagctaccaaaacggggattgcagctctagctagccgccacagctccgcttcacccgtcataacccttgcaacctccgcccaagttctgctcttctggttgaagactcgattgtttctttccttccagatcgtccatgcaaccaacgtcacgatggtgtcgaaaccccggcaatgttccttgaccatcttcttgcgacagtcgcacaaccatgagaggaaagagtgttcattgagcggtaagcactctgaatgcccgatagctctgagcgcaacccaccacagttgccacgactccgggcatgcgaccaagagatgatcaattgtctcttcgcattgatcacacaaaacacatcgatccgggtgcgacaaaccacgactccggagacggtctgctgtccagcaacggttaagagctacttcctccgtttcataatgtaagtcattctagcatttctcacattcatattgatgttaatgaatatatatatatatatatatatatatatgtctagattcattaacatcaatatgaatgtggaaaatgctagaatgacttacattgtgaaacggagggagtaccaaccaaaggaagtagcgacagcgagggggtgccaaagattgccaaattagcttgtgctggagacgagttcttccaaaaaagagaacacgagaagccgagcgggaagagtattctcctgaggtctcccaccgccaagatagagagtccggctcttcggaaagccgcactgaccgaaggcaatcccaaagcttgaaatactccaggatcgcttgaatacccaacgccgaactgatgtcctggatccatcttctgttagtcattgcctcggccaccgtgcgtcgattccggagatgggcagggattgcagcatagacagccggcgctagcaaccgaatggaggaaccctgcagccagcaatcctcccagaacagcaccgaattcccatcccctaccaagcataccatagaaatcgatactagattgcgctccttctgcgagaccagaatactaagcccttgccacggcttttccggtgaagttctctgctgccagagccatcgcgacctcaaggcgattcccaacctctctagatcaggaatccccaaaccaccatactccttgggcgagcaaactcgagcccatgcgacccgacagacgccgccgtttgcataagctttgccagcccaaagaaagctgtggcggatcttgtcagcctttgttggcttttcaccatctgctcatgaactggtcaagaagcgagcactggttggcacatcatctctgaactctctgaatcttctctcccgcataatcgaaacatcaaataattgagttcaccctaacctcaaaaggcttaaaaaggtggtctgaccgtaaaactgaagactgcttcgataacgtttctgtagaaactcgttttgtccaaaaccaaccgttagatcaagtttactttattagaataaattagataaactaagaagcaacttcaccagatgaatttgttcataatgtgcaaccacaacacccctcatgagtttcttataagaccataatacaaagagatccaaactctcgaatttctcgattgtggcttaccctcaggggttaacctctctcgctatttatatccatggatgtgatgtccaaagtcacgaatttaactagtactactaggaatcctaatcacaaagttgggagtgcaccagcaggaagagaagcataagcaatgagtcatctgtattctgtcttgtaaaagaaaatgataagtgtgatatctgagaaactggtttcataatcgaacctgcccacatatttcacctacgctactgcagtttttggcaatcttgcacttttctccttctgtcactgaattgtgggtccttagcctcacgtgtcaatgagacagacaagaagtgcaaataaaggattaagggtgtgtttgagaagaaggggattgaggagattgagaagatacgcaaaacgaggtgagccattagctcatgattaattgagtattaattattttaaattttaaaaatggattaatatgatttttttaaagcaactttcctatagaaaatttttacaaaaaatacaccgtttagtagtttggaaagcgtgcgtgcggaaaacgaggtgctctccctcaatgtcctccaaacgaacgctgcctaaattgttgtagtgtaaaacaaggaaattcttcagcatgttgaaattttggttgatgtttgtgctattggctgttaatgtttctttttgaagatggaaagtacaacgcaccatcaagaagagaagcattagtatttggagacattttgggtttcctatcttgtaaataatcgatatatagtctcgaagaggtcgttgcaaattgtttcgatatatataaactgcctatcgtttcttagagctaggaccgagcacagtcctactcctagcaattaacataactacgaattttaccaactcttcttttaccataaaaagaactgaggcggcaaagacgctctgtacaatcttcgtacccattcctttgtaaaacccgtgcaatccttcataccggatcatctttatgatcgcgtcaatcgtacctggagaaaacaggcagtcagcattatattacttgcacaatgagtagcaaatattccctccgtcccaaaatatctatatccgtagctaaaagtagctacattttataacggaagaggtatagctaaatgtctgacacacaagacataggagcagcgcggaaaaacaatgatcccaacaaatatggaaatgaaacagtgttttctgctagtaagttaaaatggtaggaaatgatttacctgtgtatctggacatcacattcctgccaatttcttgttttgcttgcaacctagactgcattagttcaatacaacaatcaggatagcacaaacaaacatgacactattttgataatgtaaaccattcatacactcaacccagatagactggcattgcctgcaactacttgcacccgtggcaggtctagatattgtcgttgttgagtaaagtctcacaagattaaattatattctgaaggagagcaaaaatgtggtgcagcatattcatggggttgttgtatgcaacaatgcaggacagctattagtactgtagttgttttgctgaaagcatttgttttaacaacatcagagaaacagagtagagaaatggaaaagaaatctctagcatcgatgtggacttccgggtttctattcaggcctattttggcaatcctgagtggcccatcactggctgatctgacaagccagtaattcctcatttcttaaaaaaaattgagcttaaacagatgtacaagtgagaaatgcatcagttttaacactttgcacaagataagatgatttacatgtatataatattaagtttaccttaaccactagcaatgggtatgtcacaacagtagctccgagctttgctattgcacctaataagaatacctgctcaaagagaaaatggtaaggataggacatataaatgcatcaaaggaaatttcaaagagcttaagatgttatttagctctggatctgaagaataaagaaacaaatatatggtctgtgctatggacataattaaacaaagggaagtaataatgatgaatattctttagtgcattcatagaatcataaattgactgcatagctaattgtagtatgaaattactctgtcctggcgctttatgtggccaaattatctggtttgctcaaataaccgtagcatgcatctttaaatataataatttatggagtacaagaattatagacgaatgatttgaaggtaattatagcaatcccaacgatgattctttttacattgaaccaaatattattgatcatgatcaatgtagctttatttgcatcaaagcggataaacggtgaacaggtttataggattgaaagatacaatacaaatttctagaaataaaaaagaaacatgaagttcctaggaaggcagcacatgcaaatagctgatgccatctaactgttaaaaactcatatatccacagacacagatacatgcaaatttctaatgcagagctaaatcgaaaaaacaaatccatacctccatagcagtaaggttcttttttgggagttcctttccagatctctttgaccggagacgctttgccaatgtttcatagatcataaattgaattgatggattacatacctaacaatttaaatggttcattctctatagtcactcttacataaccactaatttcagctcaaatgttttgagaaacataaactaaccataattagtgttggaataagtcctttccagaatcctcttatgcctgattcacggtagacctcccggacctacatactactgataaaagtaagaaaaatcatgtctgaccagtgacaaatacatttgattagttaaaagcaagtttgtagagcccaaaacttgaaatgcaattgcagctactattcattgtagttttttgcaaacagaattttaaaatctgtaagtgcagcaattagttctagaaggaagaaagcaattcgataaaaaaatcaagaattcttgtactatctaaatagtacaagtgagaaatctatctaaatatctagatgtggtcacaactctcaacaaaaaatagagaggagcagggttgggtgtgggggattcacgtactatcttattttatgtgctgcataattgttaagaaatggattatatatacaaaataatgtatagcaacttaaggaatgtgagtgtgctcaattactcaccgcttgaattgtcccatatggacgaggcttttcagaatcaagtttatacaacctgtccttaagaattgagacctctattgaattggccctagcaacatccttcagcaaaagctcctttttagactccatgatcttcttttctgcttgtgtatgtgtctgaaaaatggaataaagttaatttccaaactgatgataaaaaaacttacagatattttgaataatattagaatgttccaatttaatagtagttgcatagttaatacaagcttggttacaaccgaccatggtcttccaactaatttcacaaaggatgtcatggaccaataatccttgtgattcggcgcctcctgaagtttcatggatcattgtcatcataaaaacaaagctaatgcttggagtcaggcaggtacaaagaaggtaagtatgctaccagaaagtgggggcaaaagcaacagtaattaaattcaatgggtgcaataccaatgttaatattctaacatattagaagatttcttctctttttttgaattttgacaggacatacagtatagtaactcattaaccccatcatcgacgatcttttttggtgttatatgtcattttaaaatatagactgttaaacaaaatttacctgcatacgagtcacgagaacccatattggattggtaagaagaacattgattgacctgcagcagagaaaagtgtccatcagaatgcctgaggatcaatgttgcaatattacattcaaagtgcaatcttcgccatactggtgactctatttcacagcgctatggttttccagaacaaaaaccatcttaactggaaaggattacacgcttcaaattcaaagttaatcaccgccttcagtcagttctaaggaggcaaggccatacgaacaatcatggcaaccatacattaccatgaattacattttcttatctccctttccgaaacaatttaaggtttcaacgctctgttagcctttgcaagctcagtcaaattcatcagaactctattacaattcgtttgacaggatactatggagatgccctattggaccactaccaactgataatgtcccggttgtccagactgaattgttcattccagcattaaatggagacaagcattcgatttgttttgggtgaatgttggggctccaggttgacttgacatataaatgatgtttagcaatttcagtgcgagagtagatggcttacccagcaacagctgcaataccaagccaggagaacatcccaacagtaccatcccctagacccttcttaccgcgagcaactgctagatcttccaccttgtttttgagaatctggtaaaagtagtaatagattccctacaaccacaaacaggatgaaccataaatcctgaataccaccgtacagactcatccaagtatcatcacattgacaaacagggaaatacaattgttacagaaaaaaatgatgtgagtagcaccaaattactaaaccagtggaatttacctgtgaagcagcggtgccaataagagagggtttaaggccgctatacaaccctccccatccttctgtttggaacagctgcagtaactcgattccacacttggccattataacattagaggaggcaattccaaataaactaaaagtccaggaggaactacctggagcatctggaagagggtggaagtattggcgatggctgcgccattggccttcttcttttttgctgacctctctgtctgctgccgggtgttcacctgctcaggccatcatcatgatgaggaaggattgagcagactataaaggaacagcagagctacataagatggtagggggagaatgattgtacagtctggagggggtaggtgatgatctgggcgatgatgccaccaccggcaccagccaatccattcaccgccgcactcgacatgcgccaacctgaaaaacccatgcgcaatcagaaagcaacgcaatgaattcctataagctacttgtttggtggagcagcatgaggaagacggacgtgtgcgttgatgcagaggcaatggacacatggtgccgaggcaaggtccgcacgcgccatgcagaggccactaggtattgccactaagaagctactaaaatacatttcataatgtaaaagcctttcctttcgcattcatctaatgatgtcaatttgaatcaaattagcaactaacaattcaattggactattttgatcaacgaaataacccaatatcgttatttgctttgtttcagccactggtagttgatcatgaagaccggcctagagaaagccatacttggcctatgaggttgtgagttgtgactccttacgtcgttgcgagagatacataggtagtgtttggtttgaaagcaagcttggatgggttttaggcatccatgtttttgggggatgatccaagttgcctgtctggttggatggattggatgaaccgattttttgtttgggatacatgttggatgggattggacgacaactaaaaagtttacaaatgcgaaaggaggaggctctattaagtaggggtgaaaacggtacggaaactttccggattccgggcctgttttcggaaacggaatcagccggtcggaatttctcggaaacagaatcgaaaacggaaacattttctcggaaacggaatcgaatatgataatagcagtttctgtcggaactcggaatcggtcggaaaaattccggaaaaaatatcggaatttccgaagttaaaaaggcccatagaatcaatagtctataactcgtccccaagttttaagcccaacccaaatcgcggcatctacccaaatagtggctaaccctagaggagagagacagccacacggcatcgcaactttgcgagaccgcgagccggcggcggagcatcgcgctccgcccaccgctagcgcccaccgcccggcgcccgcgccaccgctggtccgccatcctcggctcctcgcaacctcacccccaccgtcttcgccgtctcgtaccgccgccatctcgcgacgctgtcccgccgtttcgcagcgccgtctcgcggccgcggcgccgtcccgccgtttcaccgccgctaccaccactgacgacgacgccacagccacaccaaggagccgacgacgcctcgcctcgcagtcgcagcagccagcagcccagcggcagtagccaacagcccagcggcagcagccagcagcccagctacgagccgacgagcctaaaccattgatttgatttcttttgtgctgtagatttatgatggaatcatcaaatgcaagtagctgttttgtgattgatccaagtactgtactgatggattgatgtgtgctgctgttgtgtgatgaccgaaacaattgatgaactatgtactgatgatggagtgatagctcatagcagattagcagtagctcatagcagattagcactatagcactgaataatagtgtatactatatatcttatacaagggtgttttgctgtaattttttttaaatatttgttatgcaaattatatgaagttatagaagaatatattttgctgttgagacgatttcatataattgtgttttatgatgaattgttgactgttgagacttgagaattggacttgacaaaagtttgaagctcagtttgaggggttgttgtattccgataaattttcgttaccgtatccgcgccggttcgtttttgctccgttttcggtttcgataatattcgtttccgttttcgtttccggggtttccgattccgaaaaaaatatgaaaacgaaaacgataaaggttgtttccgtccgtttccgtaccgttttcacccctactattaagtccaagcatgtttacacaagttcaatcattcttacatattttagtgtttagataattcccatcctatccctttcattcattgacctatttctaatggcttgcctcatcgcatccttttcctttttctagacgcatatgccctgcagccctataatacaaaaaagcttggtcctcttgtccatctataacatagcgaggcaaacaagaacacactacagtgtcatacaacatagcgggccatcgacaccgtctccaatgcacatgtttcatccttattttttttcaaactacatatttaaaggaaatattaaaagtataaccatatgaacgtgttttttcacgacaaatctatcaataattcaatatcgttttcctgtcaaatcctaatattttttagtttgtttaattagttaattaaccagttattaatatcttcgcatttccattccaggaacgaacgacaacttcacaagtaaataaataagcagttcagatttatgtaagggcacaaataccaaatagatcatgtacaaattcacgagcatgaaaaatcatcactaataaacaacatcgctccatgaagactcgatcctcacctgcccgaggttgcggtgcgtggaaggaggagggacgacgcggccgcccgccgcccgccgccggctgtgagcgccgccctcgccgcgcctcctgatttcgtggataaggaggagggaagtgagtgaagggatgaacgggagatgtggagtggaaattttcgacagattaaaaatgtttttctgactttcggtttatttaatctgttacgtgaagcctcggttttcagaaaatatcagttctgtaagaaaaagccgaattaaccggaccggtttttcagacctgttttttttttcttcacatcaaaattgaaagtttgattgaaattggaacgatatgataggaaagttagaagtttatatgtgtaaaaaaaagttttaatggaacggaaaagtcggatgtttggtgaaaaattttgcaactgaacagggccagaagcggagcacctgcacgaggcgaggacagaggaatggccggaggtgcgcctgcttgcaccgccgatgtggtcgccgccgcagttcgctgggcattgggttgggttgggacacgtaaaagtcacttcggtgtctcctccacaagccctaatgtaggtgagaaatttgggattataccatcccacagttcgtccaaatgcgtttccctccggtttcataattatttattttatggtttgaacatcaatacggtcttcgaaatatatatatatatagttttcgcactaaacgcaccgtttagcagtttaaaaagcgtgtcacgaaaattttaatcttcatcaaactcttattggagaaaagaacgggacctagatactacacgtcagagtgcttaataactaggataaaatacaatttgtgcttgcttgcgccgagctcatggaggagggagggcgatcaagctcgaggcgacataggtgaatggtgagcaactgagcacagggcaggcagcagggttcacaattatggtctaactcgatttgcaaaatctttctgaaccggggcaaaaacacaaaccacacggttattgggtcaagctaaaaaaaacaaactgaatttaaaaatttggacaaaatttatcaggatcttatcggtttttgtggtttatcaatgtattccataaaatccgatgatattgctcgtgagcggattatagttgagttgggtaattcgtatgttttataaatatagtagcatagataagtaagagagaaattagactaaacataaactcaatcgtataaaaagaactactccctatatctagatatagatgtatttaacattgaaatattgtgaatattcctcaccttagccaatcaaactatccgtgtatttaacattgaaatattgtcaatattcctcaccttagccaatcaaactatccttgtatttaacattgaaatattgtcaatattcctcaccttagccaatcaaactatcctttatttaaattgtatctgaaccttaatccctccaaaaaaaaacctattatttaaattgtatctgaaccttaatccctccaaaaaaaacctattatattttggggtatatgtatcattcactcctccagccatgaatatagccaaaaccagccatgaacatagccaaaccaatctcaacgaacagtactgcacaacggcgtggctgcatatgcaattgtttggttccacttccactcagacgtaatcaagcaacatcagacaggagacgaggacgttgccgcatatacaattgaaccattgcgcacagatggcagaacaatagaaatggaattaacagagcagcttccgagctccgtacaagaacacagttagcagtgtatttatttggacaaaatgcactagttgaccaaacatttataatgttttaagtgcttcaaacaaccgctagttccagacacattgaagtgattgctcgacacatacgaaaccgagttcacaaagcagcataagagtatacatgcgataacaacaggaaacaaatgaagttacgctcgtactagattctacatatcgtttattctagcagtgttctactggtaattcctcccttgtccgtccctctcataagccggcacaccggcattgtagttatcgccgccttgctggtagctagggttgcctccttggccatggtagcctggtgcatagccagggttgccaccttggtaaggaggcgggttgccgccctggtaacctggccctcctccctggtatccagggttgttgccttggtaagcagatggtgggggtgggggtggaccttggtagccctggttgctaccttgatagccagggggtccaccttggtagccaggcgcaccgccctgctgatagtttgtatagccttgcggatttggtgcatggggctggtagtttggaggacctgcatttggtggtggaggtggaggaacattaccctgagcatggtgcatcggaggagcatcacgaggcgggactgggccctgacctggtgggggagggctgttgaatccctggccaggaggcacatctctgttctggaagttctgcatgttctcccttctcctctcaaaattccttgacctgtcaaagtttctaggcctatcattgcgccggcttctttcattggcacgcgcattgtttctcacccactcctcgtggtacttagggtcataaggaacggcttccccatttataaaaggttctcctgcaataaaagacaaggtgtcaaatacacaccaaatgctcatagatcacatctctatgattccatcacatggataaagacattacaaaacagataaaaataactatgaactcataaaactctgctagatataattatgaactaagcaacaaacagcacactaaaaataacatatgtattcaaattctcaaccacagaagatggtaactgccacggacagtccgcaatcactaccactaccatgacatatatacaactacaaacagaaggtccaagttaccatttactccctcaaaactagataactaaatagatattactgactcaagtttataaagtttgcttgaactagttgatttcactgcgatgactactgataatcaagcaatccaacttatcagatggtctagggaagaaatagcaaactaaatttcaagatatcctagtactaggagatttcacaggatacagactccaaataaaaagttcagtggtatgctagaatacaaggtgacaccagagcaatcagcagaagagttccatggtaaaacatatacttgacgcagaaaaaacataacctctataaaacaagagccagaaattatcagttcaaagcattgcacagggacattagaattaatcagtttgatcataatatggcatcatacacatagagagcaattatcacagaggatctatataactaacacggaaatgatataaaaacagttcagaaaagaaagtgatgatatgtaattcaataggaagagaatgaacatttacctccgtagtccttatttctgacatccaggtatgagtctggaagaacccagcggaccttgggcaactctggcaaaataatttaatagcacagcgttaaagcaagaacacaagtgacccccataaaacatcccctacaaagaatttcatacaaccataaatacctttgagtttgtaggagagttcctcagatacaagagctccaaaagcaaagtaatgccgagttgacactgagtagatcttatgccttgcttcttcctcactggaagaaaggacacatttggttaaaaagaattatgagcaatttatataatggccaatacccagggcatatatcaagaaaataaatgaataaactaagcaaataaattgttatacagtaggacttacatgatgcgataattaaagagaaaccagaaaaactagcacatgctaccatgaagatggacgcctaaatatgtcagtggttgacagaattaatagaacacaatcaattttcaaaacagggcatgaagcatgattaaaaaacatcgtgttgataacaggagggcatgacctcccttctaatttacaaatcatccccatagaaataccaatttattcccccataataactaactacatgcaacaccatgagaccagattaatatggaaaccgtagcgaatcaaaagaaaatgacaaatacatgtggaatctataaataaaatcccagtcacatttgtgaaaataaaataaaatatgcatcaacagtacagaatacactatcactgaaacaggtatttatcagccaatccaccacagatgaagttaacaaataataccatggaaaaacttcacatatcacctaactataaatatccccaaatccacttcctccgtcccatttcctcacccccaatcacgacccaatcacgaactaacagattaaatcgagtgtttccacgaaatcccacggatgcgagatgcgcgtgagagggagaagggggggaggatcgttcaagacggccatatatacctcccaaccacctgtgcgagggttttgatgtagccgtcgataatctcgtcgcgggtgggctccgggttggagggatcgccggggggcggctccacgacgaccagccagtgctcgaagtcgcacccgtcgaggaggatcgtctccttggggggccggttgctccagttcggcgacgagtcccgcagcgaggaggtcgcgggctgcgtggcgaagcacctcgccgccgccgccgccgcgcgcggggcggagggggcgagcgccgccgggaggaggctccccgcggcggaaagcgggcggaagatgcgggaggtggatgatgccgccgccgcggggaacctggagaggaggaggaagccccacgcggacgccatgggggaaaaccctagattgggaatgaggggggctgagggtttaagcctaatccgggcaatcggctcccatttttatagccgcatattatatattcctcgggttgataatatttttagttttggattagggataatttccaaaacatttgctttacacacttttcggttaattaatcactctactatttagagaatgagagatgttcgaaaaggatttattaaagatgttcaaaaagaatttattaagtgaattatgtatgatgatgatttaatatgtttgtatttaaatctcttaaatttacaatctaataaattatagaatcatagataatataacatgctttgcctctagaccgcctccggcagcatgccccgccggaccttgtcggtggcggcgtggaggtaggtgatcccatcagcgtcggcggggcggagcccgatgttctcccagatcgagatctagccgcgcggccggaagcgggggtcggccagcgtggggtcccgcgggtcggcggtggatgcgctccagcgggagcacacggcgtggaacgctttgtactccctcacgccggcggcgagcagccgctccgcgatgtggttagcgacctcgtcgtggagcgacgtccagtcccgctcctccacctccacgacggccgccgcttcccgccgccaccgaggcaacacgcacccgccttgcgcttgccttgtacgttcatcccccctcttcctccgctgtcatcgcctcccgccccgccggaacaaaacaagggtttatatagcaactccggggaacccgcctccgatccaacactcgatgcaactcaatcgatctccgaatccgattcataatacaacagtgagcttggaggacaagggtgtgtaggaggagggaaaggcggtggtcgccaatctcgccgctcgccggggtctaccacaaccggcggccatggatgacggcgtggtagggaatgaagtggagacgagagagtgctggactggtgtattatatgtttttagttttggactatgaataattttcaaaatatttgctttattacaccttgttcagttaatccctctcacaaaagaattaagagatatttcaaaatgatttattccacacctattatagtgtggaattatgctcctcaatcttcttcaatccctctagtttgattgttaactgaacaagactttagaaatatgaaccataggatataggcatagattaatcttaaaaagtaatataataaaattatatatttttgataattctatatagaaaattatataatggttaaagttgctttttaaaaacatgttattgtctgaaataacgagtattattaagagagtaatctttttttatggaaatatctctaccaaataatagtccttttagcgaaaataagtgctcctaattttagggatagagtacccacagatgttggtcaccttactaatcttgagaaaattgcaaaattttcaaatgaatattttgctgataataatccatatttgatgctttggtttatatttaactccaagagacaaattattctgttcagaataagcatcacacaaaaatcggccccttacaccattaagtcaagtcaggcatgggctttggcccagacaagtcaagaaaacggtccactagtctctggcccaaatgaagaaaataccgcagctcgtttcagtaggaataagttcatctgaggcccttaacttgttaacggatccgattttcatccttcaaccgaaaaaccaaatccaacgagtccttctactgttaaaatcggtgcaaaataagtctcaaagcggtttggacggcggtttcagatgacgtggcacctacatgactaaactcagtcttcatttgacgtgacacatgaatcaaaatttaacaattagaaaaagaaaacaaaataaagtctcacccgcttctgtaacagtagccatcatgttgctgatgctgtgttgcaagatcaaagggatttatgacttgtgaggaagaaaagagtaagttcgtcgtctctctcaagggcatgataatgagatggtgttcacctatgatcctcagtttaaaattatgagtactagcttattctgaatttgcatcgtatgaatatagtaattcacaagaattttcttaaaatatcttgcatttagcagatgatctagagtattgtcttgtcttgcagaagaaatattactactactacttatggctagtgcagatgaggaacttgtgatccaagttagcaatggtcgggagtgaagctaatcattctgttttatacttcctactctctcttaagacccaagggattactgtgctccagatctgcatttgcgtgctgcaatacaatgtgcagccagcagcagcagcagccttcagcacatggagttcagtagtactgtacttcatgctcatggccctcagctgctgccaaacaaacagctgaaggagcaagcaacttagaatgaaagctaaccctggtttaccatcatcataatcatcatcatcaagagcttgcacgcatgcattgcatggacatgtgccatgcatgtgaccaagcaaagaccttaatcttctcctggaaacaagtccctccaaaagtgagacacatcacatcaatgttatcaagcaatgcaacaatgttttgttaccctgatcaaacaatgcaacaattaaagctaacatctctgcatttaggacaggaatcacaggcaggatgtttcagtgctaatctctgaaaacttctgaaactttagaccagtgggagacctgctggattgaaaggagaatcactgaataggtcagcagctttctgaccagtaaaaggagtgagaatgttcaggctttggccaaaactaagatgagaaagaaagctaatttaaggccacttgcacacaaatcaacttatcaaggcaaaagaaaccctgcctaacctgccaaacatactgtcaaagttgagtaatttatactcaatacatgttcagaaaataacctactactaattgaaaaataattacctctagctttgagaagtttacatgtcctgatcactaaaagtgactaggtcctaactcctaattaaccaagccgagcttgaggcggccaaagcggatgaaatcattgggcatgcagtttccggggtcctagctgcttatctggggacagaaggcatcaacccaagcaagatcatttccttttcttcaataatatttgcctactagatgctatgaccctagccatcttttcaggccaagatagtactagtaatcaactcaaagatcagtattaattaaggttggcaattgcagtgtttgcttcagttcatgggcaagggtctcaccacgcacaagtcagaggcacccgcactccaaaggcattgacaatctgccacacaaggagaaagcaacccccaagtacccaaccacaatatgatttagagatcgttcagtagcagtagcagtagtgtattaattagtcttaagctttcagaaataactccagaaaacgagcgatgaacacaccactgttcacacctgcacacacacgacatgatcgatcatgatcatggcgacatggatcgatcgatcgatcggttcatcgatatgccggtttccgggttcctaagttaacaccgggagaaatggaaatggcttgtgttagaggaaatgtaggacactctagctgattgatctgtctctgcttactgctactactcatatgattggtctgtacctactgctgatagatagctttttctggcttgctctctgcagctatctaactctaagcctcagtttaaaacaaattattgagtggattgttactacgaattatctacttgataaataaacttggtctaaacaatacagcaacacaaggttttttaagaaaatttatttttcggagcagaacaaataatccgtttcaatgttccggtaaaaaatctgaaaagataagcctaaactagcagtacctgaaactgcacttgctgtttgtttaaggaaatgggagcaatgacatcaggtgagacagacaattgtgtgagttgcaaattgcattgctctctctctcccctgagccacactgatccagctagataggtctgaaccctgaaagaaccctcaggacacactcaatgtttcatggaattcggtcgggattcgctcgaggacgatgccgactcgcgacagcaagtcgacgaatgagggtcgtggagagaaatgagattggtggggggtgttctcatcaggattcctatttctggtccagcatcacctgctctcctggtgcccagccatgtgttgtttgtggccattctgtcaacaatttgcattattgaaagatatagtgcttggaggagttgaaggggacctgttgcttgggcacttcaacttgagcctaatttctgtccccatttctcctcaagtgtaatcctgaataataaagattcgtactagtctccctctcatgcacttggtttggtttcatgtgctacttagttacatgcaccgaaacatcgtcgataattcatgaatggtggaacataggtaaattgtgcacgagagaaggtgattccacgccactaacttagagccagtaaggtccctgcgccaagaaaagcttagatgactggtttggaaaatttctgaaatagttgcatgtttatgcctaacaacgttatagagacaaggatattgttctcttaaacaggcattccccaaccatttatcttcccaaaaccgaacttgagagccatctttgatgttggaggagccaaacctgagaaaatcaggcttggacttcattagactagcccaaaagtgtgagtctcctgctttccactgagcttgagacaaaggttgtgacctcaaatatttgttccttagcatttgttgtcacacaccatctgtagtgagtagtttatgcaaccactttctaaggagagccttgttcttaattttaagatcttgaattcccaaccccccttggtctttaggacgacatatgatgtcccaccttgctagtctatatttccttttgtgtccatccccttgccaaaagaaccttgatcagaaataatcaatcttcttgatcactcctttaggtatttccaaaaaggacatcatatatattggtaggctggtaagcactgaattgattagtgttagtcgccctccaagtgataaaagtttgtctttccaacttgccaaccgtttttcaagccgttcaatcacttccttccactccaaattacgaagtctcctatgatgtataggaatgccaaggtaacggaatggaaaagaaccaacctcacattgaaaaaggttagtatattgatcatgagctgtttgggcttcaccaaagcagtaaagctcgctcttatgaaaattaatctttaagccagataattcttcgaaaacgttcaacaacattttcagattacaagctttctctagatcatgttccataaagagtacagtatcatcagcatattggaggatggacaatccaccatcaatgagatgaggcaccactccaacaagctgtcatgcattatttgctctctggatcataaccactagcatgtccagattatattatctcacgaccaagatgagtttaaatggaatctaaccactgatggcagattctcggttaaatctctttatcttgcgttggtgcagaccgatgttcccaatataaacaaaagaatctggaagatcaaagccctcctaaagattaagatcttcttatggtacttacgtcgtggagtagtcttaacaaaagataatcttattaaaaggaattggagaggaaacaagtcttgttctttctgccacaaagatgaaactattaatcatttgttctttgattgtcgttttgcccatgcagtttggtctttaatccagtttgcttcgaatattagtttacctaatagtacaactcatatgtttgggcattggataagaagacaaccacgcaatttgagatctttggtcttattaggggcaacaaccactatttggtctatttggctttgcaaaaatgatgtggtttttgaaagaaaaaacatatcttctcctttgcaggttatctttttgattacacattggctccgctcatgggctatccttcagaaggtcaatttgcggggaactatcgttgtggcttgtcaacaattggagctagtggccatggagttttctaccccggcgcatgggtggcgttctaggctacggttagagggctcctgaagttctttttgtccctgctatttggatgatgagtttatcttttgtttctttcttgttggctgtgtgcactctttgagtgcagaagccggaggtgctctcagaataattgtatcacttgatagaattttactgagattaataaagcttccattatctaaaaaaggtaaattgtgcgcgcttcctcatcgtcttatgcttttaggttgaactggttggttgtaactaagtatggtataaaagccagagcttttaagttcaaaaacctcatttttctcaccggtttaagcttttgggtaattgggttgaactggttagtgcatgaaattcgataataaaagacacgtagttatcgttgttgacgtcataggttcgaaacccgggtttgacagcgttggcaacattgcatcgtcacatagactggtagacatctagatgcaatgaaaggtaataacactgagcaagttacctcttggggggtaaaaatgatccccttttggcacaccaaaaagtcgccgaatttgattggagcaaggcaagcaattccattccacaagcctctcctcccgctggagttattccaatccaagcctgctgtatttgtcacggtaatggcgacaggggagcccggagtttttcaccctgttgcttgcacggagttgctctgtgagctatgcttggacgtcatcttccccggcatggtgcgatgctgtgacgtcaccaactcaccattctgtttaacctgctgttgttaaatactccatccgtttcaggttataagatggtttaactttggtcaaaatcaaactactttaaatttgactaagtttataaacaaatataataatatttataataccaaattagtttcattagatcaataattaaatatattcttataataaatttatcttggttgaaaatgttattattttttctataaacttagtcaaacttaaaacagtttgactttgaccaaagtcaagatatcttataacctaaaacggatgtagtatttaaatgtggctttgcggttaatattctcacttttttttgaagagaaaaatagcatgagagtgtgtctttttcattaaatatagcggaagaacaatacaatcctaagagcgaagaaatataaaaggccaagaaattatgacactatacgaggtgcgattaatattctcactcgtttcgtgtagattatgccctgctaatgctgatgaattgagaggagaaaaaagagtgtgtctgaaccaatgggcattggatgagacttcatgagacagttatttcttcctgtgcataatcacacaaagaaaaaaaatatccatttcttcagaaaattcaaagagaaaccagtacaagttacttcctctgtcccagtttactagtcgttctaggaaagagatgacaaaatatggtgttggaaaaatgaccaacgtgcccctacattaatcatttcaatgcttaaaaattaacacaaaactagtactgcgtctgttattccgatatatctgcaaccagcatggggaagaaaattaatagaagtactcataatagtggctagcctgctagctgccctacgcctaaacgaccttctttctgggacaataactctacaccccaatgacaactaaaccggaacggagggagtagttatactaggaagtcagatgctgatgcagatgaatcttaagtcagataaaatgttttttttacagtgcccttgaaatatctgccaggtgtgtgggcccaggaggccctaagattcagacattggagatgcttggttgcttggaaggagggggcaggaagcaactcggcatattaagcaacggccaaaagagtgacatgattacaattagaagcaagaaaaggcgctaatgattcctcctaatccacacgaagtaccacggaagcacgcacaacacatggcgataatcagctctgccaattaagccagttgattagctcacaaggcaatcactgacaagaacatctgcacctgtgtgcgtgtgttcctcctgtcagtcacttgcaagctgcagtttgcatagggcacatcagggtcgaatccgatgtgcaaaaacgagcaaagtgccaatcctgaagtttgcttcatgatttttatcagaaaaaatgtttttaaaatgaataaccagacaaaaatgtccctaaaaacatggaatcatatagcaatcatagaaacaatagtactcaattttttttgtgcaatggccaatgggcatataaatccaagccatcgagtcaagtgaattgcttacatggcatgattaacaattgaccataaaccctctagtctatcttaaaaccaaaataaacaattaattaaatctctgtcaagcgctacttggattttttttctccactttctgaaaaaagagggaggagaagaaaaagtttttgtatcaatcagaatttaggagacatgtttagggtgaaacaagattggatcatgtcaaatcggagaaggaatcatactatttaagcaacaatggtggcaggattggagtctgctccacgccacatggatcctataaattccccgcccttttcttctccactccactcatcatcaaactctctctctctctctctctctctctgaatctctggatctctgaaaactctgaacattccaagaactcataagttacctgtgatctgtgaagcttgagctgaagctgtgacagtgtctcactgatcgttgatcactcagcttggctgctactgtgcattcactgcgtggttagctagctaactgagcagaagagctttagcaatggcgacgccggggcagcagctgccgccggggttcaggttccacccgacggacgaggagctggtggtgcagtacctccggcggagggcgctgtgccggccgctccccgccgccgtcatcccggacgtccacgacgccaccgtgctcgacccctgggacctccccggtgcggttttcttgatccgttttggtttcgaggaggtgcggcgccattgccaagctcgaccgagcgggagactgatcgtgaactctctccttctgtgcaggcgccggcgatggtgaggcctacttcttcagcttccggcagctcgcggcggcgagcggcggcggcgggtggcggaggaggagggcggggagtgggtactggaaggcgacgggggcggagaagccggtgttcctgcgtggcttcgggtgcggcggcggcggcgacgacggcggcaagcacctcgtcggcgtcaagacgacgctgctcttcctccgcgcgaagccgccgtcgcgcacccactgggtcatgcacgagtaccgcctcgccgccgccggcgctgtcgccgtcgccgccgccggacagacaaagcgcgggaaccatgtgagtctgaattctccaattcttcagtaataacactaatagtactgatacatgtgattaagtctaatgtcattctgaatcatcattaggttttgcttcaaaggttcaaattaattaaccccagttttagttcaaacttttattagaacaaacttagcatatgtatgtgaaatttttgggtaaattaactgaagagaagtttgcagcttttgcaaaaggctttccacagcgcacggcagcatctcaatcatgcagacatgagagaatctttgcctcctttcaaagtaacttaacctgcttggctacgtggattaggacacttcactgtgtgcggccacttgtcttgcattgtgttccatcaaaaaatttaattgaacctctttgtcactcacatctcatctactagcatgcacccgtcgctgtaaatttaaacacgaattcagttcagttcagacttgagagctcaatttgatcatctggaatctgatgaatggtatcattatgtttttctttgcagagttgcatggctcagccaggagaatgggtggtgtgccggatttttctgaagaacaacaggtcatcaagaaggcgagccggcgacgccgacggcgaaacgccggtcaccggtgtccacggtcaccgtcggcggcagccgtcgccgtcgccgtcgtcgtcgagctgtgtcacggctgaggtttcagacggagaaggagaagaagaagtcagcagtggcagcatcaatggtgctccatctgcctctcaaagagaggcctagacatgctgaaaatctccttaattaattactagtactagtgattttttttcttcttcttcttgttctcttttgtccctccattgcttttcctgtacttctccttgtaccataatgattagtaggagtttaagtttaagcagcaggttgaagagagaagccccagcttaagaaagctcctaagtaaagattactgagcagcagctgtgacatctgtatcaattgtaacttgtaagtttctcttgatcatttattaagataaggaacctcaattaagcaggaacatcagatcgatcaccagttgctagctaccaccagctaccattattcagctgtcatttctgcagcagtcagattaactttagtccaaaatttttctctgcctcctctagctcccaacaaaagcctgtcaactctctgtttgaagaaaaaacgcatgtatacactgttttagatcagctgaaaattaacttctctacagaaatgaaatcatatatctgtgtaccaaaaggtgtgtttagttcacgctaaaattgaaagtttaattgaaattggaacgatgtgacggaaaagttggaagtatatgtagaaattttttttttgatgtgatggaaaagttggaagtttgaagaaaaagttgggaactaaaccaaaccaaaatggtcaaatgcctcctccacgatatgagcccgatcggttgaccaatgatggattatatgctagaatggctttagtagcgatacaaaataatttatgagtaaaacttttatatgtgtctctagcgacttaaagatcaatgctgaaaagaaaacaaagtccaaaataccttaaaatcaactccacaatcaagctttaaattttaaattttggccgcgactgattcgttgtaagataaacgatgatgcttgagacaaatggcctccctgaactggagagagagaaaaaaaacttttgcagctttcaagaggcgaaatgagaagtttgatcagcggaaggaaggaagggaggaaagaaggacgggtccccctggctcgagcgagtcaagtgagagtgagtgacagacacctgcgaatccaccgcgagatcctggcgttgaatcgcggggcgctctgccgatcacgtcgccaacagtgtgacagttcagcaaagatggcgatctttcttttgctctcgagtggcctcggtactctgaactcttctgaagtctgaagtctgaactccttcaagtggcgatctgcatatagatactagaggttgtctcattatttatttgctcccgattactgtgaatagtaacaagaagtagtattatagtagtatgaatatatttttctgaagaattgtgacatctagtatagaaaagaacgcagtaaaagttgagaaaccagaagtttgcaggcattattttttatccagaggcaaatgcatataaggaagtgagggagaaggtttggtctgtacagttaaactgattccgctccctttgtcgtgaaaatacaatctcaaagacatgtttatgttcttacattaaaaaaaacctcaaaaacttgtttatgttcttaagacaaaaattactcgtccctacacaaaagtcaatccacgaattactcctttaaatattccttatggtggttttctaaatgtatagttgtagcggtagagtcacgagtgcatgattctactcaccagagtttaattccttgtgtccataaatatggttatgttcatcctcgttgatgtagagatgggagttatacatttttcccctttttttttgggatatacagttcccctcgcaaaattcaggtcgttaattggaaaaacatttatgctaaacaggccgtcattacggtgatagcaatacgaaagcccatcacagcagtctcccctttgacgggccggcccaattactcccacaaaccaggctgggcctttgggccaatatgtaattacagtaattattccttatactaataataaatgcgcattaagctggggggctttcctgcaaaagagcgcggaaaataaaaatctcgcacagaggcgtatccacgctttccttctcccctcccaccaactaatcgatctcctctctctctctctctctccctctctatcccattcgcgaggcggcgtctcctcctcctccccgtctctctcgcttcccccccaaatccggcggcgaatccagggccccgcgccgcgccgacgaccaccgccgatcgcgaccaggagggaggatgctgggcgccgcgaggaggcagctcggatccggccccgtgagtgccgacgacctcctcggttttttttcctcgctcgctcgcccgcccgccatccctcggatttcccggggtttggtgcggttgggtttcgatctgtgatttggggggtcgctgacgggtaatggatggcgtgtgtgggggttgcagatgctggggcaggtgctgcggaggctccggccggcgacggcggctgcagcggatgcggcgagggcgtactccgcggcggcgaaggaggtgagggcctgggtgaaccctagtttttttttaattattttcattcgtgctcgctgcattggtgtggaatgaataatgatctggtctggcccgcggaattgcgttgttctgtttgttgacgggaaattgggttttggtggttggttgtatcattgatgtcgtgtattttgttgtttcggtagtattaacggagcgaattgtttctagtttggtgttgaggtggttggggatggttattggaagtggctgacggttcatggagataatgtgatgttttaatgtgtacctatttttttggttgagatcaacttaggattggttttgatgtcagttcttatgtatagcacaatggaattaggttatcccgattgaagaatagaatgttgtcatgttttgatgactgctgatttgtagccacatgtagactcgatgtcggagtgaactgatatctaaactgcctatagatgtgggtcgcgtgtccaaatttcccacagacagtcaggctacagggttaacagtttgtattgattcatttggcagtcactatactagacgtggagatacagtctcttcggatggtattgtgcggtttttctttagatgtatcgttgtggagatgtagacagttgacttcaaaactggtgactactatatctgcatagttcgattacttcctttggggcgtactgtactgtacttgtgttggtggtttgtggtgatttaatttgtatatgctggaaggtcctatttatattcctaattattttgttggtaagccggtaatgatttttctttgtttgataaagatgtattgttgtctggtaatcatgtctaacatgtttgatctacattgcttgctcaccttggttgttatggcgcactaggcggccatggcccatggcacttgctaaatgaagcaatttctatcgcatcatatatctacatgcttattcctttgcattgttcttgcccttctcattggcgtttattttttcctcaattacttatcaagttagtagcacagtgaatgaatgcaataagtgaagtatctgctggcttgctctttgcactgaaaggatcttcatagtttgttgagtgggcaaaggggaaaaatgacatttctatattaaaatttgtttttctttgttgggcaccttgatatggcaattggcaagttatctgcaacatattttacttattcagatgactgtccgtgaagcgctgaactctgcactcgatgaagaaatgtctgctgatccttctgtttttctgatgggtgaagaggtacacttggaactcactcactttctctccctgatttgtgtgtttttctaaggccttctctttcgtggcaggtgggagagtatcaaggtgcatacaaggtgtgtgaagttaaaaaatattagtagttgtgcctttcctcaggtccgctgtaaacgtattagctcttatcgttgttcatgaagtgtattctgttgcagatttcaaagggcttgcttgacaagtatggtcctgagagggttctggatacaccaatcacagaggtgattctaaaaaccttcttacctacctttcttttctgcccattcacatttttttcacactaaggtatcatgcgttcatgttctagtacttatctgcttcagttctgcttttccaggctgggtttactggcattgctgttggtgcagcgtatcaaggtcttcgacctgttgtagagttcatgacattcaatttctcaatgcaggttggtaatgcacgaattatcaatatgctactatgatagtggaatcagtttatattgttgcttgcagcaacggattgctgttgaattttatattagtttttgtctatgtaaagcaatgtaacacttaggtaagtatgttgtacaactagtttgttaatttgctagtatagattatctttcctgcattttagttaaaccatactctaatccatattgtacacatgcttgataaagtgttcgtcactcaggatctagtgttcggaggtccaccttctttgataagaaaccctcttttttttttctgaagcttaataattgacatatatttatcaggtgtacctcattagtgtttacttctgcattatttgtaccaatgacatatttcagtttttgtatgctgtgatttcgttttaattatttatattacacattcaggcagattgattcatatacatcaaattcaagttgccaaagtcaaagtaacatagtcagcgaggtcaagatatcatgtccctattgttttcagagggacctaatggagctgcatgctggagtatggcgcatcaacactcgcaggtttgtgatcagggaatggcttatgaattagtttatcatcctaggaccccattgaactttgtaaaagttcattgtttccttttgttgtgttgttctacccagaaactgtcctggatgatctggcaacctctttgctaatgctgaaatacttaatatccccctctccccaaaatgctggtctttaggtgtagaaaagaaaccaaagattaattatgagagttctttacagcatgtgaagctgcagtgagctgagcaggaagtttgactgtttaagatcagtttgccactagcttttatattctggctttttaggcatcacttgtttttgataaatcatggtagaattattttgccacttaaatatgtcattataattgcaattattcatttacaaactgaattggtttgcagtgttatgcggcttggtatgcacatgttccgggtcttaaggttctggttccatattctgcagaagatgctcgtggcttgctcaaagctgcgattagggatccggaccctgttgttttcttggaaaatgaactgctgtatggaacatgatcttgttatgctatactgactagccgtcatttccccaagatgctgatatactattttctgcagctatggagaatcattccctatttctgctgaagtgcttgattctagtttcgctctgccaattggcaaagcaaaggtatgttgtactagctgtgtacacatgtttgggaaagaaacatacttgcatagaattaccttgattatttcacaggagtcccttttaatgaacaccttgttttctagataagtgtataccagatacatgctgatatatatttctgttatacagtcagtgaagtttgatgtacttacctgtgggtcttctctctgtagatagagcgtgagggtaaagatgttacaattactgcatactccaagatggttggatatgctcttcaggtgcgtcattttgtaattggtaaacaatatggatgatgagtatgttacgtcgataactttatatgttttggctcatcatttgcgcagttttctatggtgtggcatatcatatctctgtaaattctgattactgtatgtctgtagcggcacttgtgagctatgccttttgggaatagcaatttatttttcattttgtgcggatagagggatcgtttatcaaacagatggttggtacgtccataagtctgatagttaaattgatctgccatattgttcctcagaaagtgtatgtttctttcagtttatgctatttgaggttttaagtagtaccagcggtacttaaaatctttcacatttatgattgcaatattacttttctatgttcttatgctcaatttttttcaggccgcagatatattgtccaaagaaggaatcagtgctgaggtgatcacttgttaaacaatttatgttcagtataataatctataatgcatcaatcttttcaaccacatactgcaaaagtttccttattttttactgctatttgccaataggtgataaaccttcgttcaattagaccacttgatagagctactatcaatgcatctgttagaaaaacaaatagattggtgaccattgaggaaagcttcccacagcatgggattggtgctgagatatggtacgctctctctccacatgcattggcacacctgtgtgtggataaggacttttagttctgacactcgttttctttgcagcatgtctgttgttgaggaaagctttgaatatcttgatgcaccagttgagagaattgctggagctgatgtacccatgccctatgctgccaatcttgagaggatggctgtcccacaggtccttttctgtttctatccaaaattttatgttgtgtcttgtacacatgttttgtttatgattcttttctccaccgatgcattttgtgccaaggacttgcacagagtagcactgtttgggtggaattcctagttttattggttgcatatatttatttctgttgacataattgagtagtagttacttccattcaacctttacattgtggggtggacatgtgctcctatttcgtgaagttgtgctgaatttaatgggagtgatgatttgttttcttcaagttgctctgtttttatttatgcctaaagccatttgattggtgcttctgaagggaatgaatatagtgaatctgatattagcagggaataaagaaatatcagttctatttcgtagttgtagtggcggtgttgaacaggatagtgtgcatatagtgttgattactggctgaccttgagggtcattccgatccaggagactctgaattatgaagatggaacctttttttaataaacagttaccatcattgtcataaccttatttgttaaaacaaatcgatttgtgtgggccatcctatgtgtctggattacaaaaatatttgcaggagcaatgtttcagtagagtaaggaaaaaagtgtggggctattgacctattgtagtttttatagtgtataatgtagaggttgctatacgtgcatacacactcataaatagaagtatttccttgattgccctttccactcaacaacttgagcaatagatatttgatcataagctggaaagcatatggcacacttgtcatgggatattacctaactgtactatggcttttagttaacactttctggtggatgttgtctgccacccagttatccctggaggtgctcactattaagaagttggtaatgctgcctattgtcggtttgtgtgttccgggtgaccactgtgatcagggtggtcatcagcatttcttcgactctttatggtttgcagaatggtggaagtacttgcggtactctttagacactggttcagaatcacatttgatttctgcactagcaatattattaaatatacctttaatgtaaatgaaatgtgaagtctaaactccgcttgcatgtttttttgtttttagctgtacctacagttttaaactggatctacgaggctatgcaattgtgaaatgcatggacctgcatcatttattatcccttatatggatcaactatgctgatcatttctttatcttcatttatattaacgacgttattgttgtgcttgcaggttgacgatattgtccgtgcagcgaagcgtgcgtgctacagagcggtgcccatggcagcaactgcctgataggagagacctcttttacatcatctttcttttcccgtccggccaacatatgattcataatggtgtccaacaattgcccaaactcaaagcgagctaattttgcaagatatttccatgacccccacctattcttttagctgcagttgcatcactgcgttcgttggtggtgacccaaatttccctctttttttttggtgtgtatgcgagaattatgcagcttatggtgattggttcacagtacacactggcgctagttacataaatgaaagaaaaatctgagctcttgatggacacatttgttgcaaaagacaacgagggcaatgaataatcccaacttaagacaacgattgcgcatgtcgcatgttgctattcgcccaaaatccggggtctaaactctcacgatagtcaacattttgaactgtctaaaacctctcgctgttgatgtcgatgcctctctctgatcaattagttttcaagtttttttttaatcttttcccaaaatcgacttaattagccgttatctccaatccaatcttgtatcgccgcaattactaacgatgtgatccccaccgaattgctggtataatagtgacaaccttttctttttagtacaacggtacagctaactaggaagacctaaatgattttttggtcaaacggtccgtgctaattgatcacggatctggtgcacgtaaccatcaatcgctataacaattattgtaacatctctcatcacctaacagaaaatcacgttccattacattatactccctccgtttttaaatatttggcaatgttgatttttagcacatgtttgactgttcgtcttatctgtgaaatatgtaaaactatatgtatacatataagtatatttaacaatgaatcaaatgataagaaaataattaataattacttatttttttaataagacgaacggtcaaacatattttaaaaagtcaacggcgtcgaatatttagaaacggagggagtattaaataagaaaacagcaataaaattcagctggaaaaaggtacttggttgatccacgcacacttgcggtcgtgcagaaaatgtatttttcttagtagtactatctcatcttttttgcccttttttccaaatctctccctttgactggaccatggactgcaacaagcaacaactaaagaaagaaaagacattaataaagcagcaaagaaaagaacagtccaattagaaaaaagattaaagtgcaaataccaaagccaaatcatccctattattatatataaaaaggattagaaatattattatttgtactaccaaaccgagcaggaatgtgtgcaagcaaggcataaccaaaaccaaccgctttccttttgtccaccgattgctctctctttgaccaaacaaagaccggggcagcttaaataaacagacaaagcaatcgaaaatactaaaataaaaaaaaacgaggcactaattaatgtcctgttcacatctaagaatttccaaagctagatattcctcgcttcacaaattcatgaatataaaatttgcaatcacttgataacatttgtatcaatcattttatttctactttaaataaaatacatatttaaatcactataattaaacaaacaaacttcaaattcaaattcagcgtgaatctaaaatctaaagctgtgccaagcatggtttggcagtcttgcctacaattactccttaattaagtcaccataaacacggcgcgccattaggggattaaagaaagcgcaacagtacgccactcgcactcgagcccggaaagaaagaggcaaaaaaaaaaaaaagaattccccatttccttctctctctctctctcatctctctcagtgaggagtggtggtgtagctaagctagggtttcgctcggaatcagggttcggtttcctccaccggaattggcggcgatctggagctcggcacggcggcgcgcggcgtgatccggacgctcgggtaggtgagggagggagggaggagatgaagtcgtcgctgcggaagctgcggggcttcgcgctgcagcgccacgagcagcgggtggaccgccgcgggggccactccccggccgccgccgccgccgcgaacgagctcctcgccgcctcgcaggtgagggggcacctgctccgtacctcccgttctccgtgtgggcgcgtgggtgagcgtgcgtgtgagtgagtgagacttggcgtgtggagatctctctctgcgggagcggttctccgcttctctgtgcgtgtggttggctggctcttgggagtccgcgaaatcggttcccgaatcccgattggttgtttgtttgtgcaaattgtttttgggaattttcgttgccgatggagtactatgggatgatgtgttcggatctgtgctccatgttctgtagggagattgttgaggaggcagacgtatggagtaagttccatggcgcggtgtgcttgaactgtttgtttcctgggtggacactgggaacactcgaatttcgcagtcttatctgctcacatttgccttaacgagcagagtttcatgtaatttgagagaaacattcctttgatcttctactcttgagtatggagttagcaaaaaaaaagaaagatcaaaacaatttagaagtttagttgcactaccatcgtagccgccgacataattcacggctaagctgaatgccttgtagtaatgatggccttgtcaattctagttggatctgacaaggtagtgccccattacctagtggcgattgcttcattagtgtttgatactagttgaaaaccaaaatgctgaatgagggaggttgtctgaataggtggaaacattgatgacatatgagaaagcatgtggtacatttttttttactacagtttagtcttatcaaatctaattggatatgacaagggagtcgctgctcaccattacctagtgtccttttctaattgttgaaaatcaaaatgctggaggagggtggtttttggaataggtgcaaacagtggtgacatatgagaagcatgctttttttttaaccaacagtagagcttaatccagattccaccaagtttcctctgttaaaactttcccttgttaggttcttactaaatttgttttaaactgcaatttcactttcaacaggatatggcagatatgaggagctgttatgacaatctgctttctgttgcagcagcgattgcaaatagtgcatatggtatgtttattccccaatagtacattttgtcttttgagatcagttaagtatgtgttcaatcctgtaaaaatatttttttgtgtattgttgccatttcattttacacatgccctgcaatagaactaacaactgcccattttcaaatggataaaaaacctcaatgtttcttggttaatcgagaaagcatttaagacgaatatttcatagttttaatctaaagtacagactacagagggtgcagaaacttaggtgttttatgagttgttcaccaattcttctcgtgtatagcctcagttcatttgctcttttttcatatgctagcagctttattagttcttatgctaattgtttataaggttatagcagctagaaatataggtgtcttgactcttttttgcatatcaatgatcattttatcctttcatgcatgcagagttctcagaagcactgcaggaaatggggacttgttacttaaaagagtcacaccaaacaaggacgggattaatggtaattatgttctgttgtgattaatggttctcactcccttgcataaacacatatcttgcaaattaagctcttcatgaaaacgacaaattgagccaagggaagttgtttgtgcccattctcatctgctagttgatagtcactatctcaaattgtgaggaaaatgaataaaaataggataatgaggccatcttaatgttattgatcattccatgtaacttttgcctattatacactttgctgcttaatgcttacattgaacagtatcccccagataaagttttgctgttgcttggaaaggcccagtttgaactgcggaagcttgtagatagttatgtaagttttaagttgtttatcggtggagtcacttatttaccataatcttctactgctaatcaagtcactatatttttcccagcgtgtgcatgttcttaataccatcaccactccatcacagtcccttctcaatgaacttcaaactgtagaggtatgttctcccattctaataattttagccattatgtacaattttttgtgcatattccctcttatgctcatgctcttttctctggggcctattccttccttgttctatgtcgttttactatttccccccctgccctttttaccctgctgatcatatgtacaatacatgaactcgctaaaaacaaaagtttggctagtaaacactggtctgtggcatgaaggaactcaaatcaactctgtagtccacttcattaatttgggttacattttattataaagtgtattgctgatcattcaaatgtggttttacataaactcattgcaactccaatggatatacatgataatctgaaattgtgtgtgtgcgtgtgtgtttttttccttttgccattcagtacaatccctgtttaaagggagcattcatttacttaaaatatagtatacatattttttttgttttgtctactcctatgcagattaacacttcacagctttgttttgtcatgttcttcttgttgcatttgttcttattttttgagtatttattatgtatttgatgcttgattacctaatcgtagtgaactgttcaatagataactatgatttattccactcagaactgcaattaagcaatagtgtttttttattacaggaaatgaagcaccagtgtgatgaaaaaaggtatgctgactgtacagaatgtggcttatatttttccctgttgacacaatttttgagtttccaaatgcttctttcagagagttgttcgaatttctgctgaatgcacagaaagaaaagggaagatctaagaatgccaaaagtgacattggtgcgtcagagcaattgaaacaagctcaggacgattatcaagaagaagcaactctttttctattccggttaaagtcattgaagcaaggacagttcagaagtcttttcacacaagctgctcggcaccatgctgctcaggtgcacattctgtcatttggaaataccccacttccttttttttttctgtggcaatctgtacaaaagctaattttgtgtaaatttgtttatattttactccaaccagctaaatttattcagaaaggggctcaaatctcttgaggctgtagagccacatgttaggcttgctgctgagcagcaacacattgaccatcagttcagtgcacttgacgaggaggattactctgtggatgaagaaaatgaggatgattacaatgacagtcatgaagatttatcctttgattatggagaaaataaggaaggcacagaagctggtcatgcttccaggagccctacagaggtaacaatgtggattttaatttgagcataattaactatcctacagaaggatactctagaattttgcatggtctcttactattagcaatcatagttcaccgcgcaggtgtaaagttgcattgctttaatgagtttaatgcatgactttgtatttctcacctttttaagaaatgatgttacattttcaaaattccatagctactacaaagtacaaactgaataattatgatgacataaccagtaagaatggtatatcgttattccatctgttaggaaagaaagatctaagcagataaatggcattccatatgttcaattacaagacattgtgcttccatgtacttaatttgttaagttgaatttgtatacggctacgcatttcttttccttttttagttggcttccttttcttgtcccaaaatatacctgtttctttacaatcatgtttttcttttcatgtctttggaggccttaattttctggatttgcaggaacttcttgacagaagcaaagcagagtattcctcttttcctggtgaaaggcagagatctggaagtcagtcagccccactttttcctgaaaaaaaacttgaggcagcagagagaataaaagagttgcggcgttctgctacgaggaagctatatacttatgttttgcctactccaaatgatgttagagacacctctcagacagttacagcaaatcctactagtggatctcctcttggaaacaaaggtgcattctattcatctccactccagccaagtacaaatgtgggagatttgagagacaataagctaccaagtcctaccagattatctaatgcacattcagttttgaaagagagcaataccaatactacagacaccaggacaatgcttgtgctccctttgggtgatctctctttacctggttatcatgactagaaggcttctgacaacaaaaaggtgaagagaggatccttttctggtcctattgttcccaggtcaaggtcaacagagaatattgatgttgtttctgtaccacctaggcacagctcttcacatcagccgtcaatacatgtcagagtttctcccaatacctcgccaccactgttgtcctcacctaaaatcaaggagcttcatgagcttcctcggccacctgctaatgcatcaaaacatacaacatttcccagtttagtcgcccactctgcaccgttggtgccaaattctgctcctttggcacccagaggccaggatcattttaggccgaggcaaacaccaccaagtgctccccaaactgcatcacctttaccgacaccacctgggcctatatcccgcagtttttcgataccttctaggggcatgagaacatcaggtatttcagatggtaaagagacagaagatcttcaggataaagggcctgccagaatgagcctttctagtcttccttcagcacaaacatcgttggaggatcatcggccattgtcaggagctaccgagtcagttagcaaaacatagggtgagtctagttttctgtaatacaacgccaattttggtagaaacttccttataagcaatttattgtttttagtccatccttagtagttcatgtaagaacatcaagtttgggttaccccttgaagattttttttttctgtgttagttcggagcttactatcatacatgagggcgaaaacatcagtgatgctgtttggactatagaagttttttcatttgcatttatttggttgccatcactactggccgcataacacaatatggatgtatatgcacacatacattaatagatgtggatacaaatgtattatggcattatttcaagtgattttagttccttttgagagttaagatgaactagaacaggtccaagtagaaggtagtttgtcaagcaccttcattttattgttgtgacatgtaatacaatggctctatatcagactaatcctttttctcaattaccttcccttggcagaatatttggtgttgaggtgaaagtttatttatcaaggggctcagctatctcgccatggaagaatattgtacatattagtatgtgaactcggccaatattgcaaattagttggtgtttcgtttgtatcccccatggttaagatgtaattgtgcaaataacgagttgtggaataaaatctccatttttctctccgattaattgatgtaagatttgtttgttgtgcccttgagatgacttgaatgccacctgttttccactgctcatgtaagcatcctccatcttaatttttaacatgagggagtcaattttgccaaaaaagaaaaacactagtgctgttattcatggaatctgcatgtatcatttatcaccttatgacaatctttaccatctgtgtgaactgctgggcaataattggctgtggcaagagaatgaagatgtttcatgagagttaatctacttctgtccaaatatacaggcagtttgttatacttttgagtgtattctgcaccaacatttctggttgcaaaatcaatagcgtagaacctgaacaaaatcaacatttaccatgtgcagtactttttctaagctgaagttaactccataattctgtactgtcagttagattgatcacattacgacatgggacgtaccaggttgtaccgatgaatagcttcagaagtacgaaaggtgtagtttcttcaactgggtcgtatttgaagaaacgatcaattaattgtaaagtctaacaggtgcggtcagtacatggaccagcaagcaattgtgtagctgtcacatgcctcaatcatgaacgccaaggacaatgctagatcagaagctggaactacctgacaatcttggatctgtatttgatggttttaattcaatctgtttgcttctcagacagggttatttccagctatttgtttttattctagttgttacaaatggcaggaggagtggactgactgaattgatcaaaaagattattattcagagcaaaactgaattacatgaagctgtccaagaccaagcttggcagcttgggttgttcgttttaggagaatggaatggcatcacgcttcctgatctgttaaacacttaaacggtatgatttagaaatatattatatatgaaattcttataatattggtttaaattcatttttaactttataatagttaattcattcatttgtacacttgcataattatattcagtattgcattccattcaacccaaatgaacactcaattataaatagacgattataaggataaaatgcatatcatgatgttaacaaatagctttgaaaaaaagttacccaaacaataccaataataaaagtttttttgagaaatattaccacccttttatataagtagttcaaaattgaactaatcaacgttaaacaaagaaaattgagaggggaggaaagaagaagattgtgaagatacgtaaaatcagacgaaccattagtacataattaatttagtactaattattttaaatttgggaaaatggatttgtatgatttttaaactgacttttatatataaagtttttttaaaaacgaactgtttagtagtttgagaatcgtacacgtggaaaataagttaaatcttctctcaatctctaaccaaaccaaagaacacagtcttaacagggttggtgatattaatgtgaactgaattgaagatgttcaactggtcactgcaatctcatcaattgatgatgtctttgatgccgagtaaaaaaaaaagagtgaagcatatctttgccttcttttgccaatctggacaaagaaccgacggcgtcagcggcagggagagaccggagagacgtagctgccgaggcacgcaacgaaaaacacaaaaagaaaagcctttggttttcacgtgcctggtcggtggccttgcattggctgcgcctgcacatctttgacgttccttttccattggttttccctgtgcagccagtacggctgctctccctttttctttcatgccaaaagttgggttggggaggaccagaagcattgagcagccacccaacaacgtactgtatgaatgatgcggcagcggcagcagcgacgtaatccctccgtcttaaaaaataattcgttaatccacctaaaataacgaattggataatcttttattcagatttgttgttttaaatgaagtcacatttttatctatgttagattttttttagactagggagattagccgtgcttctttcttttttttttttatgtatgtatgcttctaaagaactgtacgggattccatcctgcttgattttctcttataagtttggtactcattgcatactgagacttgtgcatcaggttaggctgcctagcatgtccatttgaaatcgggacagagctagaatgaaacagcaaagtgggactcacgtattttactctagtttgaactgagtttaggttgatacgtgtgtttgaatttgaacccaattggatgcacatatacgatgaaaatagataaactataagttgtaaaaaaaattagaccgaattcatgagcacctcctaacctaatgtagctcttccacagtttggaatactccctccgtactcgtaaataaagtcgtttaggacaaggttgaaaacaaacattgggaatataaatcatgaataactctcaagttgttgagtttgaaaatgtaaaaaatatatgaatagatttgtcttgaaaaatactttcataaaagtatacatatatcacttttcaataaatatttttatagaaataataagtcaaagttgtgttttgaagaccgtgtcgctatccaaaacgacttcctttacgagtacggagggagtatatttttctttatataataataaattaaaaaacccagcatctatgtatagtataccaaatccacttgaaatacacggttgttctctgttcgtccaaaaacaaagagaatatgaacacttccttgggatgtttattgaaaaaactgtaaaattcatgcgtcgcaaactagctccaatttgaactctgcttcaattttttgtgattcaaggatgatgatgcttggttgtctagttgtaattagacaagcaaataagtttagtagatactaatatacctttccaaaaaaatgtactagctatctaggagtggatttgacaccatctagaactaccaatgtggattactgatagctatatttcaggaggtagtatatattaccagtattgctacattgctatgtctcaaatcgtcggtctaatatctcaatttcacacgatccgatctaaatcctcttaataactcaatccaacagtgagatatctatcgctcattggttcaacttctacatcaaaaaattaccattaggtgccccctatatctataaattcatgataacttcaatcagacctaaccttcacaaatatcaaaaatcagggccctccatctctctttatctacggtcaggatcgcaaaaaaaaaaaaaaaacaaaaacaaaaatactgcttcaaaaggagaccttcagttaaaaaaaaaaagaaaaattgccggaggggagagaaaatccatggaatccgcctatttaaccatgagaagggagaagcgaagataggagagagaagaacaccaccaccaatccaccatcacgaggaggaggagaagagaagacgcgcaagcgaaatccaggggagga

SEQ ID NO: 17510 - DNA, 646 bp, Oryza sativa
aagccttacccactagacatgtggaagtacggtagtgctttgcaacagaggcccgaagaccggtccttaaacggccaaggtgctaccatccaaaccatgcaccccgagcccagcctaaaaccattttagggaattttgaatagagggggcggtgtgaagccaattccacaataatccaacaattccagagtgtccaagtgatatgagaatttcccaagtctagagttgtaaaaccacctaatgttgcctaattaacttgcgaagcatctacctagaattatactagtggtactatgagtagagtgtccactagttgaggttttgtttgtctagggtgaacaaggtagtaataataacaataacaataataatatggtcataacaaaggtaaataggcatggctaaataaaacagtgataacgcgggaatttaaataaagcgataatgcaataatttaaatcaacataattttgtaaactgggattcaatatgatcaagatgatgtgtcttgccttgctcgttttcccaatcgacggcttcgacttcaacgaagagcggatcttccgaagctgcagcgtctacacgaccaacggaaaagaaaaaggcctttaacactaaataactccacataacagcagaaacaaag

SEQ ID NO: 17511 - DNA, 601 bp, Oryza sativa
ttttagaaaatataaaaaaatcctccaagcctcatttgactttcatctttgcacattttaattgttggaggctttcacattgaattttaattattcttttgcacaatttcgaggatagattttagagtcgatttgggacgcgacaaacctaccccccttaaacggaatctcgaccccgagattcggaagaactgggaagagatcaggatgggctgccttcagctcgtcttcgcgctcccaagtagcttcttcttcggcgtggttgctccactggaccttgcaaaaacggattactcggttcctggtcctgcgctccatggtgtccaggattttcactggcctctccacataggtcaggtcttcgcggacttcaatttgctctgagttggcctgctcggatggcactcggagacatttcttgagttgcgacacatggaacacatcatgcacgttgcccaaggaggcgggcaactccagctggtaagcaacttctccgcgtcgagcgatgatacggaagggacccacataccgaggtgcgagcttccctttcgtctgaaacctgtgcacgcctcgcaatggcgtgacccgaagggggtgcagg

SEQ ID NO: 17512 - DNA, 171 bp, Oryza sativa
atggatgaagtcgggggtcgatggacattctccagggcaaatgaaggctacacgagctgtggcccggtagtcgagaatgtcatggcacagggccggtgtcctgctgctaagggctcagtcctacctgcctgtcccgggggttccggccgtaggtgggattgggtcggtact

SEQ ID NO: 17513 - DNA, 2277 bp, Oryza sativa
cccgtcgtgtacaccggcagcttcagccccgccctgtgcgccgtctcctgcagcaaattcttgtacacccccgtctcatcctacaccacaaaatcacacaccacatcacaaatcatcttcatcaaccacgacgacgacgacgaacaagaacggaacaatcttacgagcacgcgggcggtgagggaggaggaggggccgcggagggagaggcgggcgagggcgacctcggcggcggcgtgctcggcctgccggagcgtggtgcagttggatggcccgtcgaaggtctcgccattgaaggtgacggtggccttgaaccgcggcgcgtggtcgggcccttccctcgtgcacacgtacgacggcaggctgaagcagctcctctgcgccagctcctgcagctggttcttgtacatcgatcctcctccttcgtctctctctcctccccaccccctccctctctactcctcttcttctctcatcatttgatcatggcatcatcatctccattgatggacaatagagagagaggagggagagagattagattaggtgttcttggggagattgggagatggaggaaggagaagaagatgaaggtgagagtgtgtttactagtggtagtggtactactactactctagtaggaggagtaccaaatggtgcattgctttgctctcccctcttctttatttcttcttcttgttgctcatctccctctctttctcactctagcttcactctctcactactggccattgttgtttgtttctctctctagacaatactatggttgtggtatgggtgtagagagagaaagtagggcagagtggggagggtgagatggggggcagagacaccttctggtattaattggggggagagcatttatggtgttttgtaagcatgctgcatcctcacacacacaacacacttacctagagtcgtcttcatcatctcgcagtgcaatgcatgtgttgtgcagacatggatcgagatctctctctcttctctctagcgaaccgaatcgacggtcgtgatgatcagaagggttttcgttttctaccgctgttgttttttcatcgagatgtgatcatcgtcgtcttcactctcgccaccacgtgatcccaacgacccaacggtttgttgaatgtgtataggagtataggtcaaaagatcattttatctcggttggtaaaatgaaaattttacctttgggctttgtttagttccacgtaaaaaatgaaaatttgaagaaattagaacgatatgacggaaaaattgaaagtttatgtgtgtaggaaagtttgatgtaacggaaagttgaaagtttgaagaaaaaaagttgggaactaaataaagcctagggtgtgtttagttcataccaaaattagaaatttgattgaaattggaacgatgtgacggaaaagttaaaagtttgtgtgtagcaaagtttcgatgtgatggaaaagttgaaagctttttaagataaaattggaaactaaatcaagccttggtctaattttacaggctcgcaagatcaaatcattctttgatcttgagaaaataatctctttgttttttaataaatggtgctgatgacttctgaatatatgatcattcgttttattcaaaatttttatataaatgtataagatataaaacatgtttaaaatattttaagtgataaaataactaacaacaaaataaatttcaattaaataataataataataataataataataataataataataataataataataataagacgacgaatggttaattgtgtaaccaagttaacgacatcatctattaaaaaacggaggtagtataccagtaccgctcgtgtataggtggtggccggtggtggctaaacaaccaacaatgaccatgatttaacgaaacaaggttgtgacttgtcccattgaggtgaagttgtaaccatacaccgatacacattcgcatgcctacttacaagagaaagtatataagtttaagagttaaacacaatggtcagatgaaagtttattacacatacatcttatcagatccaaaaattgaggtatatgtgccataacatatttattagtatcatgacttattaattatatttaaaccatagtattatcctctacgttttgctaaaagctatcggaatcgtcttacccgatcagcctagatccaccttgagcccttgatgcttatggttgtcttcaaatgtataaatttgttcctcaattagcactcatggtttgactgctagatataaggcgt

SEQ ID NO: 17514 - DNA, 2253 bp, Oryza sativa
gaagggtatccactcttttagttccacttgatatttcttaacgatctcgctttacattacccctattcataaactagaaatttcctaggttagacttttgagttttttttaagagaatggtatccaaccggatgtatgcagcctttttaaattgaaaacatagtcctcaaataactcaatctgaaattcgatcacattgagatttgaatttaggatattgaagtgctactaaggttactgcaaccactaagctacatatcctttcgcaggctttagaggtatctagctgattttgtttctcattatgcatttgtgcggttatttaaaaaagagaatataagttagagtgaaacacactaatgggatgaacaatgaatggtcctttaatcactattgcaacaaaaagtttaattagttgatattgctactttgcctaatgcatatcattgtgccgacttgccccatgagacctaagtatgctctaccatgtcaaactcgaccatcccatatggccattatttggaagtggcaacaagggttgaattgcatagaagcattcttcgaatgtgtaaacttatgttgaaaaaggctaaatattggtttcttattagcacccacaatttgactggtagatattaatgtatatatgtttgaaagaaatggattattggttgaatttagctcagttcctcttgagattttgggaagaaattaaagaaacgaaatctagctgtaactagcatgatagttttatttccatttagagtatttacctggacttctggcattggattgaatggacatcctaatggtcttacatctcgctagtgtaaacttaaaatattcaaagggaaataaccaagaaagaaattaaagccgcctcttttagttccacttgatcttccttactaattttttagtattttttagaaagctcatgtagaagatcatattttatactacccatgaacttgacaatttctttggttagactttaagaggtaaaaggcagaatcatttggaagaaaacaaatgtgcatagaaacatgagattgagctaatcagtactatcatttatacttattttatattgtatttggatgacactatcttatttttggctgtgttctttgatgtgagttgacaactaatctatgttcacagaaaacagagtgacatattatcacatgattaattaagtataaactaaaaacttaacaaatggattaatacgatttttaaaacaacctttatatagaattttttaaatattgtttaacatttttaagtgtgcgtgtggaaaacgagagattgaaggttgagaaccatcacaaacgaacttaacattagtctgtcttagaatatttatagtaaaatcgtaacggatttacttagcaaattgcaaaggatagacaaatgtcaaacaacttgcaattttttttaccacaatttaaaacacatcgattgatagctacctgacgagactaccctatcaccagccagtccagcccctttggctgctaacccggtcaaaaaaacgatcaaaatcatcaagtacaggggacgatcgttcagccgttctcaccaaccaaacaatgaaaagaaaaaaaaaagccacaaatgtcaacgtgtcactaggaaaagtcaaaataattccctcacttttacaacccaatcttgtcgcttataattatgcatatcagccaaaatttaaacttttaactttaaatttggagttaattctaagaatttttaccgaaatttatttttcagtctttatttttagatcgctaaaaatacgcatataaaatttatattcacaaacaattttcagtttgtgaatatatgtcctatggcttattcaacgacagggataatcctcccacgattttatttcattttcaaaaaccgcgccggcttaccgggcggcgactcgacccgccaacccgcctccacgcctacggagactgccacgcgggccccacccccgcacaccgccgcgaaaaagcttctcccccgggcccaccaccacccccccgggctaccgccgctgccgctgccgttgctacgcgtcccccgacaacgtgcactccctcttctcctctcctctccaattcgtctcctcctcctcaccacgcttgcttcgccatcccgcctccgcatcacccgccgccgccgccgcctcctgctcgtggtcgcggctgcgttgccggtgctgcaggaggtgcttcgggggggagatctcggtggggt

SEQ ID NO: 17515 - DNA, 10071 bp, Oryza sativa
attcctgcagccttatgtgactgggcgcaggcgtgggaggaaatgagatgttttcggtttcacgtgttcgcgatttgtgtgatgcttatgttcgaaatgcgagtttaggggcttggtgtgacagaaatttgagccgtatttgatgcttactgtagactgttcgtgttctagttgtttatggttgggaaatatagctctggatgggtggaaatcagttcatattcgaatcatgaaatgttgatacagctaggggaaagtgtgtgctttctattgttacgagaatacacagcagaaaatgttttatatttatgttcagtgcttcagtttatttatcaggttgggtggggactggggaatgctagttcattagtttgttggggaagctacttcaattttcagaatatgaacttttaatgactcttacatgattatgaggatcatggaatggggactgcagcttttggtagtacaatatgttgggaatgtttgatacagaaagtaaaatgttttatatctgttgtgcagtgattagttttggcgagaaacacattatatattggaccgtaaaatgctttggttggaaatgtgttatgctctatatttctcgtagaactgaaacataccgagacaatggtaattttggtctaattgtctaaatgatccttttgattcctttgatggggtacttggatgcatttttaagtagaagaatttattcaatgatagcttctttgatcctttttattcctttgatgggatacttggaggcatttttttaagtagaagaatttattccaggatagtgtcatgctttagctcatctacagagtggtctatgcacagcgacctttgtacatgattcaatcacattctggcaggtgtaccgtcaataaattagtgcacgcttcgtctgttgaacaagaggtgaatgaggcatttgtgtatggagattacctcatattaccatctcgttcctggcatctccgtttcactagattctccaattgggacagcgtgcaactagaacaaacaatccattcaaacatctgtcatctgcatagtagtgtgcttaaggttgtgattagccaacgatgtgggatgatgaataatcttgtggccttataaagaagcaaggattaggaaatctttctgggagtttggatgtactttatttttttggcaagagtgaggctgttttcttattaaaaaatttcttagcttgtggatataattgtccatccacctaattttaacaagctagagaagttcttgatatggtacacattccgtgcttgggagaaacagctaggaatgtttcatattacaaagccgctgagttacatttttagatatcatttcctgtttctgattatttggttgttttcatgagattttagttttcttttgcccttctcactattagtgttagcagcttttaaccttgctatattgagacatcactatttaatgccataaagtgccacttttttggctaatcgactctgttttaaaaaatagcatgctgaccgttttttttataaattcacttatatatttgcaattatttcttctagtttcacgcattggattcattgataacaattatggatctttttttcaggagtttttcttgcaaggccggttcatttttggaccagatgtgagatctttgtttctcactatattcctcattcttgcaccagtattagtcttctgtatatttgtggctagacatctgatcaatgacttccctgatcactggggagtttcagttatggtcgtagtggtcgtcttcacaatatatgtaagtattgctaatttgctgcttctcatttttttttcttgttccctctaaattgattgaaggctgtcttagttctgctactctgaatttggttcatatgacagttcaaccatgttctctttatctcctagcgcttgcatgatcagtaaaatttctggccatgaataaaactattatgccaagggtttttattttagttagatgattatcaaaatcggataaatctgtcaaaagtgatgcacattcatgtgtaaagagtaacatagtataatgtgtatgggaaacacataaaaatgtgattggctactcaaacattgttatccatatgaaagggagttatgtgccgagtgaataaattactttgacagtgtaatttattatgtttggttgtttgctgcatttatttcccgagtgaatatgcactgctgcagtgtgtgcaattaactgaagcttcatttaattttccaggatttgacattgctgcttcttacctctggtagagatcctggtatagtaccacgtaatactcacccacctgagcctgaatcgattgatggaggcagtgatatgggaaatggacagactccacaacaactacgtttaccacgcacgaaggatgttttcgttaatggagtaattgtgaaggtcaaatactgtgatacctgcatgctgtaccggccacctcgatgctctcactgttctatatgtaataactgtgtggagcgttttgatcatcactgcccttgggttgggcaatgcattggaagggtaagtatcttgatgtgttggaaggtttaagatatccttattgcaattagcttgaagatttgatatcatgtgcggtgttgtggtctgtatacctcttgttggattttctatattagatattagtagattgttagttactactttaaagttttaacaagtcagcgctaattatcaacttatctgctgcagcgaaattaccgattcttctacatgtttgtattctcaaccacattgctgtgcctctatgtctttggcttctgttgggtgtacattgttaaaataagagatgctgaaaattcaacgatatggaaagcaatgttaaagacaccggcatcaattgtcctgatcatctactgctttatttgcgtgtggttcgttggtggtctgtctgtctttcatttctacctgatgagcaccaatcaggttggtatcctttcggtttttttttaagtttttacaaataaatctttcaagcatagcttaatgacttgttaaccgtccttttctttacttgtgtgtatcagacaacctatgagaactttaggtatcggtacgatcggcgggctaacccatataacagaggtatggtgaacaactttctggagatcttctgcactgcaattcctccttccaagaacaattttcgagctagggtcccagtggatcaaggtttacaacaaacacgcacgcctgctaggggtttcatgagcccgaacatgggtaaaccagttggagatcttgaattgggtaggaaacccgtatcatgggatgagcctcggtcagcagcagatatcagagatttggaagttggccttgggggtcttttggatgagaaagagggtagaatagcccatgcatccccagatctttctcttccgggtgagcttgtggaagtagggctggtatgcattcgagacgatcaagttggggtcacagaagcggaacctcagagtcgatggacagcatcgctgtgcaaatgggaaccgaagctaactggggttcaatcagcagcggccatggtaccaccagttcaactcactagcacacatcactgcatttctgacgctgcatctgcatctattggatccatctcatgaatgaagaaccatgtgtgtactctcttctcctgtgctgcttttcaccttaggatatatacacagtgctttcttcctcccgtcctctgttgttgttccatcctggaatgggcatctattgatgcacatcctgttctagtgtctttaagcaaaaataacagaagatctttaactcaatgcgtggcttggattatctatctgtatatatcgagtctgtaagcaaggttgtcgtgtttggtttggtttggttttcgacgttctgtaactgtaccatgctgctcgactcttactcaagaaatactactacccaaatcatcctctttttctaatgcaattctttttcttcaagtctctaattggattgttttttttttctttttgggacatggtataccatctgcttcgcattcttctgcatgctgagctgctccttatttgattcttgtgttatctgctcaaccttttgtattcctttgcatactgagctgctcattggtactatgaattcggtgtaaaaattaacttcaaattcaatttgctcgaaaactttcattagcatatactccatgtaatttatccagaaaaacaaaagcccagttgcaattgcaacgggggtgttctgctgggttattttaatacagatgccactgaagcgtgtgcagcatctggctcgcgccgaccaatcactcaacctgcaacagttgcaacagtgggcttgtgtgtttggcatgctttccaacgcaaaaagggcacatgctgagctgcactctcctgctctcgcagcaatgcaatgcagaagcagcgtcgcttttggtgctcccatgaaaattctgtggcatcgccagtgccaagcattcaagtatattttgtaccaccattttcttgctcataccagagaaaaatcatcataagaaactttgtattttgagtgttcttctgtgtgtcatgatcatatgttcagtgaggcatgttcttacatgtttcacagagcttcagttccgctaaaaaagagagcagagtgggctaaagtgatcttaaaaaattaaactagaagggtgaagcgagtctcgggccactccacagctacactttagactccgctcctaaagttaggtttataagttagagtcctataaaacaaactcgggtttatgacgattattcaaggacaaaaacaattaattatatattagaaagtcgaaaagttgttttataaaagttttctaagaaatgttgaagtttttttttggcaaaaaaaatgtaatatttaggaggctggaaagcgtgcccacgataatccataagccattgtgttaggtcaagttggatcgttgtgacacatcagtcaccaaatcaaaaccgttccaaccacagttaagtacagaaaatctgaatggattcatgtgagagtgaataaataatcatcactaagaatcaagcagaatcaagcaggaaaatgcatgtttgattcccctgccaggagttcctgatgcaagcagatgaagccagtaagtacgtagtagtagtggcctccagctcgagcagcagtgcagcactagaactgatccagaaacatcaaattttccaacaaatcaaagttcagaaactggcatgtcatacatggaaaattcatactcctaagtgcctgcacctgaagatcctgtggatacaagcaatggtgtatatttggcacacaatccaaataattaactagagcagattccattgagtggcaaaaggagatgatatgatcaggttagtggcttgtaggcaagtggagatcaatgaggaggtgaggaggagatgaatcgtatctttggtctcctcttatcttcttctttttgaatttaatcttcctttccaataattgaaatgttcataattcatcagaacattataaatgattaagagttaactatctagttcttcaattagctcaagggaagcttctgtcttctcattgatacacatggtaccggcagggtttcccaaaccaccggggccggggttaccacgccccggcggtaggtaaccgtgaaaaaccatgcaaaatttatcaaaaatttaaattattttttaaatttatttgaatttaaggaggttaccgtggtatttatattaccgtaccccgcggtaagtccggtaaccgcgcagttaccgacggtaagggaaaccctgggtaggtataggtaggtaaccatgtaccgaatagctggataagactgtgacaaactctgcattttgccctcctttttcttgtgctgatctgagaaaagaacacatttatgcatctgcttaactagacccaagaaacgtgcacgaatacacatcagctcagtactctccgcagaaaagattttctcaggcttgtcttcagccacagcaggaactccacttgatcagtaataatgcatgcatgcatgccaagcacttactagcaacactacttcttcttgttcatcttcttcgtcgccatctcgataaaacttgccgttcttggagaaagtaaaggcacagttgggcagctgcattattgaatggttcagctattcaccagcatgctgaaaattattcagctgttcagtagctagtagaagcagagaaggtgccagtgaaacaagcactgaaacatttccgtttcatcgcctcctcattgccgcgatgcagaaaaggcctcgtcgctgcatgcacataatgtattaccaccaagctttgatccgacaagtggcaggcaaatgtgatttgcagctgtaaagcaagtaaaaaaaaggtataattgtccatggtttgatggtgaaatgtaacttactgatcaaccagatgcaaagctagtttcagctggtaattaactttggccatctctgatagatgcaactagcttaattgtgttgtgtttctgtgactcttgtgtgtggtgcatcatgtatccacatacttacatttactctttgtgttcatgagaattggcatgcagctagctagcagcattgctgaacctgaatgctgatcagttcagaaaaaatcagatatgagcgccgatcaatggatggaaagagaaaaggcctaaccttgactgaaccggccacattgctatagtgctgtactgttgtctgcatgcatgcatctctcttgtcagtgctggtcatggatgtgtattaacagtagtagtacattatgtaatgcgtctttgcaattaaaatgcacagtatagtagtaacaaaaacatgcccttttcttcccatagttttggggtccatgcaggtaattcatgtgcagattctgatactgatgatctgacagactgacaacacatgaaacctcagatgcaactggagaagacataatttgattacactctacaatatctaaatatgtctctcctatgtactaactttttgaatacattcctgaatttagttaatggaaggattattatctgacaaatgttcaattattcagtaagacttcaggttatagcaaacagtaggagtataatatctctggaccacttaggcacttaggcaccatgtagatacgtacatatgtaacatatgagaagaagagaagctctactactatatatacaaggcttctacccccaatgccaagcacacaaacattgggtgcagtagtgaatcctcttcagaagttcagaaaactatagcttgcttttagcatatataaattaggtgtttttatcttcttttgagaaggagatcaagaacaggcagtaggaggcctcttcctcttctccatggatcacctttgggcctctgtctttgggattcttggtaagcatctcatgcatgctagttcaccatctatacatgcatccatatggtagcatatggcatggcatggtctcccaaatcatgattttgtttaattatatgtatgacctcaagatatattattcttactgacatgcatgaaaaatgcacttttcttctccacaggaaacatcgtctcattcctggttttcctcgcaccgatgtgagttttgctcatttacgccctgattttttcttttccaaatcattcattcacctaaacttaattacgcgttctgacaagtgcacaattaaattttattttttactaaaaaacttaactacgcgcacgtcctgactcctgacacgcgtgtagttaagctttgtcttgttcttaaaaaaaacaaaagaagaaaaaaatctcaataactacgcgttgtggggattgtgccagagttttgaatttcaaaacatgtctttttgccagtggggactgaaagaactgaaatcaccgaaattttggtaatttcggattttttttgaattttcaacatattttgattaaatctgaataaatttacaaatatttgacaaaaaccgaaaatttcggggagactttgtgcttgccggtggggcccgaaattttcgaaccgaaatttcaaaccaatggatggtgcaggccgacgttcctgagggtgtacaggaagaagtcgacggaggggttcagctcggtgccgtacgtggtggcgctcttcagctgcacgctgtggatactgtacgccatggtgaagaccaactccagccccctcctcaccatcaacgccttcggctgcgtcgtcgaggccgcctacatcgccgtctacctcgtctacgcccccaggccggccaggctcagggcgctcacctccttcctcctcctcaacgtcgccgccttctccctcgtcgtcgtcgtcaccgtcgccgccgtcgcccagccccaccgcgtcagggtgctcggctccatctgcctcgccttctccatggccgtcttcgtcgcccccatgagcgtcatcgtaagaagctctcacctcatcgatcagctcttttcttttaaagatatataatgaaagtttttattgaactcagccaattacatcatatgatattataactgtagtaagaacattccccaacttgaactcaactcatcagttttttttaatataatgaaagcttttattgaactcagccaatattacgtcagatgatacaaccgtgctaagaacactttcaacatgaactcatttcatcagtttttttttaagatgatggaagctttattgaactcagccgattacatcagatgatacgatcattagcttgaactcagctcattagctttatcttttttaagataatggaagttttattggactgagccgattacatcagatgatacgatcgtactactgagaacactttcaacatgaactcagatcatcagctagtgatgatcttgcatcgtacttgttgagacatgtttgctgatcaatcgatcgatggatggatggttttgcagatggtggtgatcaagacgaaaagcgcggagttcatgccgttctcgctctccttcttcctcacgctcagcgccgtcgcctggttcttctacggcctcttcaccaacgacctctacgtcacggtaattaaacatctcgatcgatatcacatcaaatcttgatcaattctctcgaccaattcatgaatttcaatcaaagtttgaattgtttaatttgcgtgtagcttccgaacgtgggaggcttcttcttcggctgcgtccagatggcgctctacttcaaataccggaagcccaatacggctgccggcggcgtgatgatcctgccgacgacggcggctgcggcggcggtcgacggcgcgtggctgagcctgcggcggcggcgcatcagctggcggaggagctggaaatggagctcgcggccgcaggcgcgcacgcggtggccgtgctgccggcgagcgcgctgcccgtgctggccgagctgcacaagatggagcaggagatcgggacgccgcgcaagggcgccaccaagaccgtctgacacgtggctcgcctccattggttgtcgagtgccatgtcatcatcgtgattattatatatatgggcaaaatgcatcatacccagtagtaaatttcttaatttcagctgtttgtttgcgttccatttgtgtgtttgaattgagtttgtattgtgcaattatcccaagaaaaaagaaatgtgcatgtattggttatgattaattaaattaattcgtatcctatcaagcatagttgcaagtcgagactatcttttttcttcctagccattgggtctccaatccaaaggtgagacagcccatctgaacttcgcggtccagtcagcccaagctcattaggcccagtatctctctgcaacatttttgcatttttttttctttctttgataaactcctctagtgaatatgtgcataactgaaatggacgctggcctgacaagatcaaattaaaaccaactcttatgtttgagccatagctcacaagtcacaaaacaacaagtgattcaaacaaatcagaaacaataagtactccagtgatcttgcagggg

SEQ ID NO: 17516 - DNA, 18450 bp, Oryza sativa
  unsure (1)..(18450): unsure at all n locations
gtccaacaacatcactgtggttggctctgtctactgtgatgcctgctccaacaacactttctccaagcacagcttcttcttgaagggtgagtagaaatggtagtatacctgttacacagtagctcagctgcattagagttagttttgatcaatgtgtcattctgcattgtggtcaatcaatggtttgttctgaaatatggtggataaacatggagtgtttttacagcaggttattctttgtttctgagatagatttacaagatgctgtaaatctcttgctcattgcacagtacaaccacatgtaggatgtcttagaagtattaggttttttttttctgttctaggaagatgtcactgaaaagtgaaaactaataggcaagcgtgacaagacttctttttgagtacattgattccctatgaatctaaaggagacagagaaaagttgacatatgcacaattgcacataaatgtgtctgtggcttgttctggatttataattggtctggtcaattttcttggtccaattgtaattgttgtttagttttagttaatgctaccatgaaagacaagatgcctcacacaatataactcaagtttcttaggcccacttaaagcttggcatacactaactgaagttgaaatacaactgacaattactacattgtgccttcaattgcataaatgcagtatcatccagcttctactacccatctgggctctggcattgcaaacagaagttttaactggctctgagatgtgcttgttacacagtttcaattcagagttttgatcttttttttaaatggaaaaaaaatgtttctgtcggttattttgagcgggatatacctctaaatctcataatgctatgcaaattacaatgctgcctcaagctagaaatttccatgtttttggctttgttctaaaaataacgatttcattatcctaatagaacatagtgtctatgagttgccaaagtatgacattgcactatattaccaatgcctcattctacattgccactaaaactaaagctaagatcattcacaagagcagctggtttcatagatttcatcattgcattcaatctgaaatctgaacaagtaaaaatcagtaacttaccagatatgaaattgtcttcatctttggcaagaactgagatgctgaagccacaccactaatggccaccatggtgatggatgctgtgcaggggccagggtgctgatccagtgcagcttcaaggtgaactccaccatggccgaggagctgtccctggaggcggagcgcaccacggaccagaacggcgtgtacaagctcgacgtgccggccgccggcggcttcgactgccgggagggccacgacctccggtcggcgtgccgcgccacgctcgtccggagctcctccgccgcctgcaacgtcccgggcctccggggatccacgcagcacatcgccctccgctcccgcgccaccaacgcctgcttcctcaacctcaacgcgctcaacttccgccccgccaagcgcgacgccgcgctctgccacggcggcgatggcgccggcgccggcggcggcgctgcgttcggctcgtcgctcttcttctggccgttcttgccgctcttctggccgccgtaccggctcccgggcggcggcggcgggacggtgtcgttcccgtggccgttccccgtgccggactggctggtgccattcctgcggccgccgttcttgccattcacgctgtaccagccggcgccggcgggctccgcgccgccgccgttctaccgcttcccgccttcccaagaagcatcaccatctcagccttagacctgaaaaagtacaaaaaaaaaacttgccaagattaatcctagattcttcatgtttagcagcaagagaggttgtgtgattgtgacattgttgtaggtgatgattctccctgcatcacacgtgtagctggagctagttcaggaattgccaccgtgttcatcgggctgatgaatatgtggaagtgataattataatgtagtgatggcaacttgttagtagtattcggtatattgtcttaaaatatttcctcgctgcagctaatttttcaatcatatttatatactgatgaatgatattgcagccgctaacactatcttggtactctttttttttacgaaccggcacttagaatgtgccaatttcattgaatagagggagaaatcctgataccgtttttctcacaatttaaacttcattcctaaaggaaataaactggacaactattttgaaaccgagagagtaattgacagatacaaaatagtaaaacttgtcagttgggtgaactcatgaaggtatatgcctgattcagtccagacatgaaccaaggaaaagtttcttcgtctgcgtgtaccagcagagtaactacccaatttgcatatggcacgaggaacaggtacacatatgtctctaaccgactgctgaaagtagagttcatcagaattgattgcttcgtcttgtctcgcggattttactggcatggaacatggtatgttttttgccaagcccaatggttttttgatttcttccagtggaactgacagtgcagtttgacaaggaaaaggggaagcagacacaagataggacacggtctgtttcatcatgtaaaaatgcatggttcagaagtaatttggctcctggaaacacttcgcagtgatgacatttcaaagttcagtttgattcaactattcagcaatcggttccaacatacacaaatctagctctgttaatctgaataaatattctcaaccaataacaaatggttaaacttatacggagtatattcttagacccaggagcagatgtgtcaaattgaggagagttgacaaggactaggcgaccaagactgaatccataacaaaacaaccgaccatttggagcgttgcattgggtgagaaaaagaacaaagaatcctgtttaggctaaacaacccttgtggctggggagttggacacctccattctaagtacaatcatgcacacaggtcaagaggtgtttatagctaaatctaatgcattattgacatgacgccactggcctctccaagtcggccatggcgtcactctttgcacacttgcaactcctgctccagttattaaccttccggtgctgccgtacctcatgtatactactaaatcactgcatccatggaccaagtacttaaatgctatatatgcaatcttcagttgtacttaaattctatatatatgcaatcttcaattgtacttcaattcaatatatctactctttaattgtaattaaattctatatatgaaatcattaattgtgcaagaaccatggatatctgcccccaatccaaaagatggcctttggaccaagaaccttgcttggtccatctatatatatcattcaccacctctcctttcaccttcccacatgttcttgcttaatcctttcactaaatgtgtaaacaagttgtcgatgtgccaccattagaaggagcatttgcaactttgtaatcactagctaactaaaaagaggaagctgttgtatacgtacgtgagcgtgggcatggccgagaagaagctggcaatggcggagagagggcggaggggcctgatcatgaagacgctggaccggtgccggccgccggcgtggaggaggccggcggaggggtgcctctcggtgtacgtcggcgcggcgcggcagcggttcgtcgtccggacggcgagcgtgaaccacccgctgttccggccgctgctggaggaggccgaggaggcgttcgggtacgcggcggcggggccgctgcagctgccgtgcgacgccgccgtgttcgccagggtgctggagcagatcgaggaggaggaggaggagacggcggccgccggcgacgtggcggcgaggaggtgcggcctcgccgccagagggcactccgcctaccggctgctcgtccccggcggccggcctgccctcgccggccggtcgtaggacggtgcagacatgcagtggagtgtttcttgtccatcgacttatcttgagcttgtggctctgatgataaatccacctaaatcaattaatgtatctgcaaatcatgaatattgcaacaagaggttagtgcttagtactagtagttgatcagatcttgggcttgagtttttcttttgttgagctcatattcacagaagatatgtgtatctcttaggtcgcagtaactgttgatcagttgatgcaaatgttatatattcaaattccctagctttggatatttatgatacagatttcccaagctttgaatgtttatgatacaaatctccctaacttggaatgttttatggtggaatgatgcttagaattataaataggttgcatatttgaatgcatctcacattgataagtttgtagtttttggcctcctgcagttcacttgtcaattgtcatgcatgtattcattatttttttataccaagcttctttaagtctactattcaatacatataatattaaaaagactcaatgcttcaaaaaccaaataataagtcaagatagcaattagcaagcaacacagcagaaacacggtgacgagtggaaaaatgggtcaacaatggacaaagaaccagtactaaccagcatgtacagaagattgaattcaaaaaaaggaaaaaaaatctagtgaatcactgcacatacctcctggtgctttgcttggcttgctagaaggttgaatcaacataagggactacaagtattcagcaattaacatctactgaggcagcacctatgctgttattttcagcagcacttgagggacattttgtcaaaaaatccaaatctgaaaatttcaatgtaatatgatatgcagttaatgattaacttttcttttttgctgggtcggccgaaaatcaaccaaccgaattgtattaagaagaaaagagagagttcaggttacaaaacgacattaaactgttgaaaagggcaaacagccaaccacgaaagcagcaaactgatgtccctaaaaggaaaaaagcctgggcacaactaatgtttcagtgttaacttggataacgaaaacaacagcatagaatttaaaatggctaggttccctgtacttttgacatctgtagagtcaaatgacaggggccacattgtttcgctagccctagtatcatccgaaaagctacaactcagtctaagactcggtaaataaaatcaagcagcaagaagaaaatgtcttgttacatgaaacgggctgacctttcaaagaacaagtgttggaggcgagaagtttttttcttatactcgattggaggcgaaaatggttgtgaaaattatacaatctggcataacaaaatctggcaaatcaaacaggctgctggttgtgtcatgtatgtgatcttaagcaaggtgtgggtaaaatattcactctttagatgagttttttggatctttacctcaaattcatagagtcctggttttcaatacttgcctcaccactagaatgtcttcagaatatggattctgaagccgtcaatttgtaaccaaattacaagaagaatgcagttacatggtcgcatacttttaaagcatgtgcagtaattcagattaggcataccaagactgcggttgcgtggtttctgctctacaaagatatcgcaattacagaagttctggtgaagaaacacaaagtacacacccttgcaactcctgaaactgagttcacttattcaatactcattgagaaacagtgactctcaacctccttcaggcggcctcctctgttgcctctgaccactgtgctctccttcttcattcctgcgttgactcgccaagggcgcagcgctttcgctttgaggccttttggcctaagtttgagggattcctccaagttgtgcaggacgcctggcaacctcctgctaaccttccccccctccccgcgcttgcctggtgtttctctaacacggctaagcgccttcagagctggagtgatcgtcacgtcggtagcgtccgcctccagctgcagatggcgaaggagctcatcttccgtctcgatgtcgcgcaggagaaccggtctctctcccccctggagacctggttgcaacgagacctaaagttgaagtcccttgggcttgcctctcttgagcgcaccatcgcccgtcagcgttcgcgtctgctttggctcaaggagggtgacgccaacaccaagtttttccaccttcacgccagagcccgaagacggaagaacttcatctcacgtcttagagacggggactagcttgccgtcacccatgatgagcttcaagagctcgcctcttctcactttggcgccatcatggggacgtgcgttgagcgcgagctcgctcttgatctccactccctcggcctctgtccggcgcagcttggggagctggacggccccttcaggaggtgtgggcggtggttaagtctttgccttctgacaaggcgcttggtcccgatgggttcacgggtcggttctacaagacttgctagccagtgatcaagtcagtggttttggcggctctcaactccctcttcttggcttacggccagggtttctcctccctcaatgatgccctcatctctctccttcctaagaaagatgaggccgttgacgttcaagatttccgtccgattagcctcattcacagctttgggaagttgttctctaagattttggcctcccgtctttctcctctcctcgacgggcttgtggaggccaatcagagtgccttcgtcaaaggccgatctcttcatgacaactttcgctatgtccagctcgcggcaagggctctccatgccagacgcactccccgccttcttctcaaggtggacattgcgaaggcttttgacacggtcagctggccgttcttgcttgaggtgcttgcccatctagggttcagtcaatgctggcgtgattggatctccctcattattagcgcctcctcttcccgggtgctgatcaatggggtgccgggtccgcgcttccttcaccggaggggtcttcggcaaggagaccctctttctcctatgcttttcattctagtcatggaagtgctcaatgcgatgcttcgtaaagcctctgattcgggcgggttccttccgcttaatgatcgcgctttgcgacaccgcgcctccctctacgctgatgacttggtcctcttcctctccccggttcggcaggatctcgagttcatccagggcattctctcggtctttggtgcggcatccgggttgcgcaccaattttgccaaatgctcgattactccgatccgctcctcggatgaggacctggagctggttcactcttgcttcccctgctcgatttctgattttccttgcacctacctcggcattccgctgtccgttcgcaagttgccgaaggcggctcttcagccactggtggacagggtcgctcatcgcctaccaccttggaaggggcgtctcactactcttgctggtcgctccatgttggtccagtctgttctctcctccattccagtccatgtgtctatggcaatcggccttcctgcctgggttgttaaggccattgacaagaagcgacgcgccttcttgtggacaggtacagattcggttcatgggggatagtgccgggtgtcctggacgaatgtctgtcgtcctaaggccttcggtgggttaggaattcctaacctcaggttggcagggttcgccttgcgcgttcgctggctttggcttcagcgttccgggcatccctattgggatggcttgaaggccccggtcgagcagtctgtctccgacatgttcgaggcgtccaccttcttcgtgccggaggatggtgaatctatgctcttctggactgaccattggattgatggaggccactcagtggcctccttggctcctgacctcctcttcgctgtgccacagcgcctccgttcgcgcacggttgcttctggtctggcgaacaactcctgggtttcggacatccgcggggccctcactgtccctgtcatctcccagtttcttcttatctgggatgctgcgctccgaattcagctcttgccgggtgtcagagaccgtcttgtttggcgttggacgagcgaccagcgctactctgcgcgttcagcgtaccaggccttcttttttggccagcactcctttgcctgtgccgatcttctctggcacgcgaagggccctgctaaatgcaagttcttcctctggtttgcattttagcggcgctgctggatggccgacctcctcctaaagcgcagcttggatagtcattcggcctgccccttctgcggtcaagagcttgagacagcgaaccacatcctcctcgattgcgtgttcgctctgcaagtttggctccgtgtgctgtcgcctcttggttggactgcctctctgctctctggggtagctgtctccaagattggtggccttcttctagggtttgcttgccggggcatctccgggccagtttcgattctatggtcctcctagtctcttggcaactgtggaaagagcggaactccagagttttcgactctgcattgtcatcggtctcggaggtccttgagtccatcctctctgagggccacctttggtctttagctggtatcgctaattttggggttctcctgggaaggtagtggctctgccccctccaagctatttggagttgtgtgtagccgtcacagtagtcttttgtctcttctttattttagtcttttttctcccctttcttggtataagtcggtctgactgattgcgtcatgtaacaaacattctattcttctgatatattgacgtgcaattcttttgcgcgttcgagaaaaaagaaacagtgactcagtgaggcccataggaagatatttgatcaagctctaaattcaatagtccctgacaggttcccaggcatagaactttattcagaattttggacgattgcctcaacaaactttgaaaataggtaaaaataccaatatttactggaacctccattcccaaagtcccaatctacaacttgcaataaaaaccaggcgattacagtttctccccgaaaccaagtaatcctactgaccaccaggggagatgcaatgcatcgcaagacataactgtcggaatccccaagcaaaccgcacaaaaatcgcatcgcatgaatactagcgcgctatgatcctaccagtacacagagcacgagtatggaaggctagttgttgatgacttgagatctgcgaagagaacgaacagagcgagggagattcacctgggaatccccgcgcggtggaagactgcgaatcgctctccccggcggctcgccgtcgccgcctcgctccgccgccgtcgccattgggtttaccggaagggcaaacacgcaatatcaaagtacacgaggggtctacgtggaaaagtaccaaacaaatgggctggactcacaatcaattacggcccggcccagtagataccaccacctcacactccattcgcgaggcccacggcccaagtgacgcctcctaaaccctaatcctggcaacggacggcggatacagcccacctcctccccccacgccgcatccgacgctcacgaagcgtccacgtctccccgacgattgctttataaaaccaccacctcctcctcgcaccaccagtcgccgccttcttcctcctcctcctccgccgcccgcctcgccgcctcccgagagctccaccctcgcctccggcgaaatggtaagctcccgtctccggtgccagttgccccccgcggttctcttcccgtggatcttgcgatccgccggcttagattttttttttcttcagttgcagcgtcgatttgtagctttgtattttgtgtgtgaatattgggatgctctaagtaagattttggatggcgaatcttgcaggcaccgaagcgaggcggcagggcgccggtgccggcgaagaagaagacggtaatgctcgccgtctctctgctcgaaatctacgttgtttcgttgttggggggcttgtgatttacttggatgttttgcttggtggttcttgcaggagaaggtgaccaacccgctgttcgagaagaggccgaagcagttcggcatcggcggcgcgctgccacccaagaaggatctgcacaggttcgtgaagtggcccaaggtggtgcgcatccagcgccagcgccgcatcctcaagcagcgcctcaaggttcccccggcgctcaaccagttcacccgcaccctcgacaagaacctcggtatatatctacatctcagttcgttcatcatgtcggattgcacctggaacgctaattggccgaactggttaggtgttacaaatgtcatttccttgttaggtttgtaattgtagtgactagctgatgaatgtgtcttcagtttatgatgaccttttgggtgttctagtcgaacatagttatctcaaattaatgctggctgtgtcggtattcttgttggcatggtagctctctgtccaaattttattctaggatagaatgttaaccctgtgtcaaaagtggtgcttttaagaatggaaaattgctaaagcagactattgaagttttgctgcagtatatggtggttgtcagtttttatcatgtttctgtttgtttatcactatgattagactcaacgctgtctcttcaacaccattgttatgtaggatcgtgttatcaatttcttagttgttaccatttcaaaaatgaagcaaggaaactcatctgttaaattgttaatttgtgttgaggaattaatggcataaaaaatatctgatgtaaatctttatttgcagcaaccaacctgtttaagatgcttctcaagtaccgccctgaggacaaggctgccaagaaggagaggcttttgaagagggcccaggctgaggctgaagggaaaaccgttgaggccaagaagccaattgttgtgaagtatggtcttaaccacgtgacttacctcattgagcaggtacaggagcttgttaatgtgttcatttctttgttagtcactcatcaaggagacttattcatgggaacatataatcaagcactttactgataatttgaatgcttctcgcgcagagcaaggcccagctggttgtcatcgctcatgatgttgatccaattgagctggttgtgtggcttccagccctgtgtaggaagatggaggtcccttactgcatcgttaagggcaaagctcgccttggatcggtatatttcctgactctccatactcaaattgaatgtacttattgaaagtatagatgctagtagaaagcggagctcaaccttcgcaaatgatcatatgcagattgttcacaagaagactgcatctgttctgtgcttgaccactgtcaagaacgaggacaagcttgagttcagcaagatcttggaggccatcaaggtaagaaaccacggcatcccttgttctctcattcatgatcatcatgttatccagtgctctgctctttagcctcattgctaactcggtgaaccataactttgtaggcgaacttcaacgacaagttcgacgaggtcaggaagaagtggggaggcggcgtcatgggctccaagtcgcaggcgaagaccaaggccagggaaaagcttctcgctaaggaggccgcccagcggatgacctaaattatattcgccccccgccgttgagctcgccctgtagtttcatttttcagtgtaatgattttgacgaggaactcagttagcaccatgcgacagtgctgtggttttctgaagtctagtttcatatattttctgttcaccggaccatgttgggaaactatgcaagatatcagagctttacaatgtttggtttctacgcagtttatgctgtgtgttttgctactcgtttgtttgccttggctgaacctgaacatagggcttgatcactttgatgccattttcagccttatcaaattttggtaaagttacctaaaaaaaagtggatatatttagtttgctgcctaattttggtaatgttaaattttggtaaggttttttttcatcaaagtaaatagccccataaagttcatttcacagccttacagccatttaatttaagcaaaattatgaaagctaacatgttatttttttaattttttgtaatgtcgaaagttcttggtagttttgcattagttgaaagtcaaagtcatacgaaaaatgtcaattttgatggatatacataaatctaagatgcgagctcgcaaaaaattccgaaaccgtaagtttatattgggctagtagtaactctagattaggcctagcccaatttggacagttggcccaagattttacttggagctcaattatggaataagttcaccggagatccctcaacttaacagcgagattttttgagatctcttaaccacaaaaccagaaatcttcacctctaaactatacaaaaccgttcactcaaggtccctaggcagtatatatgagtggtttcgctgacgtggcatcctagttagccaaaaaaatttttttcttctcttttcttctccttctcttttctctcttctctatttctcttctttagtgagagaggccagcggcaggcgcgcttctccttctcttctcttttctctcttctctatttctcttcttcagtgagggaggccggtggcaggcggagcaacgcacgcagatgcgggtggcgcagcagagggcaagcgccagcggagcggcggcgggcgcaagcgcggcaggccgagcagtggagcgcgagcacgaccgcgggcagagaagcggagggcgagcgcggcggcgggtggagcggtggagggcgagcatggcagcggagcggaggtgggcgagcacggaggcgcatccagcccaccccaaccgaccaaagcacaccctttgccctcggccataagccccgccgccaagtcgccgtcgccgtcctcctcgtcgtcgtcgagcggcagcgatgacttcgcggtgctcctcgacgcggagctcaagctcacctccgccgctgactcgacctccgccggagacgacgacttcgaggaagacccctcccagccttccctccttcctcctcgagctccctcacgccggcgcccacgcagggatgggaagctaacagtgctggtcgtcgtggtcagctcgcttgccgcggcaacgctggtcccggcgctaaccggctgatgcgtctgcggatcgatgccctggctcatgagcttgcgcttgatgtgctgttccacctgcagaaccaatcaatcagcaccaagaacacaagaagagctaaccggagcagatgacaacacattgaaatttgttttgcttacttgttgccgagaagggcatggagcttgatggtgagctcgtagtcgtcgtcgatgaaagttgctgcacttgaggtcggggctaaggtagttcatccagtggaggnnnnnnnnnnnnnnnnnnnnnagcagcaccatcgccttggggagggagagagggtcgacagggagagcgcgccgctcgtcgggcggcggcggggcccgtggtcgagcacccagcacattcgaacatctccgccgccgagctcaccgttgcgccgaccgccatctctcttccgctcccgccgccgccatcgcatcgaccacctctctcttcctctccgccgccgccgtccccgctccccgccgaccacctctctccccccggtcgccgcgcttgctcgagactcgagagaactcggagagaagagaagagaaaaagaaaaaaatacaaagaaatgtgagacccacaccattgtctcacttacatgtgggccacacatattaattttaatttttttttgctggctaggatgccacgtcagtaaaaccacccgtatatactgcctagggaccttgagtgaacggttttgtatagtttaggggtggagatttctggttttgtggttaagggactttaaaaaatctcggtgtaaagttgagggacggccgatgaacttattccctcaattatttcccggcccattatacgcatcagcttgtcaccggcaggtgggcctgggtcccgtgtccccacgtgctcctcactcgcttctcgccacaaagtccaaaaagcccacgagatcaagccgttaatccaacgtaaagacaagttcccgtgctctctaatttcctcttcttctgatctcgcaaacaagaaatccccgggaaaagagaagcggcgggacaagatcgccagagattccacggacggacccaaggtgagcaagctcgatccatccccatcaatgcctgctcggttcgatctcgctacttctggattgcgccgggcgcgtgtcgctggtcgaatcagccggttttttgggtggaaagattacgacttactagtttggtttcttgtttaagatttgtgttcttgggaggaggcggagctactcaggcttgctgggagattgctcgttgtttgtttctgttactgcggttcgatgcgccgtttgtgattcgcgtgttcgttactggattttgcttccgtggatggcggacaaagggcatatcgcgccgattcttggagagttctctagatctggcgggaatgctcggctccttgatttgccactgctcttatgccccaattagatgggaggttttagctcttaccctaggaggatttgtgcatctgttgcctgctacagttaggtcatgggaagtgcgtacttcttcagtgatgtgggaattttacttgtgcgtctaatagtgagaatgagacaaataatttgtgtgtatgtgctaattcacgtgatttttagtaattctacctttgtattttgtctctgcattgtcgtagggagtgagtcagtgagctatttcttgaataccgcactatctacctgctgcttgaatttgaaccctttaataactactccctctatcccataatataaggcgcatacacatttcaagattcaacatttaaaacatttaaccaacacttagtataatattaaatgaattttatttgttaaaaaatatatcattagattgaaatttaaattactttcatatggttataattttgttgctacacttagtataatattaaatgaattttatttgttaaaaaatatatcattagattgagatttaaattactttcatatggttataattttgttgctacaaaccttctaggatatgagaaattataagttaactttgaccatgccttatattatgggatagagggagtatatagtatgtgaatttgggagactgcagttgtgtgttcttatttctcttaagctaataacctcactcgtctttttttgggtagaatgttacagctatttgatagtagttctgtaatcctatgttgatactgtctaaattctatggctttgtgtttcttgcagtaggacaatggaggggagtttgagattggggtttctgttggttctatgtatcttggccttcttgcgccctgctgcagctattcgcttcgtgatcgatagggaagagtgcttctctcataatgttgattatgaaggagatacagttcatgtatcctttgttgtgatcaaggcagagacgccatggcattataccgaggatggcgtggatcttgtggtatgatcttgtttttctttttcttacgtccaatcttcatccatgtaaatactccacaattgtagagtgtggtgagattcttgctttcattttttaataaggaacaatagctggctagatatttccgttcttgtagtctgataatgggcatggaggattgcatatggactccatgttttgtttgatgcttgcatgagcccttgagaactttccagttatgccgcatccaaaactgattcaactttgatatatggcaggttagagatcccaatggtaatcaaatccatgattcccgtgacaagatcagcgataagtttgaattcatagttcataggagaggcgttcaccgcttctgcttcaccaataaatccccataccatgaaactgtagattttgatgtacttgttagtcacttttcgtattatgaccagcatgccaaagatggtaagcatttttctggttttgttaaatttgtctagcaaggagcatgtggttgattcctttactctggaaatatgtagaacatttcagcgccttgtttgagcaaattgcaaagttggatgaagccctctacaacattcagtttgaacagcactggttggaggcccaaacagaccggcaagcaatatgtatgttcctcgtgtcttactctctcctttaaatactagtactttttcgaaattgtaatatgtgaagatctcttgttttcttttatcttgtaataaatagaacttatgagttgtagcaaatgctcaacttttctgtttctgtactaccgacaaactgtcctgccttaggagctccagccttttatgtcaacctttggaccagaccgccacacatgccacattaccaaacatcttgaaattgataaatatttgttacattgatgaacaacatgagaacacacaccatcttcttttctttttcttttttttccctttttttttgtaaatatcatgttctgtcaaaagcaaaatttacagtatctcataaacgtgttttgatgctaaaactgtaatactatatttgtctatctgatgcagtaaacgagaacatgagtaggagggcagttcacaaggcattctttgaatcagctgctctcattgcagccagtgttgtgcaggtctacctactgcatcgcctctttgagcgaaagctgggaacatcgagggtctaattctctgatagtaggtctccttagactcaccaacccaactgtatttcaatgctgcaaaatgtgtttacaatatctgttacatcctgctcagatatttagcatttttgttcagaattttgtaattcagttatttacagtactgtgctgcagtaacttgccgcctcatcagattcatttcagcgcattatatctatcgtcacatgtatattaggtcctaagtatttccacggtacgcactgctttaaaaccttttttgcgatcaaggtacaggagtgctagtattgagaaagaaaatgaagaaagaattccttttctgacaaagactcctaaacttcagctcatcagcattctactttagtttcacaatttcagaatccatatttcgatgataaccatttagtatgaagtattcaacgtttattgagcctgtattatttctgtatttagctgtctggaggtagaaaagctcagacgataccaaatccaaggagatgacaccaaattggtttcttgctaacatcacaccatctgattaggatacagttggaagccatgtgcagtctggttggtcctaaattcttttgctgactggattttttcgtgttatggataatgatttcacaaataatgattggcactactgcttgagccgataagcataacaactctggtattcgcatttcaatgtccagtttggttggtacatggagtcactgacaatcgagtttggaatctctgaccaaacataacagccgcccgtgacacgtatcaacatcaaggatgataaccaataatcttgaatttttcagtaaattctgcctgaagcactgtactttgtaaagttgcatttcagatatcagcacttgttctctgaatcagttgtaactttgtcagtaatttagtagcctgaagccctgtactttgtaaagttgcatttcagatacacgaaatcaggcatcagcatttgttctttgaatcagttctaaacctgtgaaaccttttcatgagtgtgtgagctccaccagaacactacctcactgttcatccacagttcatgctgctgttattaagctcaacaaaaaccttgatgcagtgatgattgcatagtttcaagggacaaggccatcagtctctggatgaatctgaggctgaaaaccgggtcaagttttgtcatggttcaagagaaacgaatgccattgtttgttcagtttaaatcttagcttttacagaacaaatcctaccaaaatgtacacaaattcataaatattacaaacttgttattagattttataaacttattctgatataaaattgatggttggaattataaatatttcgattgaatcatatcctaaacaatcatatcataaacatcaaatatttaggcctgtttagattctaatttttttcttcaaacttttaacttttctgtcacatcgaactttattacgcacacaaacttttaacttttccatcacatcgttctaatttcttcaaacttccaattttaacgtggaactaaacacagccttatatcggaggaagtagttagctaacaccaccttgcaatttaattaatactatacaattatcatcaacaaaaagctcttccacctttcactcttccccactgcccaccactgtactgtacccccaccattcctgtctcttctcttcttcactccactccactccac

SEQ ID NO: 17517 - DNA, 24563 bp, Oryza sativa
caaccaaccctcgtgttcttgattcagatttcaaaccggaattggaggcgtcagagtttcagagtcgcacttgcaccctcatattttttggttctaggtttcttgatttctttagtaattgatagcctcggtttgatttcggcgagtagttagctttgcatttggcatttgaaaatccttgcaaaattttagcagcttttgcagcttcagagctgcttgtgatgcactgaatttttcagcattactctgcattaggcatttgcatacttgcaaagcttacaaacttttcagctgctttcctgatgcattcaggattcagcttagcagcatgagcagcatgagggtctctgaattttcagcattaatctacatttaattgcatcagagatcatgtcaaaatttggtttgttagtctcagggaaaggagagaaaagctacttcctccgtttcacaatataagtcattttaactttcctcatattcatattcatgttaatgaatctagataaatatatatatgtctagattcattaatatcaatataaatgtaggaaatgatagaatgacttgcattatgaaacggagggagtagtagtacgagataatgagagattaacagtagattaatggtacgaaatggcaactggattagctccaaatcacgcactcgtcgcttctgccatgtgactgcacgacccttttctgtcaactgggctgcgtaatcaaatgctcacgacagatgcttctctgaatccctgctggaataccaggcgccacgttgtcgtatccgatgtggcggacacggaattccgtgccgtccacgtcatcattcctcccatttcatgatgatttcatactccgggttatttagatcgatgtcatttcaaaccatatttttttataaagttgttaaatatatacttccatttatttctttatcaaactccagtaaatacataagaaatcatacaaaaatttgataatattgttaaaatttggtaaggtttattttggcttcagtttaaacagacctttaaatttttgataggtgtgcaaatgctttgatcactttgaaaattgaagttacgtacgttttcaattggcactgaaattattttgggggaattttaaccttttctgacaggggtgtgacgcgtcggtcatgatcgcgtcgcggggcaacgacgccgagaaggactcgccggacaacctgtcgctcgccggcgacggcttcgacacggtggtgcgcgccaaggcggcggtcgagaagaagtgccccggcgtggtctcctgcgccgacatcctcgccatcgccgccagggacgtcgtcgccatggtaaaccatcccatcaatcctcctcctcctgccatggcgaaagctttgctgcctctaacaaggtcgatcaatcaatcaatcaatggcgttgcagtcgtccggcccacgctggaccgtcgagcttggccggctagacggcctcgtctccaagtccggcggcgtcgccggcaagctgccaggcccggacatgcgcgtcaaggacctcgccgccatattcgccaagaacaacctcaccgtgctcgacatggtggcgctctccggcgcgcacaccgtcggcttcgcgcactgcacgcgcttcgccggccggctgtacggccgcgtcggcggcggcgtggacccgtcctacgacccggcgtacgcgcggcagctgatggcggcgtgcccgcgcgacgtcgcgccgaccatcgccgtcaacatggaccccatcaccccggccgccttcgacaacgcctactacgccaacctcgccggcggcctcggcctgttcacctccgaccaggagctctacaccgacgccgcgtcgcggccggcggtgaccggcttcgccaagaaccagacgctcttcttcgaggcgttcaaggaggccatggtcaagcttggcagggtcggagtcaagtccgggaagcatggagagatcagaagagactgcacagctttcaactgaacatagttgcatagctgcactgcgacatttgtaagttgtagcaattggggatttgatcgtatattaaaaatgaaatcatttcaaggtaagaatttcatactttctgttttcggtccagaagtcatggctgagtgatgaaagcgacaaaatgcctcttaagttaactctacaattaaattaaaattcaaaatagccacagctgaaaacaaccgaaaataatttttgatcgtttaagccacggatgataagctactcttgttgtttcaaattatttgtcgttttaggtttgttctaaaccaaacatatctatatttgactacaaatttttagaaaaccgtataagttaacaatacatgaattatatattatgaaaatatttctcatggtgaatctaaaaatataaatattgagatgttaaactatacgagtttatagaaattaatgattaaatataaaaattcttgacttagaacaaaccaagcaatttaaaacggatggtaaaaacaatttatggataaaaccttttattaccattcttaatagtttgaaaagccaatacccaaagataaacttcgatgcaaatatctgaatcaacactaaaatattttagttttaaaatttaaatgttagctacggttaataagttaacaacagtctctctctctctctttctgtctgcgcaacggcatgcgcaaatctgacgttcgcagccgcttgcctgacgttgatacgtgtagcttcagaaaacaaaactggcagagctttcttgtggtggtagggcaatggccactgcttgcttcctggggttgctctcctcttgctttcaagacccatacttttgacctaatcacccaaacctttccttgctgttgtctgaacacgggccatcttgggacctactcaacgcttccagcatgcatggacagttgccagtagcaatcagatgctactaaccattttcaggttcagatatcagaagatatacagagctttcagatcttgctgtcttaacaaggatccaggtgttaggtcatgtccagaatgcctgaattcataccgaaatactatcccgttctaaaatataagagatcttgaaagtgcaaatacattgccaaaatccctttatattaccgaatagttcaattatggcatgaatcaagaaaaatcctggttcccaaaacagagcccttgagacagagtaaccatcctaaccaaaacagaggcaacagagcagctccataagattggagacaatcagtctgacagtgccagttgagcaaaaacaagatacaaaccttgaaggaaaagaactctccaattctgaaacaattataggatagatgtaataaataataaaaccaaaccgttctttttccatatgtacaaagttttctgttaaagcttgccatcctaattataatatataaaaccatctaagcttgttgcggcgttacatggtaaaaatgttgtccgggaaggaaaagataggatggcaacaacgtaatgccgcccaaactcttctgcttgtatacacctccatgagaacctacttctcattcaacttcacatgtaggacatgaatggaggcttggaaaatatataccctgccagaagatacaatccaaagctcttgttatacgataacgttggaaataggtatgaatgcaataaagacaacaactcttaaaagcatgatagtgatgataatagtgatataggcatgatactgtttacagtcagtaggaccaagaaaggaattgcactgatatcatatttgaacttatttgggttgtaatagctgatcttgatggtgaacttaatacatccgcattaatttaccacagaaaattgatgtagaatactgttcgtttgtgaggaacaagcacatcaaggttggcagggaaattgaggttcagcttcacctgtattacacccatataaagtattttctaatttcaacaattaactagctatatcaatttttctagatgcattgacagtgaaatcttgaaaggtgaaaggaatacactaggtcaagcttaactaggctattctattcttcctgggaatctaagaaagctcttcttctcgattgtcactagttgcatttagttcctctcaagctcctttgttcctaagaaactcagcttgtatcccgtcgaaacgaacaaagttataaacttaagctttctggtctcctacttagcaagcacgaaagcgctcaggcatccatttcattgttatatggccctttttgactctatatgtttacagctcctttccccctttcagttcatatggtcggtgctcaccgacgcaatttagtcccttacgccctttcaatatcgaatttcatcaacctgaagctatagccagcctctctacatcaaattagagatccaaaacatttgagaatcatctggattgcatcgacaaccaccaattctgaccctttccacttcttaccatcgcgtcaattttattttaactacgacaacaagctgctcacattatttggaatgatgtcctcccgaactaaatcaacgcaacaatcctaataaaaccacaatttaaatacagaagctacacatatctcaattttcagagaagcacccaaagtatgacagatgcttcacaattgggcataatttaagcaaaggcgctcaatttagcgcattttgaactctgataaagccaagaaacaccaccaatcatcatatttaccccccaaattacgcatgaatccacagtgaattccccaatcctgactaacccaaacatgtaaaaagaggagcctcttcccttttgtccccaaacatgtaggagccctactcctaaacggccaagatcacgtacatgtggaggccaccttgggcgaggaggagcacgaggcgggccagaggatggccctccagatcacggacaggttggtgacgaacccgacgaggaggaagacgcaggcgaggccgatgacccagggcatgaggaagaaccccagcatgaaggtcaccgacccgcacagcatcagcgccaccgacgcccccagcagcatcgacgccacccccgccgccgtcacctgccgcggccacgccgccgccccccgcccgcccccttcctccggccacgcccggagcaccgtcagcagcagcgcgcacagctcgtacatcgccctcgactggtcagcctccgccgcctccgccgccgccgtcgccgacgacctcataccacccccaagaattcttcaagaatcgaattcaagaaatcaagaaccgatcgcctcctcggcggtggcgcaagaatcttggaggaggcgaattgggtcggagaaattggttgtcgggtcgggtttgcttctcgatcgctctctctctcgcgttggtggaattgaaatggcgagatgggggaggagagacatggggggagatgttgaaatagaggggggaatgggaaattgggaatgggcggagacgtctacgctacgagaggataatggtaggctggatttgtttattcggcagttatttccggtgttggcgtggataactgtgcaactgattggttgcgttggcggtcaaatttgcactagcacttgttgaatcacaacgtttcaagtttatggaaaacacctcaaaatttgtactccatgctcgtaaaggaagtcgtttagaacagcaatacggtcttcaaaacacaactttaactttttgtttctataaaaatatttattcaaaaagtgatatatttatacttttataaaagtatttttcaagaaaaatctatacatataatttttacattttcaaattcaacaacttgagagttattcatgatttatatttctaaggtttgatttaaacattgtcctaaacgacttcctttatgagtacggagggagtacttctttctctgtcccaaaactacttcaaagtttattgtaatattttaagacaaatgaagtatactatcttcgattataaatattttatgtttggagtaagacacggtcggacttttgataaaacgttgacgatcattagtttctaaatcactattttttaaaaaaaatgatatgaaccgatttggcatgaaaaatattattatagtactatgggtttattggatctgcgagtttattataacatgaattgaatgtcgaggtttcagaaatttaaccacctctcttctcttatggtactccctttggtttaaaatttatggatgttttggacagaatatcacgtactactccctcctgtgccaaatgagttgacgttttgaggcttaaaaatattataatagtactatagatttattgaacatgtgaataccactctcctatatatagtgctccctccgattttaaaattattgatgttttgggacagaaatctcacatatcaaggaatgattaattgtgacgcttctctccggtgtcaaattagttaacgtttggacttgggaggcttgaaatatattataatagtactatagatttattgaacctgtgaataccactctcctatatatggtgtccccctccgattttaaaattattgatgttctgggacaaaaatctcacgtattaagaaatgattaattgtgacgctactccctccggtgtcaaattagttaaaggcttgaaatatatttcaatagtactatatatatttattggacatccaaatttattataatgaaattgaatctcaaggttcataaatctaaccacctctcttatatatggtactccctaattattgatgttttggataaaatctcacaatgccaaggaatgattaattgtgatcctactcactcggtgtcaaattagttgaagtttggaggcttgaaaaatattataatagtattgtggatttattggacctgcgaataccactctcctatatatggtgctcacctccagttttaaaattattgagatttttggacaaaaatctcacgtatcaagaaatgattaattgtgacgctactccctccggtgccaaattagttgatgtttggaggcttgaaatatattataatagtactatagatttattggacatgcgaatttattataatatgaaattgaatgtcaaggtttcataaatttaatcacctctcttatatatgtactccctccagtttcaaaactatttgatattttggacagaatctcatataccaaggaatgattaattgtaatgctacacctccgatgtcaatttagttgaagttggaggcttgaaaaaaacattctaatagtactatagatttattggacttgcgaatttattaaaatatgaaattgaatgtcagaaattcaaccacctctcttatggtactccctccggttttaaagttattgatgttttcgacagaatctcacgtaccaaggaatgatttgtgatatgctactctctccggtgtcaaattaattgatattttgaggcttgcaagatattacagcagtataatatagatttatttggacctgcaaaattattatgatatgaaattgaatgtcaaggcatcataaatttaaccacctctcttatgtatggtactacctcctgtttaaaattattgatttttttttgacataatctcactatcaaggatattatatttgttttttatgggacggaagaagtagatcgcggtttacaaggaaaatgctggcacaggtcttaattaattagtggtatctcctgttctctgcaccctttggtaattttgacgacgcagtgttatgcacaaaacacgtggtgatatggtgcatgtgcattattatcaatcgtctctattcttcatttcagagatggcttgctcattcgtgtttcggacagtacgcaactccctccaattttttttttaaatctagcattataacggatgaagtaacaggaattataagctaatacacagcaaagatctgccgaagtgcattgtttttttttacaaaaaatacttatatattctaagagttaagtgtacgaacgggctataaacttgtgtgcagatatattatctagatctctaaattcttaaaatatattttcaaattatcaaacttgttttggatataatatatgatcaaatgagctttatcctactccatacggtgatgtagcatgtcatggtgacttttacagatcattagtattttttaaaaaaaaaacatgtttttctccttttaggtagagaggacaaaagataaaataaaaaaatattgaaaaaaattaaggtggagaggagaaagctaaggcgagaaaagataaaattaagaaaatactattaacgcatagctaggcatcactttgatatgtcacgtttagtatatcacgtcagctcatgaagtagagtgggttggaattcgtttgaatctatatcgacgtcgcaccgaagacaagttcagaaactcggaaatgtattctgaaggtttaagcatctagctagatgatatacttagggaccgtccttgtctaatataatctaattaatatatgatctaaacgtgcaacgcgagggttggagttgttaccatctcgatctatggtagtgttacagaatgcaagctggagcactgattgcgatcgaggtacgttgtttataatataatgtaccccgatctagcttgattctcttgtccttgttgcaacgtgttacacgcgaggaagtcccattcggtttgagacaacgatgatgagaggagacagtagcagcaggtacgcgaggaaatcgtgggcgacgacgtacgtacgggtgccgccgtgcattaatggctgcgacatattgtactacctccgtcaaaaaaaaaaaaaccgggtttccgtgtccaacgtttcaccgtctgtttaattttaaaaaattatgaaaaaaaaataaaaagacaaatcacgcataaagtattaatcatgttttatcatctaacaacaataaaaatactaattataaaaaaaatttcatataagacggacaatcaaacattggacaccgaaacctaaggtttgtctttttttggacagagggagtagtagtagtatcgttctagatagtgctatatattgagcaagtttaatagtatagccaactattagctctagttcatctatagccaatttaatagcttatttatacaatagttatatactacactattaatatatggtcccacatctcatacacacacaatgtattagagtctgtgctgcagctggctacaaatctgaagctcgctttccttctttctctactgcacatgtgcttacaggtgacttgtagcttgctactgtactcgctcttaggttgtacaaatagtcaccacaggattagtttccgggcaatccggggcaacgcaaactgtgaaccgcgctggatgtgtacgtcgttgttgcttgcacatggtgataacatgggcatactttgaactcgggttgcacgtactgagagcatataagtgggtcgatccgtgaatctacttatagcctcaacgtaccgatttggtacaactcgtcaggaacgctacgttcacgccaaccccgcatttcgatcagcttgtagccttgtatcctcgacgtaccgatttggtacaactcgtcaggaacgctactttcatgccaaccctgcatttcgatcagcttgtagccttgtagcctcaacgtaccgatttggtacaactcatcaggaacactacgttcgcggcaaccctgcattttgatcagcttggtgacgaaagcgtgcgtttacgacggttgtgttcggtagtttgagttgggaactaattaattcctctcacatgtaaaagggaataactcattagtttatgattaattaagtattagataattgtttttaaacatagattaatataattttttaaaacatatttttaaaaaaaatacaaggttggcaatttgaaaagcgtgtgtgcataaacgagagaatagagttgagaacttagtgcctcttagatttgcatgaataatgtaggatttttggaaaattctaatcctatggaaaaaaattcttatgaaaggcatttaaataaaggattgtatcctatcatatcatttaaaattccttttgagtctttgtctcttattcaattcctataattttttatgtagttcaatcaaacggttattcttattttttttataatactctattttacaattacatttctactagaatcatattcttttattcctattttttttataattcttatgattcaaggggactttagggggtgtttgggaactagggactaaatttagtctctcgacttatatttttgtgagagggactaaagtttagtcccaatttagcccctccaaccaaacaccaccttagactcccagacacagccgaacttgccaatttgggaaggctgccgtctgtaggaattaactgccgtccaaaaccgcagatcgatgtcagtgtttggtgatggtctcgttgtctgaactctgaactctgaagccgcggccgccggtctcggtctccagacatgtgggttcccgccggagaaagtgcaaactgattctagtgcttgtcgcgaagcgtgccatggcgagcgagctcgtcggagacgacgaggcagccgtcgtcgtcgtcggccgccgcacgcacgcaatcccgttccggcccaactaatgattagccggctgccggcccaatcgacatgggccgtatggcccgagttactgtttgctccatcggcccggcccaagctagcaatcccatatgggcccgagttgcgtccgatctatatatcgtgcggcgaagatcaaagggggttaactgcaaaaatacgcacgggctggccctacgttttgatggcagttttagtgcagatgaagtggatgattcttggattcagatttgtttcatcgagccacctgaagcgatgcacaatccagcttggagatgaagtctatctgttggagttttgcctcgaaatcgcacggggagtaacatcctgattgcactctgttttcaccataaacattggggaaatttgaagcagtgtcttatattttcgaaagatcaatgagaatgcttacggttttaattttttcgcttatgcttatacttatcagtcatgattttttttggcaagaatattaaacaaacggaagatcccttattcttagggcataatatgtagtgtttggttcgaccagtccgatcaaccagccaaacaaaacttcagtttagtaactgcagtattacaatcgatttgtgggaccagcaaaaaagaatcggccaatcactagtctgtccttcatgcatgcatacacaacaaataattttttactcgttccattcgattctaattcgaagttcaatttgtcctctgataaatacgattcgacagctacaaatatacattgttcaatatacattaaaattgatttaatgttcacactgaagatgctcttattcaatattaaaacaattgaccaatgtggtcactatgtttacaaaattaatgaaaacaaacttcccaaatcccaacccttatagtaatgttttgacacatgatgactaagctgttggacgttcgtcaccatgaagtataagaacaacaagtttttagtagttttttttttttggataacacaagtttttagtagtgatggcccttggtgcggccgcaccccatgatggacgccggcagccgcggcagcacgtcgacgccctcctcgaacaccacgcccatgcccatgtacacgtgggcctccaggtggcagtggaacagccacacgcccgggttgctcgccctgaacctcaccgccgtccaccccatcgggtgcagcgccaccgtgttcttcatcacggcgccgcccctcgcgctcgccgcgttcagacccggcccgtccacctccggcacgaacttgccctcgccgtagccgagcacccagaagtcgtgcccgtggaggtgccacgggtgcgtctcgctccgcccgttcggcggcgggatcgccgtgttctgcagcaccacgtcgaccaccgagcccagggcgaggcggtacgcggcgtggcgcacggcgaggctcgccggcggggaggagaggttgaggctcccgtggtcgtagctgtccggcggcggccgctggtcgaactcgccgcggaggccgtgcttcatggcgacgaggtacggcgtcgccgggaagctgagggagacgccgttgatggcccacttggtgtggttgtcgatcttgctctgcgtgttgaggaggaggagaacgcggtcgggcctcgccggcggcggctcgacgtgccccggcagcgcgcgaacgacctgctctgcgccaccctgctcgccgtgtcgttccaccgtggcccggtcggcggcggcgtgcgcgggtgatccacggcgcggaggcgtacctgacgacggccctgcccggcgccgtcttggtggggtcgcggctgacgacgtgcgacgccgcccagtagctccgggacgggtcctggtcggcggtgacgagcacggagtaggtctcgccggagtagatgaagaggttcttgaccaccaccggcgtgacgtagtacccgtcggcctccaccaccgtcatcgtgtgcccctcgatctcgaagctcagcgacgccagcgacgtcaggctgccgatgcggaggcggtacgtcttccccggcgaggcggtgaacagcgtcggccacccgcactcgccgccaaacgcattgcacgccgcgccaccgccattgctggccgccggcggcgagcagttgaacacgcctctgccgttgatcagaagcgactggggctcgccgacgaacaccatggggacggaggcgaggccgacggcttgctcgtacacgctctggtgccaccagtccatgaggaggacggtgtgctcgccgtcgtaggcgaagggctcggcgacgccgtcgggcaccgacacgacgagcatgccgtccagccccgccacgcgctgcatgccgtagtgcgcgtggtacatgtacgttccaggctgaaaccatcacaaaaacacccagaaaatcaatcaaaatttgctcatccaaccatccaagcaaagaactaagcatcgatcgatcattgcacgtactccctccgttttagattataagacgtttgaccaagtttattaaaaaaatagtaataattttaaaccaagataaatttattataaaatataattaattattaatttcataaaactaatttggtaatgtaaatattactatatttacttataaaattagttaaatttgaagcagttaaaacatcttgtaatctgaaactgagggagtagctgcttaccctgtcaacgacgaatctgtaggtgaaggtctcgccggggaggatggggcactgcgtgacgccggcggtgccgtcagcccacgggctgccaatctgcgacgacacattgccgttagaacaatacccacacggacgaacacatgatcgccggcgagccggcgacggcgagggggatggaacgaagatgaagaatgacctggcggatgccgtgccagtggatggcggtgttctcggtgtcgagcatgttgtggacggtgacgacgagggtgtcgccctgggcggcgcggatggtcggcccgggggactcgccgttgatggtcacggcgagcttcctgaagcagtccggcgacttgtactggtacgtgatgttccacgtgtggtggtgcgtcttcgcctccgccggcgccgccgccgcggcggcgcacaggcacgccagcacggcgagccgccacgtcctcatcaccgcgcacaaagctgacgatcgagctcaaggattgggattttgcgacggatcagaggcttggaaatgatcggtttcgtgagcaatcggcgaggtgtgtgtgtgtgcgcgctttgtgctttgcactgctctgcctcgaggcatcgagtggatttatatagtttacgcgcgtcaaagtgggtgtgattttgcgcgcgcgttcataactgggggctggggctttactaccaggtcaagcatgaagcagctacagagctcaggttgaagcgttcgacggtgggccgggccgtggctcgtgtgcgcgtgtgggggcatggtacttcgtcagatcataagcgtgtgcgtggctgtgttcgctagtttcgtttcagttgggaacatctcccatgaaaacggagcggtacataagcgcgtgactaattaagtattggtaatttttttaaaaaaatggattaatttgtttttaaaaataactttcatatataatttttttaaaagaaaaacacactatttagcattttgaaaagcgtgcgcgcgaaaaacgggagagggggagttgggaacatgagggaaagaacacagtcaagtgggagtatctgatatttagcataagattttatcaagatcttgaaacattgactatcaatagtttgtcaattaatagtttgtcaataaacgttggcatacgtttaaaattaaacagaatattaagtactagtagttttataaactttaggctccacttgaatcactggaatgaaaaaaacggagaaataaaaaaaacacatgtttctaataagaatataagtgcaaaacaaaggactaccgaacgtagaaaaaacacagaaataaccatttgattagaccgcaggaaatacaagaatcgaatgagagagatataatcgaagaaagttttcaagaggttggagctcttgctaaatttcctccaaaatcattatttactccataggatttttgaaggataggatataattcaatcatttgtttcaaagaaattttcctacaagattaattttttaaaaaatttctctgttttatatctaaattaaatgggcccttattctattagacagatgaagttagagtgagtatatcgtgtcctaatgaacattaattagtagtaatcctatatatttctttatacttatatacgttgctcacttagtgcaattcataaatactatttctcttttttcttataaagccacattactttaatactagtttctaatacttatatgattaattaatgatcttaattgtgttcctctttttacaaaagatacatcgtctcaattatttgtagacttagcatggtcaacctatggatcatattgtctcttgtctcttataaacaacatcatctggatcaactattctaccgttcttaataatagatcaaagatgcatattccgtaacaacgcgtagtatctagcatttccatatactaattcgcggtgatgatttccatgacaaaatatcatgtttatttcgaggagtgtggtcaacgaagcgtagctctactagggtttcataaatgctacttcccctccgtcaaaatatattaactttacaatttatcttaaatagagcgtttacctactcacttatctcaatcaaatatagccatttctcatttaaatctacgtatagaagctcaaaagtgctttatattttttggacaggaagaaaagatagtactacttagggcacccacaatggttatctataaactctctacaagagatccatgtcagcatattttcctacttggaagagatgaaaaaagagagcaaagctatctactaatgtgaagatagtctatagagaaaaacgaggcaatatattagagagctatagatacccaagtagacatactattaaggtggtttactattaatctagtctattgctgagatgtacatgttttacagagagcaccttactttactattgcgggtgctcttatgttttatattataaatcgttttgacttttttcctagtcaaactttttttttacgtttgactagatttgtagaaaaatataatagtatttttaccacaaaacaaacatattatcaaaatatattcaaatgctagatttaatgaaactaatttgacgtttaaaatgttacttttcttctataaaacctagtcaaatttaacaatgtttgacttagaaaaagtcgaagcgaattataatatgaaatgaagggactagtactttgtatgttttaaattacttgtcgttctaccatttaaaagttatgccaaaacacttgtcattctcatattccaaatcactttttaaatgcttttttcttcttacctttctctaacacaaccatgctagtagtagtctcttataaggaattctaattcttactttgaaaacatgattaatatgtaattaagaagaattgcaatgtaatttgctatgacttcgtacgattttctggaacgacaagtccaaattaaaacataaaacggaggaagtataaatatatatacacgcttcgttatgcaaactagtactaataagcaaactaccattaatgcatttggcgtttgaattaatactacgagttgtacccgttgtctatcagtggagattgtctacagtagcagccactgacatgtaggatcgggttcacctatcagccactgctactgcaaatgtagtactgcgaagatccatgtccgttgtctatgcgtgtcgtgcctgctctgctctttaattggtaaaaagtattggttagggctgaatgcaaaatgcatgtactcctggtcctggacgcatgcttaacgaagacgagatccagtcgaagccatctttaaaaaaaatgaaccatatatatgaataaaaagcaaatcactcaagttgaaatgcctgcatctacattttcgctcgtacgttcgcaatcacagtttcgggtcaactaactatctgcgactcggacaagtacgactgcttgacagcccaactacctgggctacttgcatgtttcttttccttaattttcatgcagaccagcatgctcaatttatgtacaacgacagctatttttttagacaatgatgtacaacaactaatcagttaacctaatactcctatatataaagaacctagaatgcacatgagcatggtaattaaacctcgacattttattatatttgacacactggatatatagtcaataaactttaccgcaaattatgaaatgtacaggcactgcactgtaccatacgtagtttttgtgcagcatataaccataggctgtcacgtacggccttttataccacatactagtccttgaacgcttaataataattaaaagtgcgtgcatcacatcagaaaagtttcaacacgctagcacacaaacacggaattactagtctcactcttgtaggagaagatcaatctaatggtgcgacttgatctgtgtcgtcacatccgtttttattggttgtcgcatcggccttcaggagttcagggtagccatgtcggcatgaaggcagtcacgcatgagttgttcatctgctctggagtaaacctacgaagagaatcaaattgtgttaagggtgtgtttagttcacgccaaaattagaagtttggttgaaattggaacgatgtgacagaaaagttgaaagtttatatgtgtagaaaagttttaatgtgatagaaaagttgaaagtttgaagaaaaattttggaactaaactcggcccaagttcatgtgtagagagcattccatacctttttttagcacagaataaaatagatacgcacgattgagtggacctccttagtaatctagtaaggctagaaaaacaccattcatatctcttaagcatgtgttaaaaaagcttactcacggatgtatgcgtgagtgggtgtacgcgcgtgtgtagtggtatatatgtgtacgtgcaagcttttcccgtaataatgaaaaaattaaactggatacacaattggtttcaagaactaatgagatcagagaaacgatcatgaagctgaaatgagtaacatgcattttatacccgatctgcaaggtgggctcggcggcagcttccagggaatggaagaatccgttgccaccgtgcggtggcacctgctggacggcatgaggcgactgccgctcgtagccgagtagggtggcgccgtgctcccacacttgtccatgcaactggttgctctcctccagcttttcctcgcaaacgaatcaaacattagtagtgctcgttattcttttctcacttgtgtttttttttttcatttcacagcatcattttggttatttcacagagctacgtaagcaggcgttagccaggagatatatatatatccgaggaagagatgccaggaaaacggacctaaatgcctaaatcgcaaccgaaaacagtgtgacctcgtcttgatcaattgttaatatgcattgcttacgtgtgagagatccttatgttaattaatatgcgcagttgaagtaatatgctgtctacgaagcttcatgtacgtattcgttatgtagaaataaccaataccaaatgttcttttgtaatatatacaattcatcctacaaactaatatgcatcaacgtacacaaacttgtccagtttctgttatacgcccttacaaaccatattttatatgttcacatgtttgtaagtttatgtggaaggaatatataaagtgctaactaaacactgatgttaacatctacacattgaattcctgatcagattaaatttagtactacatggatgcggggctttgattttgaacaagcacacataaaagtgaagtgtataaattacttttaaaaccacatacttagttcatgcagaatcttaagatcaagtaaatgcatgaaacttaaacgggacaaggaattaaacttacttttcttctgaggcacttatttgcttcacacaacatttgttcctgaaaatgatttaggtatataaagttagttttggaaataataaattttcttgcctgaaatacatagttggtaagttttatgtcaagcttgtaccctcctctggagatcagtgagctgatcaagcatatgctgtgtctgcaacaagattagagttaaatttttttcaacatttctgaaacatatgtgagaaacagttaacaaattacccttgtggatctaatgtgcctcaaggatgaatcaagttgtttctcaagctgctctagctcttttatgccaagtgtcccaagatcttcaccaagaagattcctgtaattgtcaacagaaagatctactaagttaggctgtatttagttccacactaaaattgaaagtttgaagaaattggaacgatgtgaacaaaaaagttggaagtttgtgtgtgtaggaaaattcgatgtgacgaaaaagttaaaagtttgaaaaaaaagttggaatctaaacggggccttagttctgtatattttacactgtgattgatgcatgcatctaattctctaagcaacttcagtatatactactgcacgcatctaattctctaagctagttctccctgagattactgttttaccacttgtaaaccctatataatagagacggcggtaggaccttcattggttcacatatattacttcactcttgttaacactagtcatatgtgttttttccatgcaatatagttttttttttcacccaaatggccaaaaagtatctagtgtacacataattgttcttgccccaatacacaataatttatctactttgcatatatatgaatgaaaccaattaactgtgctccatttcgtctttgataaaattgaactcataagtggaagcctgatattacctttgggtcctctgtaaattttccacccgtgccttcagtttgaggtactcattgcggctgctttgcactaactgaaaaataaatttaacttcagtacaaagaaataggaaacaatttagagattctatgtgaaaacaaaataatataatttcacatgcaaaattaggcttatgaatgaacaatttattagaaaacagtgatattaattcatgaatccatctatcatatcatggtcaataaccagtgactaggagcttttctgttttatattcagatctacatactagacatttcagctagcacaaattagagttgtaaatcagtgttattacatgtggaaacacaacaacaatactcattctagttatagcactctttcatatgcaaccttttgcagtgctctcatttttcattaaattttgagtcttgtagcaacatcacatacattaagaagcacagcgaatatattaaattaagacttcatttttaattgtactattcaacacgtgtatatagttggtaattaatgataatactaaaagcagcatatctaggatcaatcaattaaactgcatgaatcgaattgttgaagtattatccagtgagacacagatcgattaatcagaacacaaagctagtctatgcatcaacttaaatccataaaagcttgtcataactcactaaaaattaaaatatattaatagaatctagtaacctcattttccttgttctgtattgcagtatctggcccaccataactgaatttttggtatctttccaaagttctggtcatgctgcaagtttcaaaaacacaaatggctatgtttatggaaaaacgaaataaaggaacatatatagttcgcccataactaaatactaacaatctagggcacattcttttccggggaccacatcgattaattagtagatgaaaaatcttgtttctcacaaaacatgaacattagctccatgacacggatgaaggtgcttgcataattggagacaatttctaagaaacaataacgttttatcttaattcttgcatcggtagtttcaagttgatttataattttatatatgtccatgatatcaacctagaggccactttttgtaaagaaaatggagtacactctttaaagagagatatcaagttcagacgacacacaatgaaatggcataacttcagcagactactactacagctataatgctcacccccccccctctaccgcgtcaatttagtgaccttttggctgtgtttagttcaacgcaaagtttagattttggttgaaattggagatgatatgactaaaatgttgtgtgtatatgacaggttgatgtaatggaaaaggactgaagtttggatccaaacacagcctttgtttaaacaagtcgtgaattcagatttctgaaaaggatctacagtacacgttgagtatcaatttgtcggcataaaatactccactgaactagctctagctagaactagaagagacatctgatgaagaccaatcttctgtactgacagctcagctacgagagctgaggagaccaatcgaatgacaatcgaaagctgtcactaactgtaccctgcagatactcaagtgagtcctaggaatattgtgtactcccttgcaggatttcttccgaggagcagaggagggatgtttcactcaccccatatccaaattgaattccctggtcaatgaaatcatgtactcttatttgtgaatatatttaatgttagaattttataggcgtattaattttaatttagtaacttaggtataatggaaaccatttaaacataactataaaaattggcaagcatgtactccctccataaaaaaagaaaaagaatgctaaagtccccatatacttacggctgattataagccataacggcttattagcaaccaaaatataatttgtgagtaaaattgtatatgtgtctttagcgaattaaaagttaatgctgaaaaacaatctacattgacaaaacattaaaaatcaacttctaaatcaagtttcgaaattcaaaatttgatattggcttataattcatagggtaaaagatgaggccctaacttctagctataaatctggacatagcctatatatgtccaggtttggcaaaaaagttggttttttctgcaacggagcatataataatgtaatcattatctaaaatatataatgatgtaatattcactatagaagatattattaaaatgatcagtgcaatacaatgagcaagaaaatttaaccttctaaagtttggaaaatgtatgattcaaatatgaaatgaagctcatgaatgcctgacttatctaccctaactaattgtttatctctaaacacaataccaaatgttttcttccccccgaaaaaaaatgttttctaattcaaaatcaattcaactagcttatatgcggcttgtgaattatgcctagccaatcagacgctctgtgtttctgaaagacaattatatatatagtagtatatgatttttcatatacttatctcaggagaaacagactttatatttattgatgttgcctttaatgatgcaaccataactcacttgaaaaacaatactcccccgcggccatcccttaaaaaaacaaagagacaaaatcttaagtgaaacccccaaatcttgtaaggtatgctgcctccaaaccgtggaattcatgcagtgaacgtttgtttagacacacatccggtacatggctaatgatatgcatgatcccttcacacaccccccccccccaaaaaaaaaaaatcatatataccctaaaaaaaattgcccctcaaaaaactaaaaattgaggaaaaaaacagatcccaagggaattcgaaactcgcataccctccattaggagatcgataaaattaagattcgaagcttccaacgattaattttctccgtaaaaatcgacttgctgatccaggcttaaatcctgaatgtcccatcccatgcatgcacataaattaatcgcaattaaaccaaactcaaaaccattaagcgcgccatctcaaaaccactactaccacgggatcagaaaccctcagatctacgtatttcaccactccctattacgctagctagcacccgatcgaacgaacaaaaaccctaattattcccacagaattccaccaacttccttctcccaaaccctcccaaaactcaccaaaacacgagcacactcgcagatccaccatgtgcagccccagatccccgcaaaatcgccaccaagaagttcacaaaaccatcgtgcgctccagatctggaggcgcaggcgcgcgcaagaaaccctagctagctacgttgcaagcagctaccgatctagctatagcagatcgaggcgcgcgcccagtgcgtccatgtatatatacctttggccgctgcagaactcgtagagcttgccgcggttggagaagatgatgagggcgacctcggcgtcgcagagcacggagagctcgtacgccttcttgagcagcccattcctccgcttcgcgaacgtcacctgcctgttgatcttgttctcgatcctcttcagctccaccctccctctccccatcccgatctcctcctcctcctcctcctccacctcacctcaccgccgctcgagctcgatcaatcgcgagatgaatcaaccaatctcgcgaagcgaaagagaggggaaagctaaggcgaggaggaggaggaggagggggaaggggatgaggggtttaaaaagggaagggggagagggtgggcagcggcggtgggggctacccggcattgccatttccggcaaggtggtggaacgacgcggaaccctaggcggcctcgatcgatccatcgtacgcaaaggcaaagctatctaggttaatttcgcactaatctccgacccaattcaatgcgtctctcactgattgctttggattttctctctctctctctctctctctctctctcctcgtcgacgcagcggtggcgactgaggattcgacaggtcgagaaattaagcgcggaaaagctggggaaaagtgagtagagttgggcgcttttgcacttgaaacctcggagttttcgggtttcgggaaaaatacccttcttgtgtccactaggagccggtgggtgatctgttgggagagcttaaggctttgtttagtttccaaaataaacaattttcacccatcacatcgaatatttaaatacatgcatggagtattaaatgtggaaaaaaaaccagttacacaatttgcgtgtaaattacgagacgaatcttttaagtctaattgcgcctgatttgacaatgtggtgctgcagtaaacatttgctaatgacggattaattgagctcaataaatttgtcttgcagttttttgacggaatctgtaatttgttttgttattgtaccacatttaatactaatgtgtgtccgtatatccaatgtgacaaacaaacccaaaaattttccccaactaaataaggcctaagattttgggaaatagctagttagtatcaagcttctgagaatatggagaatgtggatttctcagcttctgttttctagttaattttttagattctataattagagcttttgagaatttggatgaaaaactagactatgtagagaggattaatatgattttgagagaagatacagcggtcagaaaatccccatacagacccttacaacttttctcttgggttgcagttgcaaatcaaagcagcaaaatgaaccaaggtagcatagtatatatctagctagctagcgatgtggttgccaagttgccatagttcgtgtagacaaaatggagctgtttgggtttggatagagagaggcttcttcgatcggtatatctctttgcctgcagagaactttgccgttgcagtgcttgcagtagtagatatatatgtgtgtgtaaggtttgaagtcttgg

SEQ ID NO: 17518 - DNA, 2675 bp, Oryza sativa
cacgagatatctgcaggcaattttaatctgggctatatatatatatatatcgtcccatctcgcgcgcgacttgatcgatcggtgatcgcgaccggccggcgtgacggagtacgtacgacggacggacacgtaccgggtcgatcgatcggatgccatcatgccgcgatcgtcgatacgtaccgggcccatggtattcgtccgttcgatgtatcgtcgtacccaatgccatggacgcgcgacgaacgatcccggccgccggctgatccatggatggatcgatcgacgtgaggacgcggacccagagcagggagagagccgtgtgtgcgtgaaaaaatcccggtagattttggacggcaaaagccacgaaatggcttggctagcttgctagtactactccctccgtctcataatgatttatcctagaattacgaatctggacatatatagttcccatatagtccatatattaggttacaacgttatggaacggagggagtagtaggcagcttgaatgcttgatctatcggcgcgtcccgtccggcccggtgcctgcccacaaactactcgcgcttgcttgttgctgccttgcaatcaatccatcaatcaaacgtctcaacgatcaatcagttcaatcagtattatgtgtgtgtatgcgacgcagcgaccgtgtcgtgttgtgcttgtgcagttgtgcgccatttccattggcgtcatgtgactcatgtcacatgggcccaagacgacgacctaacgtgggctgcagatgggccgagttaattaccactggccgagaaaaagcccagacggaacagagctcctcctcctgctgcagtgctgccagtgaagtttctgtacaggaatttccatggaattctctgccgctatactcttttaatgaattaaatttgaaaatatagtgttcattcaattattttttgttagaaatatttaggatacagcacaaatataccatcggtctcgtacaaccattgtgcgaaaatgacgcataaatgatttcacgaccggtatcgtgcagtgaaagtgcgagaccgtgcggtctcgctcaagcaaacaacgataccgctcaaacaatcaacgctatcgctcaagcaaagagagatatcgtgccttgcctatttaattagcggttaattatactgattattaattaatcactaatcatgataattaatcactaattattattagttaattgttaattaagtacttgatcactaatcaaatggatcccattggacaatgtcacagatggcttctgcagtctcactcttccattccgcgagagaccgtgcggtctcgcgctttcgccgcgcgataccatccgtgatgttattcccgcgtcattttcgcgcaacggaagtgcgacaccgatgatatatttctgcataattttttgcatcccaaatattccttagaaaaaattgaatgaacggtacattttcaaatttaatttctcttttaatcaccggtgaatgtccacccgtttattgcatgtcatctaaattattattatttttttaaaaaataattgacaagatatgtaatatatcactacacaaacatgtaaattaaaatttaatttctacaaattgtaacataaacaacaaataaaactcaaagtagtgtatatatatttgcagttaaatttctcaattttgttacagcttgtaaaagttaaatttaatattacatgtttgtatagtgatatattacatattaatctatctagttaattttttaaaaataaatttataactatttagttgatatagttgatatgcaactaatggatggacgttcacccgatgattagaatcaatctccattctctgccaatttctgtgaaactttgctgctgctcagagaggtaaggtaactaaaacggaagcaccacaagaagagatcgaataacactgcacatcacaggtagtagtagtagttactaattacgggaggaacagctactgatactcttaactcttaatgataattactggggaaggctactaattaagctactgccacgagaatgggagcgacggcgacgtgccgtcggaggagccctcgccgccgacgtgaaacatgccgtggtagttcatctcgttctcgttggagcccggcaccagcacggcgttcagctgctgctgctgctgctgctcgctgtccatgctcgggcaggcgaacccgccgccggcgacggccgcggcggcgggcgagctggcgaaccacggcgagctgccgccgaactgctgctgcaggttggggaccaacggctgcgccatggggatttggtggtggtggtggtgctcggctcccgccgccgccgccggtgacggctggaccatccggctgacgtcgacgctggaggagttggccggggatgacagaagagagagagcacaatcggagtcgagcacttggtggtggtggtggtggtggtgggcggtggtcgtcgtcgtcgtcgccgtcgtcagcccgtcggaggagaacatcttgttgctgctgctgctctccggtggcggcggcgcgacgacggtggtctggcacaccgagatctccagcgtcgccgccgccgccgcgccaccgccgccgccgaagcttatctgatcgccctcatggaggaacgggaaccgccggccttccttgggggagaa

SEQ ID NO: 17519 - DNA, 9440 bp, Oryza sativa
  unsure (1)..(9440): unsure at all n locations
atagtatcagaaaggtaaatatcaattgaaacataatactatgcacaacaagatataattttttttgctgttttaactgaaacataagggttgcattgtgctctctaagctccatgtaatatataggcaaacctatcatcgatttacacaggaggaaactagtagaacttgcggaatacgtaagtatcaggtagattactgaacctcggttctacatgctacattttatgagcaattggggtataatttgcagtggcatattggtggagtctagatatacattactttttgtttgctttacagctcagatttctggtttaagcaagagaggacattacataatttattttcaactatgtcattagcattcaacatactcttcaaaacaacagtttttaaacaagaataccttgttgacttgtcataaagctgccagaactcatgctatctgcctgtggcttcctgcggcgtcgattgtgcccatccaagcgttttctacaactacgcttagcctcatcaaactccccaagcaagtgaaacctacagaaatgaaaagctatgatgagaattccaaacatcaaaatccttttttagtacttaataaatctttataaaacaaagcttgattgttatactaggaagtgaaagggaaaataaaatagagctgctttaatgctgaaaaggtagtgtgagttctaattgaagcaaaaacatattcagatgtacttgttttatctcagagataaataatacagtacatacgaatacttcaaaattaatggggctcagatgctatttaaaagaagaggaatgatacgtgtatttatttgctgaatattcaataatagcacccagcttcaattaaataaaatggtacacggctggaccaatcgtatttcaatgtgtcagctaataatttcaatgcatggggattcagttatataaaagttttgtactggcctgtcaagcacaagagaaaaaaaaacagtacaactttggcctctgggacatttggaccacggtataatggttccagcaggtatatggcagtatgcatcccaccagcctgttgcttcatgaggatcaccttttttttttgcaatgagcactgaggaatacttgataaagactggcaagcaatatggcattttaattttgctccactgggcatctgggagagggcaattaatcgttgcaaaggagtccccacaggatataaatttttcaggaggtggcgaatgattggctgataatatttgtactgtgttaaaggtaacatgatgcagaggtaatttgctcattatagctcaacaacgtaaaaggacatcacaaaaagtccacaactgaactagagatgaacctaatacaagatctcggcttgcgtagtatttttataaaataaaaaattgacaaattggaggcgcgcattagctccagagagtaggattcatatcggcagaaagtggaccacattatactcagttggtaagagtaagcattatgcttggaactaatttagaaaagcagctacagtagttgttatgtcctgaaggaaaaggattttcttttttttttttgtttgtggaagcaaatgattcagctggaaaaggacgaccatgctttaacaactgttttatttcagttcagtagtcaaataacaaggatgatgttcatattcctggaacaagatatactcttgaaaattaaatatagcttttactgtacagccaaatcggtcaaaatttcactgatatcttacccaaaaaatactgatcgaatttgaaaaggtgcacacaaaccaaccccaaaacacacaaaaaggggtaaggcaacctattgggtgtatttatctgatttgtaattagttaaccattgagtagacattggtatttgtaagggttatctggttgaatgcactatacagactgtagttagctttcaaacagcaaccttgttggtcccaacaacttaaataaagagcatagctaataacctgaagcaaagcaagccataatataaagcaggttgcatgttcaatatcatctttacaaatcaacagtccctcataataaatactgttgcacaaggatccacggaaaaaagtgaaataacttgtatggatctggtcactgattcagaaaggaaagatctaagcagaaaagggagctaggcaaacatgtcagaaatggggcctaatcaaccagggtattacttaactaagagacattctgattcttaaactcctcaaagcaaaaaaaaaaaaaaagaaatcacatagatcctaaactacctacctaatgtgttggaactccatttttactcttaaattttgcagctgaccacaaaagaattgctacctgatgtcaatgacactacccgtgaaacataataaatttcttcggcgatacaacgtaaaattcacgaatttccagttcattcatcactttcaaacaaaaaccatgaagaaagtggccccagggataatgtgcacatgtagcaggtatcataacaaaagacccaactccatctgatctttggcacatgaaatgcatcagtggctttttagggataataattaccactgatgggtcagaaagttactagtgcagaaataggaaaagaggaggttataattcaggtataccggttgccaaggtaaagtgcaacaggggaaaaacttgtggtacatcttatgaaaaggctgaaaagttggcgccggaaaaggtaaagctgtgcatccttggaacaagacagccagaaaaatgttcatctcatctcatctcatctaatctctagtgataaattttcttggaacaattgtgccagggaaagggaaagccgaggccaaagaaagaactgatttggcctattcactttgaataaagggaataatcagcagtgaaaagaaaaggatgtagaagagataaactgaaccccaatcagtcagtgtgtgttcttggttgcggccaatttttattatttttttccatcgcacaattcaggcaatgatcttttgcaaatcacaatccgacgtgacacgattgcgggcagtcatcgattcgggaatttaatcaatgtgctgaatttagcatggctagaattggatatgaactgaaaatttgccaaattttacccgattttcttgtgcttttttttctttttttggttcgtcagattggtttacctgctgcactgctggcagaagcgcatctcgcggccggagacgacgacgacgggagtcttggagtgcggctcgcacaccttgtgccgccggtggtagtcgcggtgcttgctcaggtcggccttgcagccgtccacggcgcacgacgggcactgcccgccgccgccgccgcccccgccgcgcggccgcttcagcgtgctcgtggacggcggcaccttcgccaccgaggcggcggcggcggcgctcgacaccggcgccttcgccgcggcggcgggctccttgagcgcgtccgcggcgccgaactcgccgagcccgccgagcttgaggtcgacagagcactccggccggcccggcgccccgcgcgacgccgccaccgcggcaatgcccggctccgccgcgctcgccgccgccgccatgttcggcacggcgttgtgctccagctcggccaggtcccaagaaacaggcatcttgagatcccaatccatggcacgacacggctccactccacgccacttgttggcaacttggacacctcgtcgtctacctctcgctttcacggtgaggccaccaccaccaccggaggaggaggacgaggaatggccggtttgtcgccaccgcccgtcgctctcatcccacggacatgccgcggcgaaggtggcaactagcggcgaacgaacgaaccaacgaattattgatcgcaaacaccgagataccaacaaatcgagcgccaagaacagggcaaatgcaacagatcagcagcagaagcagaagcttatcctgatagggatgagagacacactgaaacacacacacaaaaacacactctcttcacacagcagaggagaagagagatgaccagcagctgcagctgcagctgatgctgatgctgatgctgctgctgctgctgctgaatgagcaagtgaaattgatggtggttgtgcttggctttgctacttgtagctgctgctgctacacaacacagcacactgcacagatgcagcacaagtgcacaacacaacaagaatactctaccaccaaggaggagactagtagtggtaggcagtgagtcagtactactcctacttggtttttgcagaggaggcaagtgcagactgcagagttgtgtagtgttgtataggcagtgagtgagtgatcttcatcagtgatgaggggaggaagaggaggaggagaggtggtcatatatatatatatatatatatatatatatatatatatatatgtgtgtgtgtgtgtgtgtgtgtgtgtgtgtgtgtgtgtgtgtgtgtgtgtgtgtgtgtgtgtgtgtgtggcattataatactccttctgtttacagataaccatcggttttgactttgagctgttttgcttccatcaatagtggctttagaaataattttggctattaccatcaaacctgtatcattcaattgaggagtcaaatgtattttttaggaattacttacattcaaatctatctgcttgtacatcgcttaaatcgtacattaaaaaaatatcatgctgatgtgtttaatgaggctagtcctaatattacgactgtcatttaaacagtagcaaataaatgtggtttttggtgtattgccagggcctttcagctcgatgacgaattccttagaaagtcgtttacctcaattgaataaggtctggtcgaatgagttgtgtttatacaacagacgggtaattgtttgtggtgagggtgttttaccctctccactgtggtttcctacttcttaataaagtgataggcatactcatgtatattaaacaaaaataacagccagagtttatctacctctaatcaaaacaaacatatatttgtgaccgaaaggagtataacatacattattttacatggaaaaaattcttatattttgggtagaggtattagtaatatacttgtagtaatatgttttctagcttggcttgttttttgtttgctgcatggatggtctgatgcagtgtttgcattgcattgcagccattcatctcatcaaatccctgacagggattctaaagggagcaaacaatgaatgggggtgggatgggggcccccaagcaccacagggccatgttcatcctttaacaccagcatggagccattgtgccgcaataattggggaggggttggtttggttgaggggaggccctggcctcttggaggccaagtgcaattacttttcttggcttcttgttagcagaggtttggtggtgtgtgttgggatttattatttaggtgccacaaattaaaacaaatcaaatggctttactgtcctgctacagtagcaggggttgtgatgtgtgcagctcagtgttgctatcttctgtcttggggtcattgtttgatagtttgctctctaccttactgaaattcgagaaatggggtatataggtatatttggttcggtaggagaattgtatttacgtgagatcaaattatgatttttttataataaattgaaaacgtagaatattttttattgtgactctttcaccgaattgtatacggaactttcgctgttataaatagtgcgtgtgatttagatagttgaaggttacagttaagaaaaaagtttctttcatggaagaaaagtcaaatattcatagaaaactctaactggtctatgttttctgatttcataagtacattatatatatattatggttctttatatgctatatgctgttggttcttgtgtgttcctagctagctactgtgtgttgaaatctgattctttcttttcttgaaaatatgcaagctgatttctcactgggattgtagtaacaaatggcgcaaatgtcacccaaacttcgtatacatctcattgtcaaaaacaaataagcttcacaattaacacatgtcaacttttagcccggtgattcaagctagcgtgaaaattatcacgcgccacgtcactgttgtttaatgtatggttgttgggttgaactcttaacaaacattcatgctaatcattttgtgtcaaaaactccatcttatagaaaataataaatttaataattaactagctctacatgaaggatgttttaaattgtcttgacacttatccccttgacagagaaaaggacatcaaccttaaaactaagagcctatttgcagctgctttgtaaggtgagtaggagcaatttttaattccagaagtgtgtagaccacacattctgactccaaaaaaaatctatctgagcaaacttgcacttgcacacattagtttaaccctaaaattcaagatgttccaactgcacctctcctgcaggtcactggtccatttgatctaaaaaaaacagtatatcatggtccatttctccatcacaagtacatattattaattttatatatcactagtttatatcttgtcgccacatgtagcaccagaccaattcagaatttggtgttttttatatacacagaaaatacttttaaaatgctttgggggttcttgtttgggagggagcctgtcctttgcctattgccaaggacatggggctgatttgtttgtttgttacttttgggtgtccttgacttcttgtgtataagggataaagggcttctaggtaaaaaagaaaagaataaattggatgataggtgaaggattgctctatcatgataggccactctctctcacaccatgtagcctttattttgcaaaaattgtggaggagatagaatgattggttacataatgtttctcctttgtaccttgtgcttcttcttctattttttaccgcgtttccatctgccagttaatatggcaaaattttccccaatatatacactccttacataacgatgtatttccattgcgccttataaatcttctgacaaatattaaataaacaatggaatctcagaaataagtaagtagccattacttgggttgttgataaccatgggaattatttccccacaaacaatagtttgctatacatgttttgcacaatttttttacccacaagcaacatcacttccaaatagcagtatcctcaatatgcacctttttttccctttaggaatacgcaaaaggcattcatataattgcattatgggaattatttcccaccaacaataatttgctatgcatgtttgtacaattctttttactcgcaagcaatgtcacttacgaaggagcagtattctcggcatgcatatcttttttcatgaatacgcgaaaggcgcacatatctcattacattaagagttttgatgtgtacatttaacttccagaatttttacacgatttgaatttttggggtgtggattgatttgccgaatgatatttctccttttgtacatgttcttttttaaaattttactgtatttgcctccttccaacttgtataagaaattaagaataacaatagcttgtgccacataacctactgactaataatagtataaaatacaaatgggattttagtaacaaagtacgtatagtcagtattatgataattgataaccatgataattactatcatttccctagcaagaaaaatacacttgatatgcatactttaatttgcataattctttatacacacaaatagcgtcgcttccaaatgaacagtatcctcgacatgaacattttcgcattacgaatctcgactctcgacgtgtacctttagcctttaatttggattgtttttccacatttttttgcacgcgttcgctaaattttacttctaacaattaattaaattggcatccttgtgtccaaaacaaacaggtagcagtaatagtaaaaacaaaactactccgtgtgtcgtaacaaaatttaaatttccccataattaaatgttggtcgctcgattggcagattggcaagatgggatgcatgtgtccggggagcaaatgcgtttgcagaaacggccaagctgcgtacgagtgaagttgacgccaattgtcaaggcatgaatgtcactgtaagctccaggggtatccaacgaactttgtctttctttctccctctcttttcttttgggttagttgatgtataacaaacttgcatctcaaaagtcagaactactataatggcatccaagaagccaaaaaaaaaggaaaaaagtcggattaaatgactcaaaaaaaagtactattccctccatcccctaatataagatattttgacatttttgcttatgttgtttgaccattcgacttatttaaaaaaatttaaaattattatttattttatttgtgacttattttattatccaaaatattttaagcaaaactttttgttttttatatttacatataaactttttaaataagacgagtggtcaaaccgtaaaagtaaaatattaaaatccctactactacggcgcattctgtcaacatgtggcttcagaacttatagctagtactggtcctagatgtagtcatgtagttgtccaaaacatctagtagtacctaatttgggttagtgactaatcaggaaataatcgctaggattatgcccttgccaaactagggatgggttacggtgataatgtactggatgttcttaattaacagcatatcgattaatccttaattaacagcacattaattcatgtagatgatgattaattgtaggacagacgcatgcatatgatggcacaatgaaaccaaacttgtttttcttgaccaaaattgcacgaaatgggaaaaatctagtacttcatggtgggtgcctaaagtcctaaaccgtgggtattatgctgcaagttatcaagctgtaccggcaaagtacctcttccactgagctagctttttcttgtttggtgggctcgtaaactagatcaactctcgtaatcatacgctctctacggtcacgaaaacatatcgttttgaacattgacacacacaacatgtacaactaatttctgttgcccgaattatttgaaaactagataaaagtaataattataagtttttttgggagacaaacttatacctatacattcatctaactattctatatgttttttttctagataataactattctatatgttattggcttcttcaataattttataatatatcacatccatgttcgacattttcaaaacatgacttgaaaatggagggagtaattgtcaagctacgtacgggaattcataagaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17520 - DNA, 379 bp, Oryza sativa
cctccactggatgaactaccttagccccgacctcaagtgcagcaactttcatcgacgacgactacgagctcaccatcaagctccatgcccttctcggcaacaagtaagcaaaacaaatttcaatgtgttgtcatctgctccggttagctcttcttgtgttcttggtgctgattgattggttctgcaggtggaacagcacatcaagcgcaagctcatgagccagggcatcgatccgcagacgcatcagccggttagcgccgggaccagcgttgccgcggcaagcgagctgaccacgacgaccagccctgtcagcttcccatccctgcgtgggcgccggcgtgagggagctcgaggaggaaggagggaaggctgggagggg

SEQ ID NO: 17521 - DNA, 733 bp, Oryza sativa
atagcactcccaaatcaacatggagcaggtaggtatagtgtgcgttcgattccctgtgtaatctatggggtcaaaacatggctcctattatttcctaagcaaaagttgaaagaaggaaaactaaagaaaccgagtctaggtactttattgtctaacagatcatttccagatgaagcttccgtttcagcttccaacgaatgcaccaaagtctatctactatcccactggaatccaatgcgtaaccctaatatatttccaatgatcttggtgggttcagaacttacgattttgctggtgcagatcaagcatatgtgcaaacaaaagacgagactgtgtttgggttgtgcgagactttcggatggagacaagacaaccgcatctctgcctttgcggcatttctccgaacacctctgcggcgcttgtctcatctttggactcctcatctcgcatatcaggcgcatcctcaaactggtaagcagagcggtgggaaaacgagacggagttggcggcgagcttgatctcgcgccgaccgttgtcgcacccgccattgctgcgccagcggctgcggcaggtgatggggtggcaaggcctcagggagatcctcaactgccgaggtgctccgcttcatagaccgagcaccaccagcgtccaggccgccaccgcggttcccgtctgccatatggttcccctcgtcgtcgtcgtcgccggcgacggcgacggcacgcacccgccg

SEQ ID NO: 17522 - DNA, 7564 bp, Oryza sativa
ttaattccttaaaaaattttcttttgactaaaactcatttttcacaaacggctagccgcttgtgagcaactgtctgttaaaatttcacgactgaacagcctgcatgtttgtgaattttcatgtacggtcgtttaagcctcccacccgtcaaaatgaatttttactttttatattttattttgcgccaaaacaaaactgaaaaaatattttaaattttagtaggcacaaattaatattcattagctataccatttcttcacaaagtatggacacatacgatgtataagatttcaactaagatctcatgtccacacatccatatatcctaaccatctcacactaccaagagtttataattaagatgttgttcttttgacttcacctttccaaatgatcttaaatgaaaatgttatcaattaggaagttgtagatctagtgttgagccctacaactttgatatagaattaatacatctttattggaggttatttgaaacatatataattctgagattttataaaatagatcgaatatttgtatctctaaaccatctcaaacgaaaaacgttgttaactacaaaattatagatcttgacgagatatacaattttgatataaagtttgtcttcatatgattttatacgaaaaagttatgtgtatatatgtgttaaattttggaaattttattttcataggcgagtagcttaagccgcccgcttgtaaaaaaatgattttcataggtgcatgtttaagccacccaccggtggaaatgaggttatgtcttgacagggaactgtctgcgtattttcatgagcgagtctaattacgttgacttgtctgataaaataaaaggggtttcaagaaaatctgataccttaagattcaactccccttagtatctttaatcagaggcaacacattttctataccttaaggaattaattcgaacttcaaagtgatgcacataataaggatgaaagcaaaaaaaatattagattttcatctatagataagggtgaatatctaatacggcccctgaagttttacttcgggctcagtttagtccttgatgtttcaaattgtccaaacaagtcctccaaattaatcatttgggttaatatagtccttggactaaaaaaatgccacgtaagtataccaagtcatcctcgcatgcagcggtatgaatgaaatgaccattctacccttatataccatatagaaaagaaaaaaaaagaagataaatgttttacacgtgcatgatcgttttggaattgtcacttatgactgatcgtgtaaattcctttgtcggccacccattcgcaacaatgtttggcctgggctggcatgttattttttctgtttgtcttttctttattttctaaatggtatataagggtacaatggtcatttcatttgtactgctgcatgcgaggatgacttagcatgctcacgtgatatttttatgggtctaaggaatatattataccaaataattaatttgaatgatttatttggacaatttaaaacatcaagaactaactaagcccaaaacataacttcaaggaccggaccgtattagctattcacctatatttttaagtataggtagtttcggaggattttccctgaagaaaccaatgcagaattcccgcaaatatcttttagtaacttttttactgacacgaatcactcccacatccatccgttcagcgatcattttactaaccacgtataacttcggtattcatcgtctagttattattttaccaacatgtataacttctgtaaccatcatttaataatcttttgttataaaaacgacacgtatagtatttgtttgggttggacaaaaatagatcaaccgtaaactttttgactgcactttgacatgtgaattgcaattttgttaccacatatagttaatgggaaggagcctcgtctaggagaatgcaacactcaaccctcaccttagagcaagtacaacataaacaataagtactactggagaagataagagaggagagagaaaagaagcgggctataaatttgtagtcagttataacacgaactccacaacactatgtatatatgataggtgggaccagatattaatggtgtaatatatatttataggtaactattatataaattaactattagattggctaaaaatgatttggagctaatagttgtattggctatactattaaacttgcactaacagagtaattttttcactatccaagagcttccactctctatctaaaggatgcaaataaaagaattactcctcacatattggtcaatccatccattaaaaaaaaaacctccgagaatattggtcaatcaatccagcaaaaaaaaaaaaaaaaactcctcgcgtattggtcaatcaatccataaaaaaaaactccccgcatattggtcaatcaattaatccatataagggaaagtgcgggctccttgaggtggtaaaaaaattaccatttaattaactaaattgtatacagggtgggtgtagtagtttcctatagacagacacacacgagcgtgcacccgcatgcatacatgttattacgtgagataaaaaaaatataatgatactagctgcacaatgcaggccataatgctagttaagtactccctctgtttccaaatatttgacaccgttaactttttagcatatgtttgaccgttcgtcttattcaaaaattttgtgaaatatgtaaaattatatatatacatgaaagtatatttaacaatgaatcaaatgatagaaaaataattaataattacttattttttttataagacgaatagttaaacatatttaaaaaaattaacggcgttaaatatttagaaagggagggactagggagtatatcatggggatagatttcagtcatttacgttacaaaccacagtcatttacgttacaaaccacaggagtatataagtgattattttggaagcaatctgagtgaatttaatttggaaaggagtgtcacgggcgcggagcgcgatcggtagacatgatgggtatggtgggagagaccgttgggctggtgacggcgatcctcagcctggcgagtcgaatcgtggagatggtggattcagctcggcgaagcaaggagcagtgctctcttctgagtgaacacgtccaaaacataagaaacctcctgacgcagctggataaccagtggacgcccgacctggcgacggaaggggtgctgaggagcctaaaaactgccctcgacgacgcgctcttgctcgttgaggcatgccaaatcgagaagccctggtataagcgtttggccccctctaagaaggccaagaagttcgatgccctggacaaacggatctcgatcatcctgcagcagttccatgtcgccaacatggtgctcatcgttaacatccacaaagatcgtttcttcatgactgttcttaagatgctacttggagatggcgcttgcaggaacctgccagaggtaaattaatatagagctctagcttatattatttttaaattaacatttctagcttatttttgctaataatatatactatacaaattttgtgtcacgcatgtaataccattatatatatttgtacttaaaaatatttttcttagatttttgtaatatattatgaaagaagttaatattcaaggtatgtatatacatgttgcatgtcatataaaagctaatagatacgtcttgtgctttgggacttagggaggtagtttgtgcattaattaattacctgtttccatacgttatctcaactcaactaagtctgaattaataattttgtgcttggtttcatgtttagtattttcttgagcttatatatgtttattttatatagacagagggaatagacttttttttaaaaaaagaaagttgtattataccttcattttatattataagtcgcttagagttttttttttcaagtcaaacttttttttaagtttgactaagtttatatgaaaatttagtattatccaaaacacggaattagctaacatgaatatatgctgatattaggtttgttttgtgttaaaaatgctactaaatatttttatatataaacttggtgatacttgaataagtttgagaagaattcgaaatatatagttgacctcatgagttgattatcaaaaattaatatttttatagaataataatgtttttatatacacacgcacagaaagaagctggaataataattgtttctaatttcagaggaagaaaaatgagctgaactcatacatcagaggtttgactcatcgtgatgatatgtccacagacgcgaaatgggtgttgggatggatacaaaaggacctcgcggacgggaacgggtaagaacagatgcacgtatacttaaaactagtgctccatctatcctaaattataaggcttatatttttttacacatgattttcaataacatattttaatcggtattgtattttattctatgatcataataaatatgaaatagcatcagatgaaagtacttcaaaatatgaatatatagtgatataacatacataatagttagtatgattattagtcaaagctaccaagtttaattttacttggcgccctgtaatttgggacggaggggtactaagtacgctgaaagcatgcatgacttaaatactgttaatttaagtaaagttccgtttttctttgtatgttggaatataattgtaaatatcatatgcagcagccggttcgcagcatcaatcccagcagaagagggcagtggtggcggcggcgttagcgacactcttgcgaaggaggtggtgcaaacctgtgaacttatcgtgcaggaggccgggagcgcgaggcagaaccaggggcatgtgcagcggctgaagcagctggcgcagcaggtggccgacctgatgcagcacccgcaggcgtacgggctaacgcgcgaggcggagacgagagagatggtgaacaacctcaaggaagtcctcggcgacgcccgcatgatcgtgtggtacagccagcagccgcaaaggagcatgatcccgctacccctgatatcctgcagcggcggccgcggcagaggcgtggagcagccagccgagcagattctgacggtggtgtacaagatggagtattacctccaggtcctccccgtcatggctaggcgccagatggtgatccctgaatctgaatacggagctcaggcagctgatcgcacgacgactgtatctgatgcatatatatatgtgtgtaatactatagtgcgtactctcctagtcctatacctaactaaataaacgagtacgcgtgtgtttgcgttaatgttataaacctattacttggtcctgtgtgttaagtgtgtaagtgcaaaaatgcataagtaagcttcgatggggttttttaaatcgatcgggctatctatttagtaggtctactgtatggtcgctaaaaataatatcgtttcagttccagtaaattaatgcacaaattaaatccctataaaatgtgaccgcctatcccgcaggtgcctgcaaacttcggttttatcagtcgatcctgtgtgcattagatatacatctaacgggcagagtgtacaaagcgttaaaggtttgcaaaaaccagaaaggctgataatgggttggtggtgcgtgggctgcttgtcataatgggctacgacgagattccccgcgagctgtgcagtgcgagagaaagaagcccacacacagttaacgggctaggggagcaaacccgtaccaaacatgcatcccatctggcccaacaacgcgcggaaaggctaatgggcgggtgatcgctccccgcctgcccagcgatcacccgtccaccctctcccccttcctcctctcctctcctctttctactacagtagaccacacaaaatttttttgaaaaacaaaagttagaaaaatttatgtgtagaaaatactatatataaaaaatttaaattcaaattcaaatttgaatcgggtatataaacttttgacttataaactttgggtctataaactttagatgtatagaaatactatatacagaaaatatttgaattcaaattcaaatctgaatcagatataattcaaattcaaatttgaatcgggtatataaactttaggtgtataaactttagatgtatagaaatactatatatgaaaagtatttcaactcaaattcaaatttgaatcggatatttgaattcaaattcaaatttgaaacgggtatataaacttttgacttataaactttaggtctataaactttagatgtacaaaaatactatataaaaaaaatatttaaattcaaatttgaatcggatatataaacttttgacttataaacttttggtctctaaacattagatgtgtaaactttagtttcataaactttaggtgtataaatttattaaaataggaaagtaatgcggtgccaaaaaaagaaaccaggtggagggagggaggggggaggtggggagcgaatctgatcgctaccccatccctacggcgatcgatcgcccattaggggtacccgttaatatatgctcttatgtggatatagagagatcatcagttaacttatgcgcttatacaggaaagagagatcgctggttaatataggcgcttaaatggcttttttacacacaagcatgaagagctagcaaaccacacaattacacaaattccataatttattaaaaattttggcataaccttccctctatacatgggcacccatgacgagcagttttgaccacaataacagtcatacatattatcacatttaaccctgaagaagttgaaaaaaaatacataaaacacagaacttcacatcacagcttacatatgcctagagactgcagcctccaaacacaccttggcaaaatgcaaactgacccagctcacattgcgacagatttttttgtcaaacaacccttacattaacatgtaagagctaacaaccatgcatacaatacatcattagttttctgatgtatgccgccaaaacctgaaaaaaaatcaacactctttaaggttggaatcctgggcatatttacaatatcaaactgaatagaaagatgagtatatttcacaaatctagtttgcctgtcaaataaaagttcacatgcctaaacaaaactgacaaattcttgggcattatcttaccaaccctcctgccaattgttgtatgttaaatacaaaccctcacaagctttcatgcaaagctcgatcggcacagtgatatgtaaaatgcacataaacaagattgttaacatattgagttcttgctaaaaaaacttagttcagttgtctctaatttttagtatatccgtatatattgctctaactgagcaattttacggtccttaaggaggtaccattttttctattgtaaatttggtaccttttggtacctaggtactatgagataccatgaggtaccaaattttgcactaaatttttggtacctcatggtacctcctcaggaccgtaaaattactctaactataaatagaattcatctaaagttctaattagatgaatgagcttg

SEQ ID NO: 17523 - DNA, 20780 bp, Oryza sativa
gggggcatggaattttgcagggggcccccttgccgccctgggggagggcgatttttgggcccccccctataaagcccagcccctcctctgttaaatttcattatattcactaaaaatccagaaaaaacgaaagagagagaggggagggcagcagaagcggagcggcgaagccctgctggttcgctcacttcatcacaggtatgctcccatacatcttttgcatttgtactaatatgttatgattgagtatatatgttgcgttttagttttagttccatatattttagcacatatgtgtagatccagagcatagaatataatagtatgaattgagacatagacagtagtgttaattgtaagatgtagtttagtttgatctggagaatgtaacgtacttttagaaatttagaggacaatattgtagagaatgtaacttaaggcgtagtacagaaatgcgaggttaacgcagttaatgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgctggagacggtatgtgcaaatggcttttgaacggtcatggcccctcgttatatttgtgtcggtacaagagaaagatacaaatgtttcaatgcgaaccgaagatgtggagggtcctagcaatgcaggggatgttgttggaccatcgatggaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggacttgtcatatcagagggtgatcatgtaccctgggagtataaggagaacgaggtaattgagggtgcaaggtatgctcataaggatgagatgaaggaggcggtgaagcattgggcagtttcattacagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagattatttagatgaggtatggcacatatgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaatgagttgtgggacaagttggatgagttgacaacgaagcaaacagacgagcaatctcgcagaccacaagttgaaggtgacgagcctcccatacctcttggtgcattacatgatgacccaccaacaatgagaaggaggtcagggtcgtccatcagaaatttcagtcagtggattgagaatgagcctaaggagaagtggtctctattgttcgacaccgatggatctcggtatggcataatgacaaccaatttggcagaggtgtacaactgggtaatgcgaggagttcgggtacttccattggttgctattgttgaattcatccttcacggcacgcaagcctactttagggatcgatacaagaaaattggtccgtccatggccgataacaacatagtgtttggcaacgtagtgacaaagtacatggaagataaaatcaaaaaggcacggagacatagagttgttgctcaaggcacacaagtgcatcggtatgaaataatgtatgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattttttcaggaaagaagcaatctttcatacatggagtgaggaaatatatgggttcgggatctcaggatcttacacaacgctgagtgcccaagttttttatattcctgatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaaaaatgcagaagttccaagcggcgcagatgccagtccatctggacaggcaagtgatggtaggcgaccacctggtgaaggaacaacaagcaggcgcgcaaggccaaggcgtcgtcgcgcagcaggcgattcgatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgtgaactattcggtgttgtatcataatgttatcgtgatgagtgttcggactaagtactcatatcgtgtaactgcagttattgttgtaatcagaaatattccgtatggtgacacttttgtttgtttgtactattgtttaatatgtgttagtaattcgcttatgaacatttattacttatgttgaactaattatttatatgtttctgatcaatctatttgatgcaggtatggcgtacgacacaccggcgctgttgaaccgtgcgattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgaccctgcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccgaccagcacccttcctccgtactctacagtcgggcctagcaaggcttggttgctccagttcactgtaagtaaataagatgttattatcatacatgattatttgcgaccggatgagtgttttgtactaacatttcattcttaactgtaggcggaccttctgcaccctgaagctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccatagggcgaccagtggtggacagcgcaccctacggggttggtcgcagcgcgcagtggccagaggacggtcccacgatggggacttactggtgtcgacgtggggttagtgcaacttcgctgcgttataagtttatcagtcctcttcttttttttttccttcacataacatttctaattccgatcatgtttattgcagcgtcgttacgctcacgtgcaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagacgaccgtccccccttccgaccactcgtgagttcggattgttcatttcgaaatttttatgataattacatcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatttcatttatcttgcataaaataggacaactactgaattttttatttccatcttgcataggctgatgccgcacgggatatcagtgccgatatcaccgctgtccaggtgaggttgaacagaggtttgcacttgactgacgttgagcagagggcgaccttcgaccggatgcaggacaagatgcgtgcggtcatgcgcgtcttctcctgtcgcagcgccgtggacgtcgtacctccagctggtccggtacacccacggcctcgcgcgcctaccgtcggagcaggacctcgtttgccttcgagcgcccctagcttcggagcagtgcgacctacagcaccggtttcgcacggtacagttcagccaagatattagttcatttttgtttcagcttttgcacgaatgtgtcaccatgttttaactgcacgtttcctcatcgcaggacctcgtctgccttcgagcgcgttcgcaggcacgaccggcgcttccgctagctccgcagggccgttcgccacctcttcgggcgcgttcgccagctcttcctctcacggagcgtcgttccctcgcccacacggtactttactttttattactactgctaaatacttgtacgaatctgatggtccttgtccagcaggatatgcagccgggatcttcggtactggggcctcttcgtctcacgccggtaggactggtcctactagccagttctacgacgacgacttgcacggtgcagaccaccaggacgtactaggctcctctcagctcggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttctgccttacaaacttgcaaagcagtactacttttgctattactactgcagtactacttgtgtttgtctcgtctacgtagttcttttcattcatatggtgcttgaacaacttatgctcacaacaacacactttcggcgcttcacggtagtgccatatccagtagcgcgcacagtccacaacagcacacatgaaaagcggcagctcgagttatcactatcaactttcgacgctgcctgttgacataaagtgaatcacgcctacgcgtgatcgtcttgtcacatctaatgaataatgtatctcattgatttcacatatattgcagtgaaaacgacgctatataattgacaatctgaaggcaacctcttcatatcttctttcccactagctcaccacacacgaaaatggaagcctattcattggtaatacgtaatttagatttgagattatgtataacattcttcactacaattttacattttggcagcaaaccaaatatgatcaaatgcaattttaccttactaaatatttggtagtactaccaaaacttgcttatattttggcactaacaaaatatttgtacggtaacaatccaaatatgccctaaaaaataataaaattgtattttaccagtctttgagattttaatcttgtatagttttcaatataaaaagatttcataactattgctatttatataaaaaaaaatatagagcacagtacaaaatcgccctcccccagggcggcaagggggccgcctgcaaaattccatgccccctcgccgcccatttgcaggcggccccccgcacagtacaaaatcgccctagcggagggcggcaagggggccgcctgcaaaattccatgccccccctcgccgcccatttgcaggcggccccccgcacagtagaaaaccgccctagcggagggcggcaagggggccgcctgctaatttcgttgacggccgtcgcccgagagcgaacggccggctgccacgtcatttacgccgccctctaaaaatcgccctcccagagggcggtaggcgactatttccgtcaattttcaaaatggaaaattatttttgtaaaacttttaataaaaaaaattataaataaaaaaaactcgtgattcgcttacgtggcaaaaccagacgaggccttgtatagacggaatcccgggcccattgaaattagcccttcaaggctgaaagcccactacactttgacgcgtagtggactggcattacacagtgaagcttagactgtgtttagtttctttcaaagttaaaagtttaagttgaaattgatacgatgtgactaaaaagttatatgtgtatgataaattaatgtgataaaaaaagttaaaagtttagatgtaaagtttggatctaaacacagcctcaaactcattgaccaaactaacaaccgcgtcctcgaagatccatcgaccgctgactcagctcactgctcacctacttgagtgagtgagcgtgaatcgatatttccgttacattttcctgaccactctgattcgctgattcaatatttgtttcattgtttgtgatcgattagatctgaaccatcatcctctcacgtggatataatctcgtcgtcagccatgcgtttatcacgtggttatcatagttaccatgcgcggtacattttcagattgggtaaagaaagtgataatgggtagtaaagttgatgtctaggtaaatgatcaagtggggccttactttaaaacacatagagtggggccttactttaaaacacataaaggtttgaggcagggagatcctctatctcctcttttattcaatttggcagctgaagtactaactttactagtgtaaagagctgaggataatctgctgataggagtactgggggataatgataacaacaagatggtcattttacaatacgctgatgataccatatttcttctatttgataataagacatgcaaaaaaatctaaaatacatcttatgtttgtttgagcaattatctggtctcaaaatcaacttcaataaaagtgaggtgttctgcattggtgagactgctgataaggcagaggttttcagtcagatatttacttgcagtgtgggtgctttgcccatgaaatatttggggatcccaatagatcagaaacgcattacaaagaaagattggagaaatgctgaaaacaaaatggaaagcaaactgggatgctggcaagggaaacttcagtcaataaggggagattaatcttgatcaattctagtttaagcagtgttcccatgtatatgatctcctttttcaagttacccaaaggggtgaaagaaaaaatggatttctttaggaggtttctttggcaagaagaccaaggcatcagaaaatatcatttagtgcaatggcccatcatctgctcaccaagagatcggggggtctaggtgttctggacctagacattatgaataaggccttgttggggaaatggatatggaatttggaaaacaaagaaggttggtggcaggagattcttaggggaaaatatttgaaaaataaaaccttgtgtaggatcgagatgtcgactagaggggggtggtgaataagcgatttaaaactaaatgacacctaatcaacactaacctaagtggctaggcttggtgagggtcaactctaactaagcaactaagttatattttgcaaacctagggtgatagtggctcaattatatctctaggaaagtaaatcacactcctatgttaatgtttagcaaacctagggtgatatgatctcaagtatgtctctagaaatgtaaattgcacaaatgtaaatgcggtaatcaaatgagacaaggagacaagagatttttcaccgaggttcggaaacttgccggtttcctactccccgttgaggcgagtccaactccaccgcccaaccacgaagccaccgcacgcccccttcgtcaaggggtgggcaaggcgggagccggcccacggagaggactacccaagcctcgatcactcggggtagttcttcctttactccgaaggtggtgaactccaaaccactcacaattcgacgcctggcctcctccacaatcttctcggagaggtcaccgggcaactcctccacaagccgtctaggaggcggcaacctccaagagtaacaagcaatgacccggcgtggagatgattaatcaagtgccacactagctctacaaatggaagcaatgcacttgactcttggctagaacaacctcaatcactacaatggatgaacactaagctcaaaggtgtgtgagagaggtacaaggggtgtatgcaattgaattgggtgccaagagagtccccttgctgctggtgggggagtatttatactcccacccaccaaaactagctgttgggggcgaaatcccccaactcagtgctctgtcggtttgaccggaggtatgtgcccgatcagaccgtgctactctacaacggctagttttctagccgttgtagggctgtcattgggccccactgcctcggccggttagaccgacatggggtgcccggttagaccggcctcggctcggtcagaccgtcctcagctcggtctgaccgaatacggctccggcggctcgggatcggccatcctagagcatgccatcccggccatatggccggccggtcagaccggccaacaccttccggtcagaccggcattgatacggcggtcagaccggccatgacatggcggtcagactggtgacaccggccggtcagaccggaatctgtccggcggtcagaccggccctggcagtccagagcagtgacaaatatatagcaagtgcatgttgtgaaatgtgagcacaagtctaaatgcaaatgacctaatttggcaattaaaatcatccctttgctaggtcattacccctcttaatagtatggcgaagctaaaaataaactagcacaattttgatcgccccacgcctcgatcaattcaaaatgaaaacactagtttatcgtcttctcttccttttgctttgcgccgtcaattttaatccatcaataatcatccatgcacacacatgatgtcaatctaacttaaaatatagctcaaaagaatggttagtccacaattagcacttgtcattaattaccaaaattaacaccgggggcctagatgcttcaccttgtctgaggtaacttttaaacagggtaattctcatttctggcatgggttgatggaagtaaaggatgattttttttaaattttgttcaaaaaagtgggaaatgggaaaagaactttgttttggaaagatagctggataggtggaaacccccttaacattcagttcccaaatctgtataacataactttgaccaaacatgtgacaattgcaaaggtgaaaatgaaaggcttgcaatgtatcaaattcagaagggatctggatggagataaaatgagagattgggtgagaatcaaaaatagtttggaaagtctgatcttataggatgactctgaagacaaaatttgttggaatttgacaagggatggtatcttttctgtgaaatcgttttataaagcccttaaaatgcatcaggtgtcttttccttaaaagagaatctggaaatttaagattcctctgaaaattagaatttttatttggttgtttgttaaaaacaaaattcccactaaggaaaaatctgtacaaaaaaggttgaaggaagggggatgaaaaatgtccattttgtgacaaaaaagaggatatacaacacttgtttttgattgtcctttggctaaattactctggaatatcatgtgttgggctctggatataattccaactttgaatcatcatgatctttttgacactggcttgatagatatgataaaaacatgaaacacttgattgtgattggcttagctgcaatcatttggacaatttggaagtccaagaataaaacatgctttgagaataaaattccaagagatcctactgatttggtctttatggcttgttcctgggtggattcctaggcatctttgcagaagttggaagcaaactgaataacagttgggagctagactcataagacagatggcaagtgatatcttttgctcaagacatggatggagacctgggatcaggaggatagaaggatgaagatgttctctttttttttgtgatctgttttatccctttgatgtcagaatgatgtaatcgtgtctagccatccagcccgtgaggcatctggataagctttttagttttttttttcttctttgtttttgcctttctgacttagtaaggatattttcatttctagtaagagaaatgggggctttctggccctagttctaaaaaaaaaatgtctcgcggttacctcgcagttaccgtggtatccaccttaccgcggtggaccgataactacgccgaaaacggtaaggggaaccctactcatcgcaatgttaaggcttagggggtgtttagatccaggggcgtaaagttttggcgtgtcacatcgggtattatatagggtgtcatatggagtgttcagacactaataaaaaactaattatagaatccatcagtaaaccgtgagacaaatttattaaacctaattaattcgtcattagcaaatgtttactgtagcaccatattgtcaaatcaaatagcaattaggcttaaaagattaattcacctcgcaaattagtcgcaatccgtgcaattagttatttttttagcttatatttaatacttcatgcatgcagatgtttaaacgttcaatattacagggtgaaaattttttgagagtgtgatctaaacagggccttatacaaaatttgcatctcctcaactgtctccggccactgcgctgcatgtctggccatgcgcggtcgccacgagcccacgccgacgctctgtatgtgttgctcctccgtcgtctcgtacgtccgcgaccgccgcgcggcgtgtgtgcgcgaggaggatggttgcagatggcgaccgtgacgcagggaggcctcgaggatcaatatgtagagatgttgcggcgtcacctgcgctcctgcagtggcgtttgtgctaccgacggaggcgctctggcgaggcggtatgagaggaacaggggtttcggagaagaaaactccaaacccctttgggatatcttgggccgttcgctacggcccagaggactcacagtccttgggccgaggaaggtggtacagtttggcttgagttctgtcaatcgagctgttcccgttccgttttgatttcccccaagagggtgatgggtcggccttctttaccagccacctaggccgaccacattgcgcagctcggatggtccatttcttgcctggctggccctgactatttgctcaaaccaactatccgatccacatcaagagttaatccaaaccatctaaagtcacaatcatctaaacgtaatcactaacagagcacaagagtgcccgactgacctaaggatgggccaatcggccccacatgtcaacccagccagcctctaactgacctccacctgatggtccaacctatatgtataatacgtgcttcatgcatatagttggtgcctcgcagggcggatccagcgtgggtgcgggggactcgagtccttcctacctcgctggattaccattgatagaaggagagatgaaagagaaagaatagagagaaagagaagagtaggaggactgaataagtaagaaagagatgagtttctccttaaatcttgttctgtatccgttcgtgcctcggtaatgcaccatagtcgcaacccgtcacttttggagacgacgattcgaggtagcaggtcggaagtctcttttagagatgctttgattggtcttgataaagcttgtgagcattgccttctcaatctttgccacttgttttgaagctcttgtcgctcctcctcggtcaatatttagtcatccatggtgagcatgtccttctcgtcttcacttgtcatagtcggagaaaacctcccttgattaatttcagccgtattaacctcagcccagaaacatttctttggtacacttgatgtttgtatgtagccaatttgatcaaaaattaactttgctgatttcctattgtcctcggtaagaacacacgcatacactaacagattgatattgcctgctgcctgtcggtcatcccggtcggactggtattatggtgtaggttagaccggcttccgcgaaagcggtcggatagatcagcggcaagaaccaaacgatcttgccgatctgattaatatatgcagcggtaacagcttgtagattcatttttttaaggctacaaaaaatactcgtgcattgcaacgggtaaatattattttaatcttgtaattgttatacggtttagctagggtgaaattcaccatggaaattcgcttggatattttattttagaaaatcatgagaagcagttaggagtctgacatttatctcaaattagcatgcaagtttttttaaaaaagatttcttatacgacttttttttatttccaaaagcaaacggacttaaaatcttactcaaatacagatctgtatttctaaaagcgaacatacttaaaaactgactcaaacacagatgacggaccaaaataccggcaaaaacatatttattttttataatagtagagatagagatagagatatggtttagttaaggtgaaattcactgtgttaaattcgcttggatatatattttgctagaaaatcatgtgctgcaaacagcagtctgatcatctcaagttagcatgcgagttttttgaaaagatttcttatacgattccttctatatttctaaaagcgaacgaacttaaaaactgactcaaatacggatttatgtttccaaaagcgaacgaacatgaaaaccgactcatacacggatgacgtaccaaaagtaccgacaaaaacatcttcaatttttataatagtagagacactcaggaccgctactgaacgcgtacgcatgtgtaccctattttctagtcgagactaccctaaggacaaccccgaagaaaagacgggaaaaacccatcgaggtgaagccccatgagtccaactagcgaccgaccgttcacaccacagcgaatgttccaaccgagctaagctcgttcctcagcttgtagattcattttggccatattggatggctgaaaatcttgatcaacagtgttgtcaatttgtgttggagactattgcaattaacacggtctcacctaaatatttgtgatgctaacaaagtcatcaaccaccttgatatagaaaaactctcgattaggatgggtttagaaaatatgaaaatcgactagcggagccaatgagagatcaaaccagcctttagaatgatttagatcaatttagaggacaaacctacaagggctgggtatcgcactctcgtagcgaggacggatgatttacaccataaattgacaaagatggatgaattaggtactatatgcagctatagaatgtaaagtagaaaatatggttgaaaaataaaggaaaaacaacgattcgattgattgtcaagtgtaggattcaggggttagaattaaatcagccataacccttataaaagtgttggtcttgcatctataagtttcctccacatcctattgggtttagagatcaaataggaatcaaaaaacatcgggtccaagtaagtaaacacaagaatagacttaattggactcggtcttggggttgctagtcggatcggccgtatacctttggtcggacttgcactatgcagaaggctcaggttattttccatatctagccaaattttagttgtcaacaatactcttttttatatactctggtgctttataaaaaaagtctatcgtgtgaatatttccagttgaatttatctttttgtttatttagtttctaacatatgggtcaattttagagttaaaattttatgaaatggcatatgcatattgtatgaataatgaagtaatttaaaaagtatcacataagtttagccttctttctcctcaatgttctttctttgatccatgttagactttgttctattctccttaatttgttagtttatagctcctgtccttttgataaaaaataaatacgtcgtaaaagtgtttggagtgtttttttggaggggaggggggattatagcttttgttgatcaatttttggtacaaatttgctattatatttttaaattaatttcagtcagtttttataggattgttctcctctcttctaactaggtaactagttatgtttttcttcattctcttttatacacacacacacatacatatctatgctttctataaggttaatgcccactaagcctaaaactcaacatgcaaccataccacatcatcacctactagcaataattacatgtttaatctcatgcaagcatacaacatgatctataatttatttaattctataaatcaaaatacaagtatatccaatcatcacccctcatatcatttgcacaatattttcataaatctatctatcacttttacaatatttaatatatacttatcgatatgtttcacattaaaacacgggtatcatttgactaataaatcctgatgttttatttttttactcctaacttaaatgtaaaacaaattgagaattacttagtaattcccgcagcaaaacgcggggaatcacctagtatatacatatacgaagcatctaacaaccgacttctatgaagcatatgcaacaaacataaaaaggcttgactgctcgatcaatgcatcggctcgatcagccatcaacgtaccaacacccacgtcaacatccccaaagcatcaacacagagaacacatcccaagcgataacatcccttaagcatcccgagcaccacatccaagaactcattcatcatcaacaaccacgccatcatccattcatctaacaacacacagacatcaaacatgcacagattagcatcaagaactaaaaatcactggaaataagagaacgaaaccgatgacgaggacgcatggatttgagctactggtgtagcgacattggaaggtcatccgccgcactgttgttgaggccgtctgccacccaccgagcccagcaagagggtaggctgcccgccaccaatcgggacctgaggaggggaggccacaccttgccaccatggaggctgtccgccgctcgtataaactcattttgtctcatcgttcccaaggggcccgaccccctctacattacatagcttcattcactaagctctcgaatctcatccgctactcccggcggagcctcggctgtcctccacttgaggagtttaccctcccacagtcgtaaatttccatgtatacattttaacttacagcctatctagaagctccgtacgttttctgtacacatgcacagtttgccgacaagaagacgaagacctagggtggacttacgactgtcgctggcagtggccccaattaagacctggcttactaaatcgagaatagacgtagacctagggcagacgaagacctagggtggacgaagacctagggtggacgaagacttgcgctggcaaggcctattggtcccacaggttatttagcaaatattaattagattatggaaaaacattccttgttagttatttcagtgatcaaagtttaaattatttagagattcctttcttaagcatatgattagctgaaaatacctagattcggtaaaaaaaagttataccacatctggacacaagcagtttattaaaaaacaaagttatttttattttggaatggaggcagtacttattagcatttacttctcttgatagaagcgcatgggtgttgatgtggaaatcgaacacggcggcctgggagatttgcttaactccagtgcaggtccaaaactcgccttcgggtgtatgagcgtgccagttgatttgatcctgcaatcaacaagaaataaagacaaagaaaccgcagttaatcctataaacgatagccgatcggctagatgccgatgacatatcatttacctttgagccgatgtcatatatgcatcgatcggcaatcatgaataaataaggaaaaactaaatctactcgatcggctgtagatattaacaatatatactccctatattgacatatacttaaatcaagtgattgggatagatcggacgccatgccgagaaagtataaatcacttagatcgaaatatatgttaataatagaactatatatgttcatagcatagccgatcagatagatctagcatgtattggctaatactccgataccactctatattaagatattaaaacaagtaaaatatatcaaacaaaagcttaatatactcaaatataataagatcttaatgtaaagggcagacttaacatgtcaatcatgcacatggaataaaagtagttaaatcaggtaagatcggctgaaaccccgatactaccctaatcggcaaccagaaggcaggctagaaattgatattctaagcacgacttaatagatcaaactcaactgatacaacattaagtatgaaaagaagaacaacatctagacaatcaagccactggaagttttatagagtggtagatatcctatataatctaaataaacgtcaatatctaacctgatcagctgcaatctaccgacagatgctggtcgattgtaggttagataacgatattgttagagattatataaaatatatgataactcaacagattacataaacaagattagagtgtcataaagatggaagcactaatcccgagaacgcaagccgccataacaagttttacctcttgttgaagatcgaaaccgatgcagctcaacccaaaagcaagaactcgttgaaataaaactaaagcaaaaaaaggtggcgatgcgccgaattgtattgaacgtgtgtgttaattattacatagggctcgggatctatttatactcgagaattacaagatatgtccataccggacacgactattatctctaacaaactctaagatatcataagtctttacggcagacttttgcccaaacatatctctaaggaaattacataaaatatcctaattaatagatacaatcgcctccttaggactctatccttacgtagcaatcaccgtaaagcacaccaacttaactcgatgacgtataccgagtcatattgtcagaatcggctgcatcggctatccttatctaactcgaactcagtcgatctgaacataaccgatttggactctagccgattcttgctctgtttctgaaataatcttcgtcttggattccacttcgatctaatcttcctcctcgatgtcgatcttaccaaatttggtcgttaacaatggggtagctgatactgtatgaaaactagatgaaacactacgtgttgtggcgaaaactttgtatgcttatctctactactccctccattccaaattgatctacatatttcataggtacacaaagaccaagaaaagctaataactctctcatactatatttactctagcaacaaactcaatgcatgcaccaatatttcctagccaatagcaaatcaagatattgcatgtgggttataaatacttgtgtgcatggatgcatgcatcaatgtccatttactccaatgcacaaataacgaatagactctaataaatgaacacaaatatgtagatcatttaggaataacctcaaaaaaactatatgtagatcaatttggaatggagtattatagaaattaaagttgtttccgctagaattatgatacgtcatccgtatttgaatcgattttagttttatgtttctatcaaatcatttccttaattttttcttatgttagagtgtccctcttatccgagacgtgcatgaattaattgggcccgcaccttttcacgcgctccttgccgcaggcaacaatcaggcccgtgcccgagtctgttttccacacgcgcctttgcgcgccgccgcgattgggcctgcaacgccctcgcgcacgcgattttccgtatacccgatagtgcccgattgggactgcgtcgtcctcgtccatgacttaaaaattgaagatgtttttgtcaaaactatggtatgttgtccgtatcggattcccgtcacgcctaacattcattgcaaggtcatgactcatgagcgaactacgaaagagagtccgtgtgatgcggataccaagcgaatgaaactcgcatagtccatgtggatatcacgtacatagttgcctagatcatctaattctattcatattatgcggcacaattcctaggacatgttagcatgatttcaagtcagtttccacacatgctcatacgtactatcccactatcagggatatcgttacaataatccataataatcattatttacttttgaaaagaaaatgccaaccgaaataaaggatgaacgaatcatcaattcctgcctaagttgagataaaattggacgacaaatcaagctcatgtttaaaggcctcattgtttggcttatgcttattcttataagccaattttaaattttagaacttaattttaaatttgactttttggcttttttatcgtactttattttatagtatttgctttcgagtcgttaagaacatgcataaaaaatatttgcacacaaaatagtctttacttagttataaatgattcggacaagaataaacaaaacagtagattgtaattatttatccaccgacacatatgtacaaattaaattgactttacccgttacaacgcacaagcatcttttctagtagaaataaaatataagttagctagatgagataactttatatacttatataattttcatctttgatgattaaaagttataattgtatttataataatttaagtcatatatagattgatcattcaattcaaaacaaaactaaaactaaggtgatatggcttaatgcaagaaaaaaatagattaattatctgaggacaaaaaaataattaaggtgtcgtgacttaataaaaaataattaattaagtatactcaatggggataatcttttatagaaataattaattacgatgatgtgacttaataaaaacgcatagtaattaattaagtatactcagtagggataatcttttatagatatgtgattcattcggagaacagacatgcacgacacggactgctttggcgtttttcaggcgtatgctatgcgtgcaagaataaataccgtgcagcccgtgctggctgcctgtaagctttgccagaagcaaaggcaaacgagatctcatccatctgtttagtgctcgggagagctagctatacatatcctatatatcgctacgagttctgacaaggtcgaaggctggtaagcgactagtcatatttcctcctgtcccccggatccagggccagtgattccacctatccttcaatttaacggggttataa

SEQ ID NO: 17524 - DNA, 312 bp, Oryza sativa
acaccgccagagcggccagcacgccaatcagcgcggcgatcagcagacggcggaacattgcgcgtaagtcaggccaggaatgtagacggtgcataggcggttacacagagagtcagaaaccgcctattttgcggggaaagctgcggagacgcaaaagctgtgcgtgctaactgccttcgtgaatgttcagcgcccggcgggtacgtccggagctgagataatcgcgatataatcctgtgagatctcaccgttgtaacgtccttcctcgtcaacgatcggcatccagctggtattactttcatacagtttgga

SEQ ID NO: 17525 - DNA, 1203 bp, Oryza sativa
ttcctgcagccatatagtctactccagtattcttgttccggcctccggactacactggaaggcaacattaattctttaattccttctcccccagtgtctccgtgggcgatgcctgtggcctggcctcaggatcgtgaggagaaggatggcaaaggggacgaaggatcacgcggatcaccgccggcgaagcgaccacgaagctcctgtggtttcgagtgagctaacttctactatcttgatccatttatgtttgaccttttgcagtattttgttctatacttctatctattcacaaatccttttgtttatgtgctatgctgcttgttgatataatttcttctccccccttgattagtctgaaatcagaaatttatagatgaaactgaatttatgacaattatttgtgggcaaaccaatgaaattgacccaatctaaaagataaaatggctgggtgagctgattagccggatgattaatacatggattaattattatatattataaaactaacaaataacttgaaaaggttttctaataaataaagaaaatgttattagagaaattatactgtaataattagtcgactaatgagacgagctgaccagcaacttgtctcggtgggatttgaaatgccacctttagttgttctgcctaccatttgagttaacaaataaatcctctctcttactctctcccctcatctgtgcgtagggagttgccacttgagaaaactggtactttctctgtttcacagtataagtcattctagtatttcctacattcatattgataaatatgaatgtgggaaatactagaatgacttacattgtgaaacggagggagtaatttataatctacgtttgatttatcgaaaacaaaataataatttagagagggtaccagactacacattacagtagatacacctagtttccatagaagaaagtattgaaaaaaaccgagcttaattattttcttcgtgtgcatgacagtgacaagcagacatacatgctccaggagatactacgaatgacacagcaacaaaacgagaggatggattatctgtttagggagattcaagagctcgttgaaaaagtttccagccttacagcggtaagagcttaatttgtgtttcagtcccaaagagcaaaagctgcatgcttcagtcttcatggtgggatgaaatgtttgcacagcttgatt

SEQ ID NO: 17526 - DNA, 9361 bp, Oryza sativa
  unsure (1)..(9361): unsure at all n locations
tcctgcgnccctttaatgtcagacaccatacaatcttgaactttcaaaaccattcacttttcaatcttaaaaagaaaaaactcgacacaaaagagtttctgcccgatatggatatatgttgggatccccaaaaatagtttgttggagaatattatgtatatgctcagtgcttaagtggcaatatgcacgcatgtgcatgatttcagaataaaggacaggagccaatgggttaacgaactacctcgtacttaagatattttcattattgggttttctcagaattggttccattattgttgcaaatgaatttgcattttacgacttgaaagtaatgcctttaaactctattgtcaggtaagaagtggatttggtggttaccatcagcaaatcgctgcacctagtaggttggtaatgtttgtgttaacacattctgtttacattaagattttgaattgtacatagatcgaatcgtattacaacatacctgcaatgttgaaactttgagctatgaattgttataaaaaattgtgctattttaactaatgctatgatgttgcattatttataaatgaagaagcacatttcattcagtttttcattttgtcgtatcatatatgttatatttacacctataaacttacgcagtgtaaacagtaatttttatttctgttgcaatatacaattccatttactaatttcaaattgaatataactatgaaatgtgtggtaaagaactagtaaacactgtggttgcatctttctttgttttgctttgttttccttttgtcacataggttttcaattgaattgagattttatacttggaagtcataatcccgagtcattaaaaagaaaagaagattatatacttaaagcatatgcaaaaggccaaacatttgcatttctgttgcaaagttgatggagttagggagagggttggaatttactagccaaaaatcgcgatggtgttgcacatgctgtcatcactatgggtttaacaaccatgatgatcttaatttatctatgtagccgctcttctttctttaaagttttataattggcttgcttgccgattggaggatttacatgatcaaagggttcagcttgcttgctggcttaacctttgccatggagttccactagatatctaatgacgaaaatgattgaattttgaagaccacagcaaggctctctcagtgaaatgataaccaaggctcccacatgttctcgaaaaatgtgctattagttagacctcttttatttttgttttttctaactcgtggtattttcctataccctacaagcacaaaagccatatcctcccaaagaggattggatacatatttatagctgcttgtagcagccatgctagtctaagagccatgcagccatgctagtctaagagggtgctgtcctagagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaggcaccacaagaccaagaccaaccaaccaagacttattcctacattctccccctaagtcttgtgcgccgtcttgtgggaaagttgagccatcccgatccgggagcaaagctcaaggaacttgatcctcccaaggggtttggtgagcaaatccgcaagctggtccttggtgttgatgtagctcgccttgatgctcccttcctccaggtagcttcggatgaaatggtacctcacccggatgtgcttgctccgttcgtgaaaaacggggttctttgccagggccagagcggacttgttatccaccctgagctccaccgctccagtatctctgccgaggagatcactaagcagtcgagcaagccatagcgcctgggtcgaagcggcggatgccgccatgtactcggcctcgcagctggacagggccaccacttgctgcttgattgactgccagctaacgaggcactcgccgaggaagaagagaatcccgctcgtgctcttgctggtgtcaatgtcgccggcgtggtcgctgtcgctgtacccgacgaagtgtgccttgtcaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgccggtactgtgtagcatccacttcctccgccgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaatgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccgagaatcacaaatcccggcggctggtgcacgtagacctcctccttcaagtcgccgtttaggaacgccgacttgacgtccatgtgatggacgccccagccttcctgagcagccagcgcaaggaggagtcgcacagactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgtggcacgccatgccgcgtgtttctcggcctttgcaaaggaccgaggctcaccgtcgtcgcacgcaaggtgcaactgcgcctccaggttgcgaggcaccagtcccggcaccggctggtcgccgagaagatcctccatcgtacggtaccgtagctgctcgccatcatggtacgcgtcgatgcgctcctcgtcgtgggagagcggagtaacgaaccccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgtcggagtcggtggaggctcggggactggggtaggcacgctcggtgagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgcaatgcgcacacgctgtgtctccgggtcgaggatgcggtaggtcttcgagccctccgcgtagccgatgaacacccctggggtgctcctgtcgtcgagcttgccgatgtggccaagctccttggcgaacgcgaggcagccgaagacccgcaggtgggagaccgccggcttgcgccatgccaagcctcgtacggtgtcctaccatcgagggccttggtaggcgagcggttgaggatgtaggtggccgtcaccaccgcctccccccagaagatggccagcatccccctctgcttgaggagggcccgagccatccccacaaccgtctggttgcgccgctcgacgacgccgttctgctgtgggctgtacggcgcggtgtagtggcgctgaatgccctcatcagcgcagtacgacacgaattcagccgccgtgaattcgccgccgttgtcggtgcgcagcacgcgcagcttgcggccgcactccgcctctgcagcagcctgcgcatgcctgatggcgtccgcagcctctcccttgctgccgaggaccatcacccacatgtagcgggagaggtcgtcgacgagcagcaggaagtaacgtcgtcctcctggtgtggccggtgtcactgggccacacaagtccccgtgcacgagctcgagccgctccttggctcggaagctcgtctgctggggaaaggggagccgccgctgcttcgtcaccacgcagacgtcgcagagctgctccacgtggtcgaggcacggcatgcctcgcaccatctccttggcactgagctgcttcagggcctcgaagtggaggtgcccgaagcgctcgtgccactgccacgcctcgtcgtcccgacgagcggcgaggcaaactggttgtgcgacctgcgcgctgaggatgtagagtcgattagtgcctctggttaccttggcaagaaggcgacggcggcgatcccaaatcctcatgagtccgtcctcgaccaacacgcgtgagccgttctcatccagctgtcccacgctgatgatagaattcctcaacgcggggatgtagtagactctggtgagcagcctgtgctcaccggacttggcggtgaaggtgacggagccaacacccttgatctccacgccggaggtgtccccgaacttgacggagcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgaggtggagcttcccgccgatggtgatgggccccgagagaggctgtggctcatcaccatcgacgaccttgaggcgacctaacgcctcctcgatcgacatcgtggagaggtccagcagagattcgatcgagcgagcgatccgtctgtacttctcagggacgcagcggaagagcttctcgacagctctctcctcgtcgtaggtgtcgtcgccgtactgcaccatcttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcgggactgcaacgatgagggcatccagtgcccgccgatcctcgtcgtagtcgacgtcgccgtaccggactgcctcccacatgtgccgcacctggagcctcaccctcatcaccgcggcccactcgatgtagttggttttggtgagggtaggccacccaccgccgggaccaaagtccctgaccaccgtctggacgccgtggtgaccatagcgccggtcaggggagagagagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcggcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggagcaaccggtgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcacaaagcacaaaagccatatcctcccaaagaggattggatacatatttatagctgcttgtagcagccatgctagtctaagagccatgcagccatgctagtctaagagggtgctgtcctagagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaggcaccacaagaccaagaccaaccagccaagacttattcctacagccatatgcaaccaaatcttcacttctttgttgtgtttgttcttgcaactttcatcatttgtcccttctttgttattgacaagctgctgctctgggatggcaaatcagtctgcaccttacatgaaaaaaaagatcatatattttggacacctttattgtgatggaatatagtctgcaatgtagttgcaacttacatgaacttttgctgcgaagttcctgcagctacagatggcctaaaccttttctgcggcctgctacattcctgaacctgcattcaatgtagagatcagaatcacatatgtcaatactcaaccacttatatatgtagcatgtaaattacttgcctctcttgctctctcttgtactgatatcttttttcctgaatttcctttcatcggacatgttctaatgttatgggtagtttgcttgcactggctacatcttcctttagtgtcagttttggataacttcttccctttttttacttccaatggatccctcctcctctctttccgtggccttcctggcatcttgacataacctggtggtcctggctttggatgactagtaattggccactgcatcataccctccattggcatcatgcaatggtcatatattttgttatacacctcaacactgtagcaatctgctatgtaatcttcaggttgctttgagctcacaaataatgcagttatagcatgtgcacaaggaatacctgccaattgccaatacctacaggaacatgttctcttctcaaggtcaattgtgtatctcttatccttatcagtgacctcaaatccatcttttccattccaaatggcttcacagtttccagataagtcaatgtacttgttcaacttcttcaagatatttggacatatcctacctagccatccttttgctttgctcttgttctgttgtatcctcacataaaccttggtccttatgccctcaaacatagatatgattggatgtgccctgatgtcaattatccaattattgaagctctcacacatattgttgtctacactatcacaattggaccctatcctaaaccaagctctactccagtgcataggttcagtgctcatcatgtccttggcaccagcaggagttagctgtgcaagcttggctctacaaaagttgaaaaatggtctacaagatgccttggcacacttccaaaatggcttctggaatgcttgatccctatacttcttcctccaattagcatagatgtgtctagtgcacatcctgtgctcaatttgtggcaaaaattcctcaactgcacttacaagtccctacattggtaaacaaaacacatgaggatcaatattcatgtatttttgttgatcatataaaaataagtagatatcaaggatgcattaccttttgttgctcagaaataataacccaaccagctccatgaggatcaatattcagatctttttgaagtagtccaataaaccaactccaagtgtcttttctctttctcgactactgcccatgctattggatacatttggttgttggggtctcttcctaatgcacatagcagctcaccattgcaagcacctttgaaaaaacaaccatctagtcctataacttttctgcatccagctaaaaaacctttcttgcaagcatcaaaacatacatacattctctggaaaaccggccaattgtattcatgatccaaacaaatagccaccgtgctaccaggattactcctaagaatttctgcttggtactcaaacactttagagtactcacctctgcatgcatcataaatccttctcatgacaatacccttagctctcttaactttcgagatggacacatcagcaaacatatccagcctcactgtcttcttcaaactttgcagtttccatgatggattagacttgatgatgtgctcgtacttatcagcaattcttcggctagtaaccaatctgttatctcttctcttagggcaattgtgcacatcattgaaggttttcacctgaaaccaatcacagtttgttccatttgaggcaaatatgaaccatggacaatctttccatgaacatctagctctgatcttcttagcttcatccttggggaatctgatatgcctgttggttacaagaccatacttgattactgcttccttaaactttgctcttcctgcaaatgtcatgcctatttcaaacttaggtgtgtgtgctttgctatcatactttggaaatctactcttccttcttattgcttcaccatcttctgcatcatcataagaggcttcttcacttgagtccagaaatggtgtatcagtgtcatcatccagtcccttatcatcttgtttatttggtgggtcactgacaagaacagcgttgtcactggttacagtaatagtggcacatggattctgggctgcagga

SEQ ID NO: 17527 - DNA, 2547 bp, Oryza sativa
aaaaaaaaacagcaagggatagcaacaacctaaccctcagtagtgccctaccaccaacgaaatcaaccaaaaaaatttcatcaaccaactgccacacgcacttattatccccttctagaacaaccctaaacctaaagcatgccaagatggagtggggaggagggagggaggaagggagggagggggagggacgcaccacggggctgcgatctcacggatcagcaccgcctatctgcgacgatcatcacctggattctccgccgtcggaagggagagaggagatgatgagaggacttgtgagggagaagagtccaacgcatggaggagaatacgacgtgtgattaatctcctgggttctctttctccacgttagatccaacctagtaagcaaaaccacctaatccatgtgccacatcagcaaagcggattgtattagattagaaaggtgaatagtgatccggttttaagaacctagggggttaagtaaaccaaattaaaggttagggggttatttgctccagggtcatacttgaggggagtaaaactgactttttccttttaataatttgagagttcagagaaaaatgttgtccaattttagagttgagggacaaaaattaagccaagttgctcttataaaaatttgttggtgtatgtgggaaaaaaaacaagtatcttttttcttgagaaagtagccaagccaagagttgagagaaaggaacagtacgcgtattccatgtgcataagatatatgtatcgttgttatatctctttgtttcttgggagaacacataataactgccataaattaaagttagtatcattatgtgtttgatttctttgcactatttttcaggatgttatctgatgattctgatcagaactgcaccgtgccacttcgattacaatttgtaaattcatgcagtaccgataagtactcaacacacaaaatagaagcagatgatgagaacccccttcaggtagccatatatgatcataacgacaagatcgtaacaatggaaccattttcttcgatgagagttcatattgtagccattgacggtgactttgacgatgataacaagggacagtggactaaagagtatttccatagtaaaatagtacctggacgacctcataaaggccatttgctgtctgggaagctgtattttagactgcaaaatggtgtgggttatctcaatagtgccaaattccaagacaattctagttttgttccaagcagaaagttcaagttgggggttatggcagctgatgaaagaatctcagtaagaattcaagaaggagtaactgaatcttttgccgtgaaggatgttcggggatactgtgagttcacgcgtgccattctattctagcattagtacatccattaacatttagggaaggggcaagcagatgagtagtaagaacaatttaactattatgactactaatccataacccatgcattcacacaggctatttatgttacataatctatatatatgtaagcttcatactgtttaaatacttaagaacagaacaacttaatccacaacccatgcattcacacggggtatctctggttttatcctaagtaaaactatcctatgttcgaccaagtttatagataagagtattgttccaagtcaaactatcctaatccagggtgactacatcaaatgtctttatctgcagtaacaaagaagaatcccaatccatccccacgtgatgctgtatataaattgagtaaaattgcaaagaacggtgacaggcacaagttactagagcagaatggtatcaagacagtggaggacttcttatctttctacaataatagcgaatatgatctgcgtaaagtatgagattgattattaacattgttattttgctagctaatttattatctatgcaatgttactgatagtttttttaatatcaccctatgtagattttggggaagatttccgaccaagattgggatttgatcattgctcatgctcagaaatgtagaccaggagtttactctagttgccttaaagagagcagtgtgtctcatgaacatgaggctctttctataagaaatgacagctattgccttcaggaatcattctcaatgcaaccaagccatacactacaaggtaggttcgacctgccctctcttgagtaatttgagtgctcccaatatccaatcatcataatttgctgctggaattagtttctgttaaatgcttcttgattagttcttgattcttcaaaatctcacagaacaacttgatgtgcaaggaatgcatccgcaaatttcatcaacctatgatggatctgttggattatcagacattggtgtgccatatagattccagccaacactttgggacaagaacttgatgcaccatggtagttggtcttttctttctaatgcacatatcttgtgttttatccagttcaaaaggtagattttttttaaccttttttcaggacaacttgaaggcatccaagttgttattgatccacacgttccatcggtagaaagtgtggatatcccagttg

SEQ ID NO: 17528 - DNA, 1387 bp, Oryza sativa
tacagttgcatctccctttggagcattgataatgcctcttttaacagggcacatatccctttggcaaatatgagaaacattagaacagtcaagccaagcgactgctaggttgagcttgtcttgccgattttgccaaatcatctgcaactttgttgagatctctggggatccatttgatgtgaacttcccttccctgcagaaagtttttaattcttgataaagcaggtcctaaagaccagtgaccaggatccgccatgcagtcctcctttttgtgaagcacttgaatatagtgatcaatacaaccaactttttggctgctaggtcggcaacttcccattccgttatcttgacatttcgatcaattataggaagttgagaaatacggaatagaaagaagtagtctagagatttgagaggaaattaagtagctggaaaagaaaacttctttcgttgggaggacgacttactttgattaactcagtacttagcagtcttctaatgtataatgtatatgatgtcattccttgcaatccctagtggggtacttaaaaaacttaattacctttgatctaggttttattggcaaggagatggatataagaagaaataccgacttgctaagtgggacattatttgtcgtccctaagaacaggagggctaggaattcatgacctcgaggtaaagaataaagtgttgattagtaagtggttatacaaactactttatcaccgatggaatatagcaacaactattacgctataaatatttgggatcacaacctttatctcaagcctattggaaagcgggggattcacatttttgggctagtcttataaaggtcaaacaagactttttccgttttggatccttcaaaattagaatggtttttcaaaatatgggcaaccaatgaggttcagaaacttcccctgtcaccgccagacactagctcctctctttttttctttcttccattcatttctttttttttcttccattcgttttcattgtactctttagctctcattagtatgtactcactccgtttcatattagaagttatttgactttttttctagtcaaacttttttaagtgtgatcaatttcataggaaaatttattagtattttcaatacaaaacaaattttattattaaaatatcttcaatgttatatttagtgtaactaatttgatattttagatgttaaatttttctataaacctgatcaaatttaatacaattttacttaataaaaagttaaataatttataatataaaaaactgagggagggagtactagtaaagacgactaactgtagtagaacatgataaagtggtaatgatcgatctatgatgtggatactaatacgttggcaagcacaaactaga

SEQ ID NO: 17529 - DNA, 1102 bp, Oryza sativa
tcgttattctatcatcaaatcgtgctatcgccacgtgcttcatcatcaaatgacgctcaggatgctcctcccctagtgcacgataagatccaggaccgggtactcccaattagattctatctcaaccaaaaattactaaagtattattttattttctatcaaatttctaacatacccttttatatactatcagtatatactggtagcactggtggagaaaccatctttcgtcgatcggccgatttccacaatagtcccggatgcaataaaaaccgtggctaaaaatgatctttagtcccggttcaaaagggtaacgggcatatttgatctttagtcccggtttgtgttaccaaccgggactaaagatcatctttagtcccggttcgaatgctgtcaggtcatgtcaggcccccccgggatcttaccaaccgggactaaagtcgtaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagatgggaggtcatgccaaaatttctattgaatttattttggtgattacatacaaatcggagatgcctaaaaggtttgcaacttcatcctccaatgttttttttgtcatactacatttgcacctatgttttgcacactttttttgtctccaaaatttagttgtaagttgatgagagagaaaatgtgtgtggggaagaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttattttgactcatgtagatggatcggcaatggatgta

SEQ ID NO: 17530 - DNA, 685 bp, Oryza sativa
ggtaaacaaaatatgtccaatgagttcatgaaatggacgtgactaccacgttaccgtatactggattgtcataacagcgacctcactctcaaatcaggtggctactactacacccaacttacaatcattgcatgtcttttttatgtgtgtcagggttatggatactacatacctaatagtagttgactaaatctcgacaggacacaccacataccatgtcctatacggaaacaacctgcggatatatgaggagttctggataagggaagacaaccagagttttacatggaaacgacaaggactactcggattgttggtttccctagttctacttggacagggggacacctatgaatataaatacaaggtcccctaggaggagaggggacaaccccacaatcaacggacacccaccatagaagagacagacaacatacaagccaacatacgacaagacaagacgtcggatatcgacttcggagataggcacggctagtcccctacggtgtctccggatactgataggagagacattgcgctgtctctgatctcgccgggcacgaactcgagaaggaagactaccctgttgtcgactacgagtcagactttcagaccgccatgtcgacaacagttagataggctaccccaaatattatactggtgtgattatggtgaataagagcaa

SEQ ID NO: 17531 - DNA, 3993 bp, Oryza sativa
tttgagtcggtttctaaaatcattcacttttgataatacagaagggaatcatataagaaatctatttaaaataactcgcatgctaacttgagacgatgggactcctaactgcagcttatgattttctaaaaatatatatatccaagagcgaactcccaaaataaatttcattttaattaaaccatataacaataataatattaaaatagatttcacccgttgcaacgcacggacattttttttctatttttttaaaaaggcaaagcttttgtcggccttataaagaaaaaaaaaatcatttcacaatccacaccaacccatttccagaaaattcctctcactgcgtcatggcttggcgtctctccttcctggaccgacccttttatttgtccatccataataattccgcgaaaatctggtagcaagaacacaatcctcctgagttgagagactactgccatagtgccatgcatggcgctgtggggagggctggggcaagcggcgacggtggcgcagctggtcggggcggacatcggaggcctcatcaccatgatcatgcaggcggcgatgacggctcagcagaacaaggaggagtgcgagcagctccccgccgcgtcttcaccatcgccgagctgctgcagcacctgcaggatcccgatgtgctgcgacggcctgagatccggcggccgctgaccgggctcgacgacacgctccgggaggcgcgcgagcttgtgctggcgtgccaggacaagagcgccgtgtacaggttgtgtacaggttggcgatggccgggaggcaggctgaaaagttcagggatgttcagagcaggatcgactcctacctcctgctcttccccgtgatcagccacatggacatcactcgtcgtctcgatcgaatctacaacatcctggttccgaacgacatggccgggccagctatgtctcctgtctccatgccccaattccccgtcccagcctcctaggtacattcgaatgcatgcataatataacctcaaactttcaattgcaatttgtacttggctccaaagggaagcttagaattgaactctaattttgcctttcttccgttatctgcacatctctgtactaggatgctgctaagatgtattggaaggaaccacatggagtccaagagtttagttttaacgagctcgcaaaggcgaccaacaactttgcccctgaaagaaagatcggtgaaggtggcttcggctcggtgtacatgggaaggcttcctgatgggcgggtggtcgccatcaagcaccgttgtcggaactcagatcagggtatggaggtgttcatggtagagatcacaatatcctctcccccatccgctacaagcacattgttccactatatggctattgtgatgtgttggtcgaggagaagcagcggcgcctcctgccaccgttccggaaggaaaaggaggagaaagagcatctgcttgtctatgagtacatggagaacggctcgctggatcaccacctgcacggcccaacgtcgtcatcgtcgtcgtcgccagtgatggcgtcctggaagatacgcatggagatactgctataggtgtgtcgcgggccatcgagtacctgcagtcctgcggtgagcagccgattatccaccgcgacatcaagacatccaacatccttctcgatggcaactgggtgccgcgcttgacggactttgggtatgcgttcacctgggaaggcccaggcactgatattaatgttctttgtggtaccatgggatacatggccccggagtaccttatgacatgggctctgaacccgacaatcgacatctacagtttcggtgttgtgatgctggaggtattgacggggaagaaaccatatctctttaaagaagaatggaaggaggagaagagagaaaaatgtgagcaagatggaaagaacacagaagaggacaaggaggagagtgaacgagaagaagaggagaagacaacagaagaacaacatgagtggcaaaagcgggacgggtggtctagtggtcacagcttggcgtctttaacgccactgattgaggcggggaagtgtggaaggtgctggacaggcgccggcagcggagccaacgggaagccagttgaagcggcggaactggttgggccaacggcagcttcctgccttcgggttcggttggaagaagggtccacccatttggaaattggtggccaatctagagaaggcgctcgagctcgtccgttgcgacgggtaggcggtagcatagcgtgggctcccgagacatcttatgtgaataattgggcaatgtatattctcatcatgtaataattaacgctgttgcttctcttctcttttttttttgtgcgcatacacaattaaacataccaatgtggtgtgatcaacgaacagaatcttatctttttttgctgatttctaatgtccacttgtgcagctgtgctgaaccaacaacccccccggatcacttgctcttagcttgtgctgtgaattcaactgttaagctaggtgcctcccaatatcttcctgttcacctgtttgagtgtaagaaatagttgaagacgcacgaattttaactggttttgctcccattagcaccaaaaaaatcaacaaaatataaggccttgtttagttggggaaaatttttggatttggttgtcaaatcagatatacgaacacacatttgaagtattaaacatagtctaataacaaaacaaattacatattctgtcagaaaactgcgagacggatttattaagcctaattaatccgttattagcaaatgtttactgtagcacttcattgtcaaatcatgacgcaattaggcttaaaatattcgtctcgcaatttacacgcaatctgcgtaattatttttttcctatatttaatgctttatgcatgtgtccaaacattcgatatggcagcgtggaaatttttgttttgagaactgaatgttccgaacgttagcagccctgctactgctctttcttcgtattgtccccacaccttctccctgctcttaaaactaagaatctcatgcatgtctgtgcagcagaatcctctgtccgtctggcctgttgcagcaatatcctgcaggactaaaatttagtcttcggatcaaaacaccacctaaagctgggttcatagggctcaccggctcagaatgtattcaatggatgattgcaaccgacgtattttcccggaaatgtttatcaaaaacctgataatagttggggtttcaaataaaaaaaaacctgataatagttacagtctgcagtaacggacactgggcttcctttgcgcggcatttcatcgaacacttggagctcaagaccaatcataccagtataccgtagcctctccggcgagtcaaaccttccgctccttctctctttcaagagagctcgaggcgaccgcaaagccatggccgggcgtgttgtggcgtgagactgtttgcactatctgcccgattgctcccctgcagccctgccgacgccgcctccgcggcctcgtcatcgtcgagggattttgctgctctagtggagacgaatcgctaggccgaaacggggtcgcggttgacgtgcctccgtatgggccagaattgcggtagtatgggccggccctataagtaagtggaccggggggggggggggggggtcggagaagagaactactagtactccagttccagtattagcaagcagcaggttactcgatcgatcacgttgcagcgttgcttggtttgcatgctagcggatctcacaaatgccatgatgccaactgggatcggaattcaaaactccgacctcctttggcatctccacaaaccgtatattcatcaagcattcgcggccagattatttaacactgaaccgataatgctatcaagcattctataaaacagagtcagtgatcacttgggtgttggtatgttcatgtgcatgccgcaggggacagctaggatgcggcggcggggctgcaggaat

SEQ ID NO: 17532 - DNA, 8480 bp, Oryza sativa
  unsure (1)..(8480): unsure at all n locations
tcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctagggcgaaacccgacgcttaggacgaccctaaggatactaagttcaaaactacttgcgaaaagctaaggtttcttttgttttctttattttcaatagtttgtttctaaaatggttactgatctttctccctccttcaaaattgtagatggcagtgaacgccagcttcagttcccacggttttggtgagggtcaccacgtcgcccagcttcgtgacctcgcccgtttccttggcttctcttgtcccgagtacacggggtactccgtggaccgtgttccccctcactgtgagctctctgtatacctttacccccgtggaggtatacacggagctggccttcgcccacaccacttcaccgtggccaggcccactcaccagatcgcgtaccaggacctctcctggactgcgcttcgtcgcctggcccacgactacagccaccgactcggaggctccgccttccgacagcttccacgccttccttctggccactcagacgccaggtacccttgcccgtacagcgagtctcagccagtgctaactcgcatggtcgagctttcggaggctcaggccactcagcacgacctactccttgaggcttactgctcccttgcccgccgctacgccgctttggaggcccgtctggccgaggagggtgtcacctcagttgacactatctcttgggactcaggccgcctctgccacgccagccacctgtcctcccacagctcccgcggctctgcccgcactcccagtggcccgtgctcccccagctcgcgtgcgccgtactcaccagtgtactccccctacccacacccagttagcccttcctacacccccagacacaccccagttgcttcttccagccgtggcccacgctttatccgcactgcgcggaagcgtattgttggttcttccaccgtgttccgtttccgccacccagctcccccaccgccagcggcccgtgctgctgccggccctcgacaggttccgccggtcccttcgcgccagccgatcgacgtttcttcgactgaggagccgactacagggggcagccaggccgacgaggagtagaggaggcagtcttcagcagctgtccgtgtgttaggcccttttgttccgccgccaactcttttggagtcgtggcgaggtagcgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctatctgagttgctatttgctttgctccttgccctcctaagtgcttatctgactcttaccccgcccttttctgggagtttagatggctagccgcccccgccgtgcagctcgtgcaccagcccgccttggttttgaagatggtagagttgagccagaagcaaatcattaatcagctaatgagcagtctcaccgcagcaaccgttcgcatcgtactgcttcccgtaacgccgaagtcgagcaaccccgccgcagcagcctctcgcatcgcacagcttcccgtaatgcagagatggaacagtctcaccactctcaccccgctgccagtcacaattctggagaagaacgcctcccttccccacctcatgtggaaaacaacatgcaacacttaatggcagttcagacacaaatcttacaaggactaaccacagccatagccaattttcagcataatgcgcatggaaatggccaccctcacataggcaacaacagatccaagctgacagactttctgagatctcgtcccccagagttctctcagaccgtcgagcccgtcgaggctgacgattggttgaaagatgttgttagaaaactcaacttagtgcagtgtactccggttgagaagacgctctacgcctctcaccagctaagaggtcctgccgtagattggtgggagaattactgcaatgctcaccctgaacccactaacattgcttgggatgagtttgctacggctttccgtgcagctcatgtgcctgaaagcactattgacatgaagaaagaagaattcaacagacttaagcaaggcaacagcagtgtcaatgagtacctaagtcagttcaacaagttggctcggtacgcccctgaggaagtggacacagacaagaagaagatcaggaaattcttgaaggggatcgcagttggaatgagactccagttgattgctcatgacttccccacttttcaacatatgatcaacaaagcactactacttgaggatgccagaaaagaggctaccgaagaatacaagaaacgcaagtctaaccatcagggaaattcttcccgaggcgcacctcgccctcgctacggtcaacccatgcaataccaccagtcggtcactcaggctaaccgccagccaggctacgcccctcgtcctcagatgaaccgtccggcacctcagccacagcagcgtgcccctagtggcaatactgcgcctaacagtgttacctctttcaagtcaccgcagggaccatcagcagttcagtgtttccgatgcaaccatatgggtcactatgctagacagtgtcctcagaatcctaccaacaccaactcagggcatgctaatggcagcactgccagaactcctactccagcggcagctcagtctcgtcctagctctcaagcaagtggacaaggttcacgtgcttccaacaactttggtcgaggccgtgtgaatcacattcaagctgaaaccgctcaggatgctccagacgttgtgatgggtatgttctctgtcaactccgtacccgcaatagttctgtttgattcaggagcttcccattctttcatatcgcaagcttttgtgaaaagaaatggttggaaaacccaaaatttgcgtgtaccaatgatagtacattcccctggaaggaatataagggcaactcaaatatgcccggaagttaaccttagaattaaggaagttgacttcctagccaaaccgatagtcctagactcgcaaagcttggacatcatcctagggatggattggttggctaagcacaaaggacagatagattgtgccgaaaagtccatcaccttgcaaggacctggaggaaagcaagtccgctttacccctaacacccctaccgcaagtcggtctatcctaacctgtttgcaagtcacctccttggagtcggtgcccatagtctgtgaatatcccgacgtatttccggaagaattaacaagtatgccaccagaccgagagattgagttcgccatagaattggcaccaggcactgcaccaattgcaaaaagaccctccgaatggcagctaatgagttagcagaagttaaaagacaaatcgaagaactggaaagtaaaggttatgtgcgacctagctcatccccttggggagccccagtgcttctggttaagaaaaaggatggctctgagagaatggtaatcgactatagagccctgaatgaagtaactataaagaacaagtacccgttgccacggattgacgatttattcgatcaacttaaaggagcaagagtcttctcaaaaattgacttgaggttaggttaccaccaactgaaaatcagatctgaagatatcccgaagaccgctttctcaacgcgttatggtctatatgagttcacagttatgtccttcggactcaccaatgctccagcattcttcatgaacttaatgaacaaaatctttatggaatacctggatcagtatgtcgtggtgttcatcgatgacatcctgatatactccaagaatgaggaagaacatgctgaacacctgaggctgataatggaaaagctcagagatcatcaactatttgctaaattctcgaaatgcgaattctggttggatcgagtagcatttcttggacacgtgatttcctccaacggtgtcgaagtagatcccagcaaggttgaagctgtacttgcttggaacccgcccaagaatgtgtcagagatccgcagcttccttggcttagctggatattatcgaagattcattgaaggattctctaagctagccagacctatgaccgagctgttaaagaaggaaaagaaatttcaatggtctgcagcctgtgaagacagctttcaagaaatgaagaaaaggttgaccactgccccagttctcaccttgccagatatccgaaaagatttcgagatcttctgtgacgcatcaagacaaggcttaggatgtgtcctaatgcaagaacgaagggttgtggcctatgcatccaggcagctcaggcctcacgaagtcaattatcccacccatgatctcgagttggcagccgtggttcatgctcttaagatctggaggcactatttaatcgggaatagatgtgaagtatacaccgatcacaaaagtcttaagtatatcttcacacagaccgagttaaatatgagacagagaagatggttagaactaatcaaggattacgatctaggaattcattatcatcctggtaaagccaacgtggtcgctgatgcgctaagtcgcaaggcctattgcaatgtagctcaaatacggcctgaccaagatcacctgtgcagagaattggagaagttaaggctgaccgtggtacagtcaggtgtccctgccagcttgacagtacagcctaccctagagtcgcaaatccgggaggctcagaaagacgacgaagggataaaagagttaataaaaagaatacaggagaagaaagacaccaatttctccatagacgatcaaggcacagtttggtgcggtccacgcatctgtgtaccggccaagaaggagataagagatctcattctaaaggaagctcatgagtccgcctactccattcatccaggaagtacgaagatgtaccaagatatcaaggcatacttctggtgggctggaatgaagcgagatgtcgcagaatacgtagccctgtgtgacatttgccaaagagtcaaggcggaacatcagaggccagctggtctgctgcaacccctaccgattcccgagtggaaatgggaagagatcggaatggatttcatcaccagtttgccaagaacccctagcggatacgactccatttgggtaatcgtggaccgactcacgaaatcagctcatttcgtgccagtgaaaacgacctatgatggaaagaaactggcagaactctacatgacccatgtcgtatgtagatttggctgtcccaagaaaattgtgtcagaccgaggcactcagttcacctcaagttctggaagcagttgcatgaagccctcggaactgatctaaattttagtacagcctaccatccgcagaccgatggttagacggaaagggtaaaccaaatcctagaagacatgctacgtgcgtgtgccttggatttcgaaggcacttgggatcgttgtttgccgtatgccgagttctcatacaacaacagttatcagcccagtattcagatgtcgctgaatgaggcaatgttcggaagaaagggccgcacccccttgtgctggaatgaggggggcgaagcactggtattcggtcctgacatactcaagtcagcagaagaacaagttaagctgatccgagaacgtttgaagacagacagaaccgtcagaagaattacgctgacaatcgaaggcgtgaccttgagttcgaaaaaggagatcatttgtacctgcgggtatcacccctccgtggtatgagaaggtttgggatgtccggcaagttagcaccccgctacatcggcccctacctcataaccgccagacgtggcgaagtggcttatcagcttgagctacttgaaggtctcgcagatgtgcacaacgtgttccatgtatcccagctaaagaaatgtcttcgagttccagaagagcaagtccccctgggtaatatcgagctggaaaagaatctgacctataaggaaagaccgatcaaggttcttgaagaggcagaacgtcagactcgaaggaagaccatcaagttctacaaagtccaatggagcaatcattctgaagatgaggcaacctgggaacgagaagatcttctccgcgccgagtttccggagctgctcccttaggtgctgaatctcggggtcgagattcttgttaggggggttggtctgtagcgcccgttccgtcgtggcgcctagcgggaaaattatctcttaaaaaccctaattgcgaaatttgattccttgcttgttgtctagtgtccgtgccatctcaagatctcaatccccgatctatcgtcaagttcaattccgaatccaaatccttccaatcaaattcctccgcaaaagtctattttgcctcccccgaggtcgatgggccgaatctcgctcggcccatctctctcttcctcggcccatctctctctctctctccctctctctctctctccccccggcgcgctcctccccccccgctcagtctcgcccgctcgctgctcgcgtgtgcgagagccgcgccgagcgcctctctctccgctcccctccgctccgcccgctcgccgcgcgcgcgtgcgcaggagtcgcccgcgccgagcgcccctcccctcgcgcgagcttcccgctcgcaaaaccgcttcccacgcgccgtgttcgcgtgcgcgcgcccgcgcggacgccgcccgttgcaagccgcgcgcaagccgagtggccgaccgtctggtcgccgccgccgtcaccctctgccgcgccagcccgcgcctgtcgcccgtgtcgtcgcgccgctccaaaccatcccaccgtcatcgccgtcgtcatcccccggcccccgccactccgcgcgcaagccgccaagaggcggaggccgagctctcctttccctctgccgcgtcgccccgtctcctcctcccttccctccctcattttcgcctccgcgcctttgccgccctctatttcgccgtcgccaatcgtcgttgcgcgtgtcggaggagccagtgcgttcgtggacgcggaaggggactccgggcgcgccttcttcttcctcttcgtcggcccgaggccggagaagtttactcccgcgccgtcggcctctcgtcacagcgcccctcctccgcacggtagtgcctctctccgttcttcctcctcgctccatctcctccccctagctttcggtagtagcttgagaagcctccccgtagttagccggcgccgccccgaccgttgccgtcactcgccgtgtgctcgccgccgtcgccgcccgagctccgtagcacccgctcgtcgccagcctcgctcggcgtagttccgcccaatccgacgcaagcgtcgagttcccgaagccgcgaagatgctctcaccgccgggaattagcccctcgggacctcgtcgccgtttccccctttcctctccgccggttgccaccgccgcaatccgccaccgacggactccctccggcgaatccgagccgttggctcgtctcccctcgtcctgtgcagccacccggtgtgctcgccttcgccggtatcgccgtggctcgccccgccgctcgccgctatcgcccgccgtccattcgcggccgggtcgtcgtctacctcccgccggcccgcgtggctgccacgtaggcgccacctcggccgcgaccggataagccgacccggccagccgctccctccgtttctccccgtgcgcgtggtccgcggtgagccgtgaggctgcgcgtgggcccgccgcatccgttcctccgcgaaccgcgcgcgtgcaccgcgtcccagccccgcccacgcgcgtacgccgcatactccctctgcacggtgagccgagccgctgacaagcgggtcccacccgggaccgcgcgtggtgagcccggtccaccggactctctctcctccctcccgcgcgcgcgcgcgcttgggccgtcttgggccggccggcccgttaagctcggtcgagccgccccaaatctcttgggccgcgccctagccgcccgagaaaagtctatgttccctccctcttttcttttctttttcttttccaaaaagaatttaatttaatcctttttcctttagaccaaaaatccgataatcttggaaattcaatatcttcccagccgtaaatccgtttgactccgttcaacttccaaaattccccaaatctcgagatctatctaatggcatgcttagaggtcattaat

SEQ ID NO: 17533 - DNA, 2072 bp, Oryza sativa
tgcgcctcgatactcgagcactctgtgcgagtatcgacggtcgccttcaaacttaaaatctgagtaacaacttgggtaaaactggagttttacaaaagacttggaaaacccgacacttgggtcggtgcttgcgaaccaaatgaatttccaaaaccgcggaccggggaacgtaccgggtgtacggtttcccgctcttgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgtctactgcttgtgaaattgctgttgtgaaaaggggttcgatgtttgaaaaatcagtagctgacgggatcagctaggcccgggtggccgtttgaagagttgttggcccgggaggccgtttaaaaagctgttggccgagtgccaaccctgtttcaagatctaaagactgatgcattgcacatactccgactggacgagacgcactgtctcatccgtgtcgtttgagaagcactcacttagttgttttcagaaaagagttcaaataaattcaattacgaaaacaacagtctttccttgaagcctgcattaaacacttatttcccctggcttgctgagtactcccgtactcacccttgctctatttaaataatccccccccagttgctgaagaagatgaagcggatcctgctgatgaggtgttcttccaggagcaagctggctatgatgagttttagggtttcggcctagttcccaagtcgcgcctgtgatgattggtccaagtcctggcttccgctttctttttgtaatgcagttgtgagctcgggatctgtccgcagcccaacatgactgtaattctactctataataaagagacctctgttgctgtgatattctgtctccctgtgataccagcactgtctcctgggactggtatcgattaacaggtttatttggagcgtcacgggcttgttccggtcggaactagttcggggcgtgacacatatattatagaagtaacttataaaagaagaaaataactttaattaatgccttttttcattgaacaaattatctataaatatatatatatatataagagttacttttaaatttgattaaaatacttcctatacattcataatgctctgaagcgattacttttattaattttttttagttaattccataatttgtgctgattaatttaatttctagataaagttatgtttttatctttacaacggatttacttcaaatgacatgctaaagttatcttcgttttgttctaagttacttctataatatatataaattacttttaggttttactgaatttacttttatatatctaagaagtaacttagtgaaatctaaaagtaatttagacatatcataaaagtaatttgtgatttttcatcaaaatataattatgtgagatctcgttgtaaagatttaattgttacgaacacaacggtgtaatcggatcgtagatcggattagtagtttaagagaagattgtatttgaagtataggtggatggtgtctcttatagatgaagtggtagctgatttatcctagctgtgtagttacgtccaatatcaaaatatgtgcttcttcaaacactgaattgcaaagtattatccttcatctcctcggtactatacactgaacaataatactaccaataatgtcacgctgcatcagcatcagtaacatatccatg

SEQ ID NO: 17534 - DNA, 2710 bp, Oryza sativa
tcctgcagcccaatgtcacgctgcatcagcatcagtaccatatccatgtcacatacatggggccgtcttggcgtgacaggccgggttcgaaccaaatggcacggcctaccttgggagtttctcataaggataattctaccgtcttaagaagatatcagaggtattatatttttatataaaatttaatacctttaaatactaaacttttttaagtataaaaaatttttagtgtaaaatctcgatacctttagatattttctcaagtacataaaatttcttttgtcaaaagggttgggagttttcttctccaaaaccccctttccccctcatgcatgcgcctctccggagcaccgccgcatgctttcagcccctcatctacggcggctgtaaccaaacgaacaccctaccacgaggccacctcctctctacttctctagcacacgagaagaggaagcacctgtttggcatggtgaccccagccgtcggcgactgataacgaaatcgctagttagtgactagtcgcgcgcccttcttcccgcgcggatggacgcgtggcgcgcgtaggaggggagggggcgcggcggccgcgcttagtgggggtccacattggtttttttcgccgttttttggggggtttcatacgggtccttttttatgttttttcttttttttccgtactttcagttttcagttttctttttttttctgtttttcctttctatgtttttttagtttttttaaggaaaaagtacgaattaccccccccccccccggaactattccggtagtacgatttacctcctaaactacaataccggacatttgacaccccaaacacttaaaaccggataaattacaaccctaactcgattcgaaacggttttcagcctacgtggcacacacgtggcggtacagtcagcaaaaaaaaacaaataaaacaggtggggcccacctgtcagcatttctttttcactcctctctccccctctctctcggtgaacacagcaggcggcgggcgggcgaggagccgaccgccgacgccgacgggcggtcggcggcggggatggcggcggccggcgggcgagcgaggatccgacgccgacgggcggccaacggcggggatgactgcgggcggcaggcgagcaaggagccgacgccgacgggcggtcggcggcatggatggctgcgggcgggcgaggagccgacgccgacgtgcggccggcagcggggatgggccggatggctgcgggtggcgggctagcgaggagccgacgatgacgggcggccggcggtggggatggctgcgggcggcgggcgggcgaggagccgacgccgacgtgcggccggcggctgcgggcggcggacgaggagacgaggccggaggcgggcgggcgcggagggggctgtgagcagcggtagatgaggttggcgctcgatgaggttgcggcggtagagctcgaggatgctggccatggcggcctcccgctcctcggtctcctcgtcgttcgtgtcgagctccttcaccgcgaacgttgtcctgtgcatgttcctccccatcacgatctccctcctcgtcggcgacccctcccctccctcctcccccgtctgcccaagcgagccgtcgtcctcgcccctgtccgccgtcgtcgccgcatgccacgccccgctggctctgtgtctgtcacgcccagaaattcacaaataatttccgaacttatttgtgcatgaaatcatcgtccaggaatcagccgaggtacacaaactgacaatttaatatacaaatctatcataataataacgttacatacttacaaaagaaaagaaaaacagcagcggaataacggtctagcgatggcttcagctccgctcccacaggcggctcaactggggtataagccaaacgtcttctccttctggatcctttttcttcaactgaggtttgattgattattgcaaggtgagcatataacatactcaacaagccacacagcaaatatgcaagtgcacaaggataccaaaaaatggcataatatagggctcatttgcaaaaacagcatttagcaaacatttgagaattgtaaaacagtagagtaattaatcatcaattttaatcaacaccgaacaacacacccatgctgctcaggcccaaccatcctgaacaaccatacccggctgtacagatctatctccaaaccaggaatgtaccattccaaaccaggagctaatcaaattagcagttatagcattatttattatggtgagaagtgtgggactaatcacaaaagacattgttagacccgcccataaccgcgggcacggctattcgaatagttttactctggccagaggtgtaccactgtatccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgattaatgttttacaaccgaaactcgtgaaccggtccttaattttcacaagcatgaccatcaaaaccatgtgctcacaaccca

SEQ ID NO: 17535 - DNA, 7406 bp, Oryza sativa
caaccatgtagatcatgattttagatgaattatgagacttaaacggcctcattccgatttcgtatgagttaattacgaattttacaagatttaattccaattaaagcctattaaagaaaagactattccaaattaattaaacaatttacaaatgatttataactgagataaaagattaaatcaacctccggaaatagattggatcatatttgatagatgacatatgttaaaaagaaataatatgccactgaaaaaaaagaatgggtttatatggctgagactaatcttgaccgagtcgaccaagatcggatggcttggattgacctggcaagcgagcctcacgacataccgattgaactacgtgacacgggatcacccaaatgatcaaccgaaaccggcgaacggaaccggcgctatgaacggttctaaactaaaggacgactcaatacggacgaacgaacgaaacacggggaaacacctcgttcaaacaaacgagcgaacaactcaacaacggttgtggctaaaccggtgagctagacacgattcacggtaaagccccggtacggcaaacgataggccggtaggaacctagggatgcacctacggctttacaactcggctaccgggctacggctaaagcggtacacggctgcgacacgacacagcagcgacggcaaacggtggctacggtagcgggacggcaacgacttggcacgcacgagcagcagcagcacggctgtagcagggagcggcacagcgacggctaggcagctagcgcagcggcgacgctagggcagcagctagcggcacagcaatacgacaagcggtgcgcacggcagcggcacaagagcggttacggtggcacatatacagcagctgcgcaatggcaacgtacagcggctaaacagcgacgcggcggcaacaaggcgccggcggcagcggcggtgcatacggcagtcggcaagcgacgcggtagcggctgctctagggttagagcaatagcggcggcgacatgaccgagggattgaaacctaacccgagggaacacggatagaagtttcaccgaaccaaagcgattggagagggagagatgacgacggcgacccggcggcaacacacggagacgacgacaacgctagacaaacaacgaattagattagattggattaataccctaggaaaaaatctacaccggtgaacgacataggagcggcggttgccggcgaaccacggcacaataatgcaaacggtgggcaccgggaggaagaggagattgagaggattccattcccgcaactaatttggaaagaggagcaatggggtggccggatttgaaaggaggaggcggcggcaacaggacacgggcacagcagctcggctctggctggaggttgaagatgcactgtagcgaggggatgcaaaacagacttttggctgggcttctattgcacagcctgatagatggagggatgcaaactagaattcggggggataaggccggccgaatagaaggaagaacgggccgaggactaaaggtgaacttttcctatttcggcccgaaaaggaaaagcggattttaattatgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattattaattttaatcatacaaagagaagttcagcaattatttaaatattaaattaatcattaaatggtctgattataattttgttaagtactttgagtgtccaagtattttcaggatttttcttgaaattatttgagtattggaagtatttttaacaattcaaagatcatttcagtgattattttaattggaaaaagtttttaaatccttccctaagtcgttgggccgatttcggcccaactctttctctctccgcgcggccgaaccggcccaatcggcccagcagccgccccctcctctctctctgtcaaagtctgttttgcctccctccttcaatcgggccgaggaaatgaagcccagccggaaaagtctacttttcctccctctgctactgttcatcttccagctctggacagagcccgagctgccaccttacgccgccttccgcctccaaatccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggagcgatttcttgcgggaggagtccgatctcttcaatccaaggctataaataggaccccctagtcctcctctttcgtttgccccctctcccgtcctctcccgtgacccgtggagccgtcgccaccgtgcaagccgccgccgccgtcgcttcttcgtcgccggccgtcatccgtcgtcgttcggcacttcggtgagcaccatcgggttcgtctcgtcgtcctctacgtgtacatgccctccaaatccgcagccagccgctctatctccggcgaggtcgccatcttggttcggccatgggtgatgtcagcatgacgtcatcggtttttctttttctcgtttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgattttagtctttttgctttagtttccgacgttccggaggagagcgttttcgttgagcaaggttcggaagtgtttgcggaagcccaaggcaagtcacacagatcccaaataaccctttgaacatgttgaacccgtttaaagctattattttatttcaactatgcattatttttgaatgtcatcgggtggtgaacctttccccgttaattaatggccgaagatgatcttattttcctatgggttataatttgattagcatgaaccttatataatggattggttcagctaaatgctatatgtaagtttgcttagctatagaaacattagataactaaaggggttaattataaactatattatattattcttattaattatggttatatttaatggtagctcacgatggttaatcgtgtgatgttaattaattgataattaaaacctggttaaggtgggttgtgagcatatggttttgatggttgtgctcatggcaattaaggaccggttcgcgagctactgttgtgagacattaaccgtaccaaccacaagccagcgtgggcaacggctttattttgtatagcatgattcatatagtgcgccagactgtgaagtggcgagaagtccatgggggtcgctggggagtccatgccttgtttataagggggtgactatgatccaggaacggtgcactgttttgagttgtgttgtgcaaagggtattgtcacgatttccccctttgcaatgccgtggtggtatttcggggcatagcaacatgtgtggaatcgtgtcttgtgggtacagtggtacacctctggccagagtaaaactattcgaatagccgtgcccgcggttatgggcgggttgagcaatgtttttcgtgattagtctcacacctctcacagtaaatatggatgttaatacttggtaataatttgtttagctcctggtttggagttagatctgtacagccgggtatggttgttcaggatggttgggcctgtgcagcatgggtgtgctgttcagtgttgattaaaatttctgattaattacttcactgttttacttctcttaaatgttttgctaaatgctgcttttgcaaatgagcctatattatgccatcctttggaatccttgtgcacttgcatatttgctgtgtggcttgttgagtatgtcatatgctcattcttgcaataatcatcaaacctcagttgaagataaagggtccagaaggagaagacgtttggcttataccccagttgagctgcctgtgggagtggagctgaagccatcgctagaccgttaattccgctgttgttttcttttctttgtaagtatgtaacgttattattatgatggatttgtatattaatttgtcagtttgtgtacctcggctgattcctggacgaggatttatgcacaaattagttcggaaattattagtgaatttccgggcgtgacaaattacttttcccaattaaattaatcactgaaatgatctttccattattaaaaatactttcaatgctcaaataattcaaagaaacttcttgaacatacttggacactctaagtatttaacaaaattgaaaccagctcatgcaatgattaatttaatatgtgaataattactgaaatattctttatattattaaaattaggaattgagcttcgaaaaatccgagaaaattccagagagtataattaataatggagaatttaataaaaattaaatccaaccatgctttatatttaggaaattttatttcccacatttaacttcacttgtaaattaatgaacatttaatataaattctattaataatttattaaataatttataaatcctgaaacggaaattcaggctataacagtgtcccacgtcgccgccgcctcctgattccacgcgcctgccggctctgtgtcccaggtcgggctccgccaccgcgctccgccgaccgcccgcgcccgccccctcgtctcgcgccgccgcctcgtctctcgccgctgcccaccgccttgccccgcacgccgccgtccacctgtccgccgctccctcgtctcacgccgccgccatccaccgatgcctccgccgtctagcgcccgcccactcgtctcacaccgccgcctgcccaccgcccggccccgcgcgccgccgtcatccaccgggaggcccccgaggtcgacgtggtcgcggcacgcagccccccggcggctgccgcctcgcctcacctcgctgctgcccgcgctcgctgcctccgccgcgtctgaactctgaaggagaagagagagaaagagtgagggatagaagagagagagagagagaaaaaactgacatgtggggcccacctgttttttaataaataagttgctgactggactaccacgcgtacgccacgtagaccaaaaccaccgcggattgggtcgagggggtaattcgtccggtttgcatagttggggggtgaagaatatccagttttgtggtttaggagagtaattcggacgaccgcgatagttcgggtgtacaaatacaaaccttatatacacaaatacaaactttgtatacgtgtatacaaattttgtatatgcgtatgcaaactttgtatatgcgtatacaaactttttatacgtgtattttttaggttttatacgtacgtatactaactttgtatacaccttttcagttttctctttctgttttagtttttttccagtttctcttttttctccttatttttaagatgtgcgtatgcaaagtttgtatacgtgatttttttctagtattgtttttgtttttttaatacgacatatacaaactttgtatacgacgtatacaaacttttgtatatatcatatatatatatatatatatatatatatatatatatatatatatataaacttggtatacgcgtatgtatatatatttttatacatataaaaatatattttttttatagtagtaccagcagtatactaatagtaggtactagtagtaatagtagtagtagatactagtagtagtaatagtatagtagtactactagtagtaattagcagcagcagcaggtgcggaccgcgcgaccagtctggtcgcgcattagctgcccccgactgataagagtacggcgttcttgccacgcccgctcgcatgacagcccggccctgtttcgcaaccgtatgatctcgccggtgtaggttgacatcatgggccgaaaccgaatcaaccccaacggtacggtgaacgaacgaacattaattactttacgagacaatcgtgccggcgagcacgtaagccgcgccgatggcgccctagcttctctagctagttctttaccatatatggattcatgcatggacacggcaagtaattaagttcctgaacaattaaacttgaggtcatcgttgtattcgtgtccttcgtcgatcggcctatatatatatgcaggcgtggcggtgaccacgcgggtggccaccacgggagaagatatatacttctatatacccctgcagcggcatgatcaccgtggcgtacgtgcaggccagtcgccatggcccaaaccagacgagaacgtaaagcaacgtcgtcgatctgtgtgcacccagccggcggccatcaccgacgttcaactgtgttctttcccaattttcctaacacctcctctcgaacatagccttaggctcagagatgctcgccgcaccctgcacgtgccaacggtcataagaaatcctcgagttttaaactcccaaccctttcccacgtgtgcaatacctcatttgatatttgattaatttcgttattacgtaatggaaaaattacaaaaaccaccccataaatcacttgaagtttaacatttcaccccataaatcatcttgttgcaaatacccacccctacttaatttgttgcaaaaaccatcctaatgtgcacacgtacttaatcaaatcaatttgttatcggtgctgtatggttatcacaagctaaactagccaagtaaatattgtccaagcgtttgcattagacttatttttcatatttgattgaacttttttttttcatatagcaaaactcagtgcgacaatgtttaagctctattttgcaattttatttgtggaatctcaccgaaaaatatgaagaacactctagaagtatttaattttggtaaagaccatattaacggctcacactttatgaaatcatattgatttggttaaacatgtgtttattgggatggtttttgcaacaaaactgagtatgtgggtggatatttgcaataaaataacttatagggtggaatgtcaaacttcaagtgacttatggggtggcttttgcaattttcccttacataattaatgcaattaatttaaacaaaacaagccaagcaaaagaagtcgagatcaactacatatatatgcacgcatggttagggaacaataatctccaacagaagtactatatatatatgccggtgtcaccgtgtcacgcgtacgtgttccggtgttcgttcgatgag

SEQ ID NO: 17536 - DNA, 1055 bp, Oryza sativa
  unsure (1)..(1055): unsure at all n locations
aagaacgtgtggaaaaagaaaaaaaaaaaaaatggtgaccaaaaggggaaaaccacaaaaaagggcaaggagagtgaacaaaaaaaagatgggaagacaaaagaagaatggcatgaatggcgaaagcgggaaatgtttatcgtcgccacaacttggtgtccttcgcgctgccactgatcgaggcgggggaggtgtggaaggtgctggacaagcggccggcagcggagccaacgccgaggcagctggaggcagcggaactggtggcgcagatggcagtacgctgcctgctgctgcagtgggaggagcggccgcccatttcggaagtcgtggccaacctcgagaacgcgctcgagctcgcccattgcgacggttagcatagcctgngctcccgagacatcctatgtgaattgggcaatgtatttctcatgtaaaaattaatgctgtttgcttctgtttctcttttgtgagcatacacaattaaacatcggaactgctaatggtctgttgacagaaaatagggtgctaaatctgtcacttttttaccattcatctttgtttaaaattcatgctgcatttggattcaatggattgagcaaagtcaggcacggttgtggactttgagatggattgggtttttgctagactttgttgttgtgttctgtgggtcccacatttacggttcaatttcgaaacacacgcctgcttttttgctttttttcctcacatttgaacagtgttttctattgctactttgtttatgatcccacgcttactaattacatcgtacttacactaaaattacatataattacatatgtaattttgtgacttacatcataaatatactaaaattacatatgtaattttattacttacatcataaatacactaaaattacatatgtaatttttggaacttacaatgtaaatacatgccgacttttttttttttgaatattatgacatcatatcataggtactccctaaatttaaatagatgagaataaaatttacctggtaagatgttaatcctatggctcgaaaaatctgcacaat

SEQ ID NO: 17537 - DNA, 2492 bp, Oryza sativa
attaactgaaattcggaattaaaaataagcaatattaaaagaagaatctatataagaactcaatacgagattaactaatatttagaataaataataaaataatattcaaaataagaaaaactaaaagagagttcaagtaggaaaacaattttgaaacaactgaaattcaaaaaaaaagaacactatacggtattaattaaaatttgaatttttttctaaaattagaaaaagaaaaaaattcaattaggaatacaatttataaataactaaaattagtgataaaaaataaagactgttgaaagaaaaggctatctaaaacacatgacgagataaattaagtaacatgcatataaaggagtagagtaacagcggcgtataaaaactgttaataaaacacaaaatagaatcctaatgacgattaaaaggagggacagcaggtaggccgtgaagcaaacaggtaaggcggttgtcgggacttctagaatgtaaaaaaataaaccctattgataatcatattcaatttttaaaatctcaatgacagtaaaaaggagaagcagcggacggggtgtataggagtatagttgtatagccgccgacggttggtggaacttctagaaaataaaaaatgaattatgaattccaacgatagttatatttgatttttagaatcccaatgacaataaagtgtaggcagcgaatggactttagaggagtacagtggcatcatttgacgggacttctaaatattataaaaaataaaacccaacaagacaataaactctaaaacctacaaggttcattttttaaaggttcggaacttctaaaaagtaaaaaaaaaaccaatgataatcatgttcgattttaaaatctcaatgacaaatggaccgtagagtagtatagtggcatcgtttgacgggacttctaaatattataaaaattgaaacccaacaatacaataaattctaaaatctacaaggtccattttttaaaggttcggaacttctaaaaagtaaaaaaaaaacccaatgataatcatgttcgattttaaaatctcaatgacaataaataagggaggcagcgggcgagccataaaggagtacaatggcaaagccaccaacggtttggcgggacttctagaaagtaaaaagttgaactcgaacgataattatgttcgatttttaaaatcccaatgacaattaaagagaaaaaatagtgaacgggccgtagaggagtataatgatagtgtttgacggaacttctataaattataaaaatgaaacccaacgagacaataaactctaaaaactataaactataagatccaatctttaaaggtttcaaaaagaataaatagaaatagtggtagatcgagtaagcaaataaagaacaatatgatagaagtaaggggtaacagctggtgtgactttttaaaactatataattagaaatacggggataataaggtttggttttcaaaatcttaagataaccagatagctatttaataaattttaagcaaaatcatactgaaaagggattgcctacacatttgtcgggtgatttttaacaagaaatcacccagattttttttacacttagatttatatccaacggactataaaataaaataactaatacaaatttgcttattcaatatttttatcaaaattatagtgcacttacatatcatatcaactaaatttacatgtgtaattttagttatatagaactgtaattttatattttaaatacttacatgtcatatcaactgaatttacaaatgtaattttagttatataggactgtaattttatattttaaagaaaataacaaatacatatttacttacactttatttttataaaaattacagtgcacttacatgtcatatcaactgaatttacaaatgtaattttagttctataggactgtaattttatattttaaaaaaaataacaaatacatatttacttacactttagttttatcaaaattacagtgcacttacgtatcatatcaactgaatttacaaatataattttagttagtgtaattacatacaagttgcagtgtaattacactatgagtgtattgtaattacatctgtgaaatttctagaaaaaaatttatcggcaaatatatatataaaaaattgaatagaataggtttctagcgatggtagatttgttaggcatggccgcatggtggtgtaatctagtgtgggatcctagctttggcttggttcagatttatgcacaagattcaagtgcagagaaggtcgtcccgtccggcgatcgtctccactcatcatgcccaaagggacgagcacagtgcgaacaagatcatcccgaccggctgaccacgcatgcagcctccaccatcgtgcggtcagcaaatccgtgaaatcactgggaaaaaaatcacacgacagatttctagcgaaatcgtactgaaaaatatatgattttgtttaggtgctagccgcgcaattg

SEQ ID NO: 17538 - DNA, 795 bp, Oryza sativa
atactgaaattcttaattttaaaaaccgggaaaaggggggggggaaattccaattaattaccagtggcggggcctttatatttggtggattttctttttgtgctaatgggagcaaaaccagttaaaattcgtgcgtctcaactatttcttacaccaatcttcatatcttcctcatactcacacaggtgaacaagaagagattgggagccaggcacctagcttaacaattgaattcacagcacaagctgagagcaaggatccgggggttgttggttcagcacagctgcacaagtggacattagaaatcagcaaaaaagatagtaagattctgttcgttgatcacaccaaattggtatgtttaattgtgtatgctcacaaaagagaagagactcaacagcgttaattattacatgatgagaaatacattgcccagttcacataagatgtctcgggaaggctatgctacccatcataacgggcgagctcgagcgccttctcgagattggtcacgaataccgaaatgggtggccgctcctcccaccgcagccgcacgcaatgcactgccgtctgcgccaccagttccaccgcctccagctgcctcggcgttggctccgctgccggccgcctgtccagcatcttccacacttcccccgcctcgatcagtggcagcgcgatggacaccaagctgcgatcagacctctcgtcccacttataccactcatgccattcttctgttgtcttctcctcttcttgtcgttcactctcctccttgtcatcttgtgtgttctccccctc

SEQ ID NO: 17539 - DNA, 616 bp, Oryza sativa
tgggctttgttgcacaaagctgttcttaaggactccttcggcaatataatttccaaatgaagaagcctacacacaaaatctaccgcacaaccaattggcccgcatataaccgagctctcattaatcgtgggaatattgccatttggttcgatccaaaaacacaatggtatgcagaacctcaaggcaaacaaggtcgaagtcaaacctactccgacatagcgattcaatgctgtttgatgatcaaatctctatttagactcactttacgcatggtcactggctttgttcagagcctcattaaactttgtagattagattggacagcaccagattattcgactatttgtagaagacaaaagcatattgatattgcgataagctatcagaaaagtcgtgatggtctccacctactcgtcgactctactggcttgaagtttttaggtgaaggtgaatggaaacgtaagaaacatcagctgaatatcgtcgccaatggcgtaaacttcacattggtatagatgctgaaacgctgcaaatacgggccgttcagctcacgacaaacaatgtcagtgattcacaagtactcgaagatttacttgatcaaattccacttgatgag

SEQ ID NO: 17540 - DNA, 1363 bp, Oryza sativa
tgcctttcttccgtaccgggtggtttgttgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcattaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcacttttgcagtcctccctagcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggaca

SEQ ID NO: 17541 - DNA, 665 bp, Oryza sativa
ggacgaaggcatatatatggtggagctgaattactttaatttcaactgcttctactaatacattaattgacgtgcaatctcgcaaaagaaactcgtactgttctgatttccttgccagagtaacacagtgtacatatggtgtatagctgaatatattaatgtacttgtaatgttttgttttccttgctatgtatatgcaggcctgatgacaaactggacgaccagaaccaagagctggccaagagcaaggatacaccagctgatgctgatcatgaaccggtggaagcatcgtcgtcttcctcaccaaggtcgtcgtcggtgccatcgcctccagcagctggttccccaccatacattcacccggaggagcctatcctctcctgatgggagcggcaagaagatggctgtgcaacgcctgagctttgtgtgattgaggtctgaatctttttttttcttttgacatttgattgtctgaatcctccgggcttgtttggcacagctacagctccatctctcctggagctgaagcttagataaacagtttcagctccacttaaaataaaaacaaagttgagtggagcgctctcacaaaagctctatagagatgtggagctgggttttgactactccacaactttcacttcaaactcatctcctgaagctaa

SEQ ID NO: 17542 - DNA, 1979 bp, Oryza sativa
ttactctcacgtgcaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggattactggctgaccatcctgccgatggtgttcgacattttcgttgagcctcactgcccgcagcgtgtgatgagacagttcggacttaggcaggtgtttccgggcaacgtgcagccgaccgtccccccttccgaccactcgtgagttcggattgttcatttcgaaatttttatgataattacatcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttccaacaattatttcatttatcttgcataatataggacaactactgaattttttattgagaaaattccctatctagcatcaaaaaaagttgctcttccccctgtagcatccaaacttcaaaagttccctatctagacaccctcaaaatttttattccctatctgacacatctgttgctcccattacctccaccgtcaaaacaagcttggacccacatcaaaattttttgacctcgctctttctggatcggtcccatccccaactccacgctgctgctcctcaactccacgccgccgcaaccctagatcgccggcccatggccggcagcgcggatggcgaccccctgggcggtgaggacggcgattccgcaggctcaggcaccgtttccccatgcgcgcccctgcaggtagtggcgccggcgacacgggaggctaggttgtcgcgggaggtcgggaaggcgaggcggcggtcgttcccggcgacggcgagcgggggggggagcgcttcttggcgatggcgacggcgacggcggtggagacgccgagctcccgcatggcgagggcctcctgcacggcactgaggcagacggctaggtcgtcgcgggaggccagcgccctgccagcacgggcggccaacccccggcctgctcggccggctaatcccaggcggtcgcaggcagccaggacccttccactctctccgctcgccaggttggttggttggtcgtagcatcttgtgaaacttgtttctttctgttctgctacacgccattagtggttcttgctctgtttgtgttcgatcgattgagcactactatgtgttcttcgttagatgctcagtttttgtgtttacggagatttgcttgatcggtgcaggtgatgagggcgatctctgcgtcgaggagggaggccatggcggcggaggaggagaaccgtgcactctcggaggcaaggatcgcgtcgctgtcgctgcagctcgacgagcggctgctgctgcgcgccgcggacgccaggctgagcggcttcaatggcttccgcggcctgctacgcgctgcacaacgccagctcgctgctgctcctcgtcctcacctccggcgccgtctcctgtgccgccgccgccaccgcggcgggccgtgctccgcggagggcgccgcggacaccggcgggttcatggcatccattgcaatgctgcagcagaggatggtggaggaaaaaacagtgaacagaggaaggggaaaaaacgcctaaattaccaaagaagggcaaaaccgtcttttgtcctacttgttaacaccgttaccctcaaaactaacggaagtgctagattggg

SEQ ID NO: 17543 - DNA, 642 bp, Oryza sativa
gggggccccccacagtacaacattgccctagcggaggccggcaagggggccgcctgcaaaattccatgccccccctcgccgcccatttgcaggcggccccccgcacagtagaaaaccgccctagcggagggcggcaagggggccgcctgctaatttcgttgacggccgtcgcccgagagcgaacggccggctgccacgtcatttacgccgccctctgggagggcgatttttaaaaatcgccctcccagagggcggtaggcgactatttccgtcaattttcaaattggaaaattatttttgtaaaacttttaataaaaaaaattataaataaaaaaaattccagaaacagatgtacgatgcgaaattccagatttgcccttccacttaatcagcacaacgcggatggaggggaggtacgcccatcggcattacggtacctggcggtaccgacgttcgttagccgtcggatgggttccaatggacgtacatgattttggtacctcctctcctgctggaccataaaattctttttaattttaaggagctcgcaaaggcaagcaacaactttgcccctgatagaaagatcggtgaaggtggcttcggctcggtgtacatgggatgtcttcccgatgggcgggtggt

SEQ ID NO: 17544 - DNA, 695 bp, Oryza sativa
ctccttacatcgaggagcacttggctctagttcgcgccaggaacatcggtaagtccgatgcatggattacatggcatcacattgatactttccccgcgtggctacgacaacatctcatgggtaacgagtcgatcaaccaacaacttgccttcctggcgaggggaccgtttgggtcgatcgcgacattccagggatatgagatcaatgggtacacattctacacgagagcccaagacatgaagagcacgaaccaaaacagcgctgtcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcagacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccc

SEQ ID NO: 17545 - DNA, 1589 bp, Oryza sativa
tatccggctaattttgaccatcccccatggcttccaaaactgggtcttcattggaaatcctttgcgctgagtcaagtaacaagttgttgccttacagagttgtttcccaaaagacatcttgcccttgtaaaaccatttgatacccatcacgaatgactcttgtagctttccaagaaggtgaataagttctgagtatagaggagcagcatcaggtctgacaagtagcctagacaaaataacttcagtaagccccttttccctttcagagagggtaaaattctcagcattaggggatagggatcgaagtgcttttacatatggcacattctttggtttctcaataagagattgctcatccaaaagcagcctcaactcaacccattgccaatggaactttgcaggctgtaggacattcagaatttctataagcctctctggaaactttacatcattcttggtactagcttctgcacaaccaggctctaaagcatatgtaccatcgtctctcattgttactggtatttcacaatcaagaagagcattcaggaaaacccgggcacgaagaggtgaaagagctttcaaacattcatcagggcttcgaagttcaacgattgcagcaaactctgaatcaccaacatccgcagccagaagatcatagaaaagatgcatgttacggaagcagacatctcgaaaaggctgatgtcttgtgatatcactaattgcacccagtagagactgataaagctgaatgtcttcatgattcgatgtactggtgtcatataaatatggtcgccaaaggaccatagcaaatattgaataagctggaggaagaactatacccaatggaagcgtccgttgcaaccttgaaaaggcaaggacataagaatcacctagaatctctgcgatcactccattataaactgtcttacagttccctattagaatcttaaaccaatgtaccaaaacttcagtggaactgtcaattttgaaatttccaatggagtgggtcacaccatttgtgctagctttggaaattcttaagaactgcagaatgtccaaaccttcttttaatcttaggaccaccatcatccgctctagactgacaaccccataaataatagctccaacaactagtgcagaaacagcagcagaaacttttacagccttaacattaaaacattttgacggattacttggaacttcatttgcatgatttccactttcatcatgggtctcagaagactgttgactgcggtgagccttaggaggagcaaaagatgctgcaacagctgaagaagcttcaacagcaagagatatttcaaatattctactaaatcgatcacctaaagtttctcttagcaaggccagagagtttatgtggatatccaaaatgtgttgaatcaagtttaatgaattaattgaggtaacacctggattgttaccacctgaaatatccaagtgtttagctattgcatgcccagcattgtcaacaattgcagaaacagcagaagcaactaaagaatgatctccatctggatttgctcctccattttgtttgatacagtttgccaatcccaaaacaatgtcat

SEQ ID NO: 17546 - DNA, 1189 bp, Oryza sativa
  unsure (1)..(1189): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggacacataaaagcctatcgaataggctttcacttggacaatcaagcaggacatcatccatgtaaggttcaagtgaatctgcatcttcatagaccacacgtgttccaaccaagcttaataaggaggaagctagcgtttgcctcatgttactacaaaatatccaaagccaaaaagttagaatatagcataaatatttcaaggacgtaaagtgcaactctgtgaacttaagatgtcacacaactaacaattaaagcaaaagtatcgcaaggaaagattaagataacttatttaagcatgcttaaactcatatttatcacatttctccagctattcatggcaatctagaggagccagaacccactcagctaactaatccagtcaagctcgtaatgcaagtgattcaattctctatctaaagtcgatgacatgattgtcataaccactgaaggcttgatttgcaacaacccactacccaagtactaaccatcctgcttaaatatttattaagttctgttagttgaattccagatgccactcgctgatatctactgataattgaaaagtagccctctattttcataaaggtgttcagattgaagtcccagcaaacagaaaaaaaaaaaactaaatcgctgactgttcgtcccagaccggttttctaatttttaggacaaatcatgtaatgctagaatgtgccacaaaatcattaaatattacctgtctgcaataattactggaagtagcctaatgatgaattgcaggcgcaaccatattgatgatcgtaaagctgatgcggaaggagtagttgaatcattaggtacagggctatgcttcctgatattcggactaccactgaagattcctttgcggccattgggtttactcaaaccttcatttcctgaaggatttgaactattcagtttattaataccgttccacactgctgctttaatatgctcactgatcacacccatatgtttgatcaaatcaccagcaaatacaaagcgaaactcgctagaacttctgtctatgca

SEQ ID NO: 17547 - DNA, 1957 bp, Oryza sativa
agttgtaagttttctatgaagttcttattgtcaagtaaccttcttacaatttactatatataaccctgtagattgatgaaacatgctacacttgagtcaccatgcatatactcctgtatagaaatgcttaatagaggctggacttaaaatttcaagaatgaagtagttcaagtacctaatcccattagatgaggaataaaaacttgcaaaataggctattgtgttgcaatctatctgtttttgggcaattctatctagtaataagctgctctagtttttgtatatttgcactctctttccattggaattgctagttaagagtgagttggtagcattgatcttctgagataacaggcttggtagttgaagtaattaattatatggttttagcattcaccatctgccccgctctccagttgggaagtaagggttggagaagggcaaatgctcattcttcaaaccaacatttaagatcaaagagacaggtggagcacttcttgttcatcatgctgacagttctgcttctccttcaggttatcactgggaaagggaatgatacttatcagattgaagtcgataaaaaggagttctttgatgatagggaagaatgccgagaagccttacaatatgttgatcaattgcatcgagctggaatagacacctcagaatttccatggaggtgtgtttccttttaaaccgctaattgttagggcttgttcactttctaatactttaggctttgcctttgttttaccaaaagaaatccagaaaattttccagacaatcaccaccttttcatctaatgcacactttgtgttttagtttagcataatttcttgtttttaaaaaaaagtttggtataacttgctcagagttcttttatgaaaaagtttacttcaaaccagaccctctgttatactgattccgtcgctcgatttcttttgtttcatgtgaaaaccaccaaatcgcttattttgcttcgttgtgatttccacaggttacctgaaagccactgattctgatgtattcaatatagccgggcttcttctttgcttgctcaaggagcagcattttagattctccctttttgctatggtaggatgtacttcagaccagcgggtgctcaaggttgactacttgacccccagtactaactgctaacttctcagtgatactcagtaggtacaaaatatatgcaatgcagcttccccttaatttctgctgccattttctatgttctttagtctaagtttttcatgtcccatagtcacaatccagtaactcacacacaaatacgtacaatgaaatcctgattgtggaatatgtgccaaacatcattcaactaattctgattcatcagaatggaagattggcaggacataccgaggaaagcgaatacttgtatggataaactaaaggtgcaaaacgtcatgatcagaaccagaggccccattggcatttatcaatcaccatattatagtccagcaccaaaaggtcacctgggggatcaggcatttggatatgcaagatgccaaatcccttatcttattcttctcttacaacagccaaattcagagatcacataaattttaatatccacttgagcggtcagcacacaaagacattgaacttggctgtaactggatcctctacatgatttttaatataaacaggggcatctttttaatccaaagaaaaaggcagagagacatggtatgaatgattatgaaattgcccacgttttggtctgattctgaatttcctgataggattgcgacaagttcagaattccggaggaaagtcgcctccttcgtgtcccactttgtccatgtatatcactgttccccgtgttgctgctgctgcctggggcttcaattcctctctctctctccctcccatggcgtcactgtcgccttctcctacgcgaattgaaaggacagcttacctcgatggatcc

SEQ ID NO: 17548 - DNA, 11611 bp, Oryza sativa
  unsure (1)..(11611): unsure at all n locations
aaatattaactaagattatcttcttcttttaatctcagtgggagttcagtttcatgttagtaacgtgagtccggagcaagtaagcttgttcagaagaactgagcgtgaaagggtgaataagcttttagacgaatacgtccatcaatgctggaaaatgaaggtgctatccattttccccatcttcctccatttctcctgcagtttcatgcacctggcatcagatttttgtgcagtagttatcattaagatgaccttttggttggttgctgccacattagtagtagtacttttttttttcgcgaacacgcaaaggattgcacgtcaatatattaaaagaatagagtttttgttacacgacgcactcagccagaccggcctatgccaaggaaggaagaaaacaaagataaaaaacaaggaggaaaaggaaaaaaaactcgatacgacggtaactctactccaaacagcgggagggagcagaagtagtagtactaattacattaaccgttgaaactttgcacagaatcaaaatgttttcgaaggtgaagattcatgcttaaccttgatttacaatggttcgtatatttcaggtcaaatgtgagaaactagtcattgagaaagaagatgttgtagctggtcttcttgaacttattgcctctcatggcatcaccaagttagtaattgcagctgctgcagacaagcactactcaaggtacatctagcattacaaaattgtttcggtgtaaagattcaattgtgctatgtatttggtagaattaggaagttcagattatatttatccttctcggtttcagaaagatggacaaaccaaagtccaagatagcaacagaaatcatgcagagagctgacgcatcatgccagatttggtttgtgtgtaaggaacagctaatctgtaccaggtataatctgatgtgttgcacacttttcgatttctgatgactattgaacatcgaaccctcagaatctctgattcagttctccatgacagggacaagaaagtagaaaccacacaatcagttacacctctcagccaacttttcaagattgatactcctcccagccctgatattggtcagaccattctgcaaccgtcagctgaacaggaacaggtttcatcagattatgcagtagatattctgatttttaaaattgtatcttcaaagcatgagtataacatgatagcggtgcttttgttttcagaatgacaatgagatggaattggggttttctgatgagctcaatgatgcacgcgtagcagctgagaacttgatggagagagctttaagcgaatctttgaggcgccagagagcagatgaacaagtggtttcatctcttcagaaagtaattatgctacccatttgactgatttcttcataaatgctaaactaaaagttggcaatactatttattttaaaagattttgataataactctgaacctcccaggtcaaacaattcgaggagttgtacttggaggaggtgaaaaggaggaaagaattggaaggagctcttgtcaaagcaaacttagaacttacacggttaaaacaagaaatggacatacctaggaatcaccagagcacaatcttgggggatcgacaagaagtgattaccgataaatttatcttgagacaacaaactgtcgacatgaagagtgatttcggagccacaggacaactaatcaagccacagcaggagtatcttcagttacatcctgaccatgacaatggtgtcagacaaccggaaacgttgctacaccgaaggagcctgactgcattttctccagcatcaactgtaccatcacagtttgataaagactccattccttcccacttcatctgcccgatttctcaggttttcatatcctcagacaaacaaaatctcaaaattctgtacttttctttacagtaatataaatacttttgacaaattatgttgcttcagaagagacgtttgagttgaccatgttttgatttgcatgtaattgcaggagatcatgagggaaccctgcattgcagcagacgggttcacctatgaagctgaagcgatcatcaattggtttgatgaagggcacgaagtgtctcccatgaccaagcagcctcttgtgcaccgcgacctgatcccaaactttgctcttcgttctgtaatccaagattatacaaggagaaaacagtattcattttcctgatgctatttgctccttttccccttctctgactcactcaattttttttgtgaatattgttgtgggtgacatcgcactgacaaatggattcagctgaaagcaacagcatttttaaacagttgtcatgtgttgtttgttttgagctgtcagctagtgcagcaacagagatgctgtgttgatgacctttttttgcctctttgatttataaccaatcaggtcagacaagattatgtgctggcataaatcataatatccctgaatgtcacattttgcacgatgaagcctaaacaatcacatgaaaacatgatggaaatgcagcccatcgttgatggcaaatatagtggaaagctgatactttctctccatcgttgccagagcacaggaagatatttgaaataataataataataataataataattaaaaatcagattgagaattgtagaatcagttgatggttcagaaaggaacacaacaatttcaaggcagcgaaacaactctgttagcatacgtggcacctcattagccaagaaatacagctcttaatgctgaacctagaaggtcaatttccatgtttgttgacaaacttaatacccaaattgttgtatctgagacgctaatttatatcagaattattcaaccaaatcagagtactctcacaagcatttcagcgcactaaattaagggcctgtttgattcagcttaagattattataatctggattattatgagcaagctgaaacaaacaaataacttattataatagattattataatctataagccagattactataatctggtaatccactctaaagatgttttttttaattattgggtggctaacaactaataatccagagaatcaaacaggtaacagcttattttttattggcttattataattcagtttatagtaatctaatttaataatttatattatataattatcttaagctgaaacaaatagatcgtaaggtctctacgggaagaaatggaggaaacgaatttttgggaagaccaaacatgtgttcctccctacatggccatgatcatgagactccaatacaagttctcttcctcttcgttgctccctcttttctgcttacacgtaggccgtgtcattgagttatgtgcttgcgatcacctcgattgaaggagaggaatggatgggtgctttgttctgtactccatgcctcagcctcttcttttcctccttgttgttttctccttttgctttggttcttcttttgttcctttctctttttctctcatgtaaatcttgatgacaggtatcagaggatgcctttgtgtcgtttctcttaatttatttcgtgtaaaccttctgctggtttaccttctgattttctgaatgagaaaatacacccactgaaatagtgagtgatttcatgcactgaataagcttatcacttaaaagaaaactttaattttggaacctaactgtggagtttctttttgtcatactctgtttttcagctttagcttttaaaccgtaaataatatagatataaaagatttacttataagctatttttattatttcatttatgttttcatgacttatcaactaaagctcaaacgatcaaagcctaaaggcacaacaaatcacttcagcttggccgcgttcttttcagtggttgggtttggacgattagccaaatgtaaaacgagaaacacgaataacatataattagttaagtattaattattaaaaaaattaaaaaataagtttatttgttctttaaaacatcttttataaaaaaagtttcgcacaaaatacaccgtttagtaatttgaaaaacgtgctaacgaaaaacgagaaatatctaagcggaactagctgtttagaatgtggaccctttttatatcacgtgtcgtttgtcaatggcacgtatttctcatgtgattacacagctccaacctttcacagcgatgatataaaactttcactcactgacagcatatatatttgtagtcattgtttttttgagcggtatatttttagtcattagccaataagaaaaacaacttttatcctggagtaaatagtaattagctggtaatcacatgggcaaagttgtaaaattacctaacagcgggccccataggtcaggccccatcccatcaggggtttaatccagccgaaacggcgagtagttctcgttcccctgaggcctgatcaccaccctctctcctcccctttccctgaccccgcgaccgcgccgcgcgaggcgaactcgccactccgatctctctctccggcgacgccgccgccgccgcacaggttggtagtcaccggagccctcccttccgatcaacccttgcgcgcaatctacccatgcatgttcatggacatgacctgctgcgtttgtttttcactgttcattctgatgtctctctctttttttttaatttaattttatttatgttgtttgatccgtttttgtttgtgatggttggggagttagggttttgctctctctcgcgcggaatggaaagcggcggggtcgacggcgagaggcccctgctgcgcgaggcgggggatttgggtggcgaggacggcggcgcaggcggagtccccgaggagggggatgcgaagggcgatgtgatggcggcggcggcggcgcaggggggcgatggcgatgagggtgtggaggcggtagatggggacgggagtaacgaggaggaggaggttgtgcagacgcccgatgtgaagcagacgcccggcgccgcggccgcggcggcctggcgggaggcggcgtgggaggaggctgacggcgaggagttcgtggatgtcttggaaggggacgtggatgagaagcgtgaggatggatcggccttggagaatggggaggatttgttggcctcccgttctctcgctgtcgagggtgacgaagaagggtatggttcttgtgctgatattggtatagaagaagacgctgagggtgatgcgagtcgggagcgcttggaggaggaagccatgacggaatcaatcagggagtatgtgacagaagctgttttggctgaccatatccaggagcaaccggacaaatcgaagagtgaatctgaacatgtgaaggttgctcagcacaagtcgcagattgcgaagagcagggaagagggacccaaacaatctggaggcgaaccgtccgttgttgtcgaggaattgaatggatcaagctcgtctgatgatgagagtaaagctacctccgctcctcctgcacgatccattagtggtgctgcaggtcgttctaatggcccctctttgccatctcgtcctgctgggcttggagcatcgacttccttgtcgcagccctcagctcgacctgttcagcagacccgcgctaatggtccagtcgctgtggacagagaaactcggcaggatgttgaatctcctgaggatggagacgaaaatgatgaaatccgtgagaaactccagatgatccgggttaagtttctgcgtcttgctaacaggtttgggcaaacacctaataatatggtggtttctcaggttctttaccgacttgggctggcagaacagcttagaagaaatacaggccagggtgtttttagttttgaccgggcacaagatatggcagaacgtcttgaagctgctggaaacgagccccttgatttttcttgcaccatcttggttcttggtaaaactggggttggcaagagtgctaccatcaattctatttttgatgatgtccggttggaaacaaatgcttttgataccagcactagaaaggttcaagaagtagttggtgcagttgagggaatcaaagtaaaagttatcgatactcctggcctgtcatgctcatcttcagaccagcaccacaaccagaagattctcaattctgtcaagcgacttatcagcagaaaccctcctgatattgttctttattttgatagactggatatgcagaccagggactatggtgatgtgcctcttctgcaaaccattacaagagtctttggagcatcaatctggttcaatgccatagttgtgctaactcatgctgcatctgcaccacctgatggtctgaatggaattcccctgagctatgagatgtttgtaacccaaaggtctcatgtagtccagcaagctataaggcaagccgctggtgatgtccgtcttatgaatccagtgtccctggttgaaaaccactcagcgtgcaggaccaatagggcaggccagagggtgttgccaaatgggcatgtctggaaaccacagttgctattgctttgttttgcctcaaaggttttagcagaggccaacgcgcttctcaagctgcaggacaatcctgctggtaaacctcgtatgaggattcctccacttcctttcctattgtcttcgcttcttcagtctcgagccccactgaagttaccagaggagcagtttggtgatgatgatgatattgaagacgatttggctgatgattcggattcagatgatggttcagactatgatgacttgcctccttttaaacgcctcacaaaagctcagcttgcaaagctaaaccatgctcagaggaaggcatatcttgaggagctggattacagagagaagttattctacaaaaaacagctaaaggaggaaaggatgcgccgtaaaataatgaagaaaatggcagcagaggccagtgcaagaacagatgacttcagtaacagcaatcttgaagatgatggcagtgctccaacaaatgttgcagtgcctatgcccgacatggtattgccctcatcgtttgattctgaccatcctagccatcgctatcgtttcctggacacaccaagtgaatggcttgtcaggccagtgctggagacccagggatgggatcatgatgttggttatgaaggtctaaatgttgaaaggttgtttgctgtgaaaggtaaagttcctttatcagtgtctggtcaactttcaaaagacaagaaggattgctccctccaaatggaggtcgcaagttcacttaagcacggtgaggggaaaaccacttcactggggcttgatttgcagtctgttggcaaggacatggcatacactcttcgtggcgagtcgaggtttaaaaacttcaggcgcaataacacggctgctgggatatccgccacactccttggagattctgtatccgctggtgtgaaggttgaagacaagcttgttgtgaacaagcagctcagggttctggttagtggaggcgctatgagcgggaggggagatgtggcttacggagggcggcttgaagcaacattgaaagacaaagattacccaattggccgcatgctttctaccatagcgctctctgttgttgattggcatggggatcttgctgttggctgcaacatccagtctcagattcctgctggaagagctagcaatttgattggtcatgcgaatctaagcaacaagggaactggtcaagttggcattcgcctcaacagctcggagcatcttgagatcgcccttattgccctcgtgccaatataccaaaacatcaagaagttattgcagagttaatccgtatcaaccagtatttatgtaagcgagaaaaggcagcaagataaatccattagagttaatgcaagcataaattagaactagagttaatgcaagcataaattagaactatctatttattttcttcttcccttacctacacgtaatagtgttttcttccaagtttttttttttttgatgaagttggatttgcagaacacatccttttcaggatttttgttgttatccttgtactctcaatagctgataagaaaaaaaaatgcactgctgttttgaaggctgcaacgccgagtatcagatcgttttgctatatttgttaagatcgttttgctatatttgttactcatattaaattgtataaccatatattcttgtcccaatcgacttggaaaatactaatactccacattctattgtgtatagatattgtttggtcttatgattcttgtgttgtcattattgcctctagtggaatggttttcaagagtgatgtgataagttacaagaataatttgtcttcagtcagcttgactgcttcaagtgtgaaagcaatgaattagccccatcatttagcagtttggttgtttgaaggcaaaggcaaaacaacatatttacaataaaaaataatttataaataaaacttttatatacgtgttctcgacgatctagaaataaagattaaaaaacaaacaacaatgaaaaaaactctaaaattaactctaaattaatattaaaaatttaaattttagctgataaatataaacgaaaagagatggtgccaaatatgtatattttcacaagtcttcccatacaaaaccaattaacgtctcaattgggtcccactgccttaggcagttgactacttgactttgattcccgccaagtcttcgagggccccacctgtcagccgtggacccgcgcttctcccccgaacaaaatgaaaacgactaatctttataacgagcagagtagcatcatatctccagtttgttagacaagttaggatccttaaataacgtcctaaactaacccaatctgcgacataatctcgtttagttcgtggacttaatccgcgtctccgttggttaatatagttacagctctagctctggatcatcgcgagggagttagtttagttagttaatcagttgggaacacacacgtcggccgtctcgtctcgcgccattttttttgatgggctcgaggggcggcgacgccgacgcgtgggagacggcgagcgcgcggagcggcgtctcctcctcctcctccggccgcgcgacggccgcggcggcggcgccggcgccggagaacaaggtgttcgtggctctcccggcgcagcacaagagcggcaggtccacgctcgcgtgggcgctccggcacgtcgccgaactggctccggcggcgatcggcggcggcggcgaggtggtggtggtggcggcgcacgtccactcgccggcgcagatgattccgatgagcagtacgtgtgtcctcccgcttcttcgccttctctcgtcgtcgctctgcaaacccccacgccacaagctgcagggcttatatcagccgttcgattagctatgtacggtcaggattcagacggccctgattggctgatgcattttttgtgaggaagcccctgtagtttttacgtattccattctgatgcatttttgtgaggaagcccctgtatttttttcgtattctattttgaactcctttttagttcactactgagtcccagtcctgaatcccccaatgcggcgccccctgcctcgccggggacggcggcgaggggtgtcgcgacgggagctcactccggcgacggcgagcatcttcgcgcgcacaattatcccgaggatgtggctgggctaggatcgtgcagagattcccgcttccttttggtccaaatgcgactgggttttagccttttagggcaaaggggaagtattatttcctactgagttgttcatcgattcgcttgtctgaattgccaaaattgtttagtgtctaggtgattgtattcggttttttttttcaaactcttaatgcgaactgataatttctagtattggtgcccatggatgcacgctgagtcagttcagaatagaactgaagtagtggtcagtctcagtccacagttcacagtaaatattcattttagaagaacaaatcgcgtgaaggttgattagatgttgacctcatgtgttaaatttcagctaaatctgctattgcaacttcaaatgacatactttgttcgcgtggtgtactaattactaaacaactcatctaattacatggtagtgggaggcaagttccatgcaagtaaattgagaccggaacaggtcagtacttacagaaaatatgaaagggagcaggtggagaagaatttggatgaatacctcgagcaatgcacaaaaatgaaggttcaggcaatcttctcattcattcttagtaatgaagtctgaattgctatggggaacaagttaagtgtattatatttttcaggtcaaatgtgagaaaattgttattgagaatgaagacattgctaatgggattacagagcttattttgctgcatggggtaagtaaactcgtcatgggagcagctgctgacaagcaatactccaggtgtgtcttcatttctgctaccgatttgtacttttgttgcatcatatatctagctaagtgatgcctcaaaactctaatttcaggaaaatgaaattgcccaagtccaaaacagcactctcagtcacggttaaagcaaatccttcatgcaagatttggtttgtttgcaaggagcatctgatatacactaggtattaagaatatgatcatgagcagtatgcatgccatacctctggaccgaccagtcatctgtatattcatttataccgacttcatatattgtttcctagatactagccattctgttagtgttctcccttttccaaaatcattttgagtaattctctctttaaactgtgttcagagattttgttgctcctatttctccaaattcacaatcacctgacactatcagaggctcaatatccaatctagctgcacggggaggaactacaaaccaatatgcaaacaatgcagttaacggttacgtacagaggtccatgtctgaaatggttgtccctgcatctagcagggtatcattgcaactgcattctcgatcatcgtacaggagtcccttagcaggctaaacatggagggcacctctgttgattcctgggatagcttccgcagaggaagctttccaagttcataccgagcttcttctactgtgactgaagaagtgttgagcgattctagttcatctggaatacctagagatggcatctcaacacttgcaggttgtgactttccaaactcagcactgcaccatgaacaggtaagctctaataccaaatttaagctttggatgattagctaggaatcttattccattacatggtgctgtatccagggtgacgcaggttcaaatgctaacctatttgataaacttgaagaagccttcgcagaggctgagaagtataggaagcaagcatatgatgagtcactgagaagacaaaagacagaagaagaattgatttcatatcaccaaaaggtaaacccttcactaagttagcataaaaaattgcaggtttttttacacaaagatctaatggacctggttacaggccaggaaatctgaggatttgttcttaaatgaggccaagcaaaggaaagaggttgaggaaaccctagcaaaggcaaatgtggagatacaattattgaaggaagaaatggatgcactgaaacacaaccgagatgacctcagcagtnnnnnnnnnnnnnnnnnnnnnnnnnnnnnnnnnnnnnnnnnnn

SEQ ID NO: 17549 - DNA, 1072 bp, Oryza sativa
ctgatacttcagagtgtgcacatcagccttcttgttcgcaaagaaatatgtcaccacaggaacatcttgccctccctgtgcagcaaagaatggagcacttggatcatcaatgttcaccaccttacgatggcgctcagggtcaaccatctagaaaacagagaggccatgctgttcatgtactcctcgtaggtcatgccagcctcatcgccggcatgcctaacattagtcagcacagcaatgtcataatctatctcgctgtccacaccagatgacggcataccatcggtggttgcctccaacaaagccgcctcagcgccattgtacaacatcgtcgccatcagcctctgcacggcaatggggtcaccagaggcatcaggttgtgcgtccagtttgttgttgccaaacgcataggccccgagaacgcctaccatgccagtcctcacacccatggcttcatacattgccctgacgaggtgcgccgtggtggtgaccccatccgtgccagcgacaccgatcaccgccatgtctttcgaaggccgcctgtagaggcaggcggggagcatgcggagagctgccgtgatgtcatcgacgatgaccagcgcgcggcaagcaagggtgccctcgatgtcgacggtctggtcggcgacgacggcgaccgccccgcgcttgtcagcttcggtgagcccagcaagcccttcctccccaacgcacacgtagaggtcccccgccgcgacgaggctggcgtcacgctgcaccccggcgagcgcgacatcctggtcgccggtcaccgccacgggcacaagcttgctctcgtccaggagctcggccagcgtcatgcggaaggccgggtaccgaaccctcgccccctcaaggccgacctcatcggccacatcaaacacctcgccgtcgtcgtcaaggggcaccccgtcgtcgccgtaatccaccccgccaccgccgccgttcgcctcctcgtcctcctcgtcggccagggacacaacactgattccttgcagcctccgaatctcgtcaaggtcgatgacctcttcgggggaaagctcgtcggcaaggccgt

SEQ ID NO: 17550 - DNA, 10944 bp, Oryza sativa
ttttattattattggtggtgctaatatgtcatttggcgcattggtaatatttggctaaattaataatttggcaatcaaatttttatatatttattcttaactatttaagtgccattggtgaaaaattaacttcggattaaaactttcaaatcaactttaaataagttttaaaactcaaatcttggcaacggctgattatgtacagaagaaactataggagcattacagatttataaccctcatccttgggttccaagagatcttttttttgacgtggcaatgatcgccggtccgtgctaacgatggtggcccaggcagccctcttaccactcttctagagaatattttttcatgagaggaccagtttatcatatcgaacacgtacaaacctatcctagtttatcgaatcgaacatatagggacatgaggagagctcatgaagttgtccttcactgagcatgaccttaatatccaatcggtgaatgcatacagcttctccctgatatatgtttatgtcaaactaaattgtacaaaaagattacataagaagggaaaatcaatttttttaataaaaaaagaaagggggagttgggttgatgaaacattgtgacccttttctgatgtgacgcatattaactacaatgcaaagaacaaaagaataattgagactaaagtagaattttccatatatttttcctccccagagcagctgactcgattattaacctagctatgattgtttgatcgataatggccacattgttgggcattaagctgaacatgtatcacttggttgtgaaattggcattttattaagcagcagcctgtgggcgagggaagatgaggctcatcaagagcccaatcaggacacctatgagcccagcaaaagcagcaaacgttaaggagaaacccgcatcgcttttgcggcttctacgcctcctgatcacatcctgaaaaaaatatatataatgcaaataataaatagaaaatacaatataagggagaaagggggtacacaaacgattcatcttgaattctttactgctaacaaggatattttacatccatgaaatgcttggagcaatgggatttttttcacatctgcattcctacaattattcagtttcaactgtaaaatagtaggaaacgtttattgatttgcttttgtttcccttgacacatttgtttcagcgacccattaaagaaataaatgttgagcaaactaaagttgcattatgaatgaaaagttgatcgatcacaattgtagaaatataaaaattgttatccaccaaggaccaataatttcttttgcatttttctcaaagtcagacatatatatttaatcaaaaccaattgttttttctccatgctaaacatttttcatcgcgaattcaaatgataacaaatgagcaagagcagtataaggttcacagttcaggtgtcaatattgagaaacataaaagctacaatgaaataaagtgatgatcacaaaacaaaatgaagtgcaaaaaagaaaaaaaaaaggctgaccaattcacgttgcatttgctgattttgctgcagggtggtgtctcgttcgtcttttaggcgttgtattgtctgtatctggatagaagaaaacaaggaactaagtaagaaacaaaaaggataacagaacatatcacaaaagatgtttctttgctcagacaagcttggttaaaattgtagagaattgccataagacaaggcacatttaataaggcaaactctttatccagatttaggaaacaaaaaatttatccaaattgcttatttggaatatgtcagtcaagataaaggaaactactttatgatcatttcaaccatctatatcgttgcttcattatcttcctaattctcagacatgaactttctaatcaatgccagcatctcaatatcacttcacaagcgtgtcttgcatttgaactcttatggagaaatttcagatgatcattacttttctcactagaaaagcattatacacatgtagaggcagcagagtatccatgcataagatgatattaggaagccatgaatcatgataatttcttgtcagaattcattagagagatatttactgccatattatttgggggtagtttcccaataaaatggtactgcctttaggatcaattgcattaccttttcaatgcttgcattcttcagcatctgcatatagttgcagtgcaaaacatgagtccccttgcacagaagtttgatcagcgtgacacaagttttcagcatagtattctcaccgtgagatcgtcagaccccaatttgaagctcctgctgcctaaagatgtaataccagagtcgtcagaacttccactgggaactgtataaacaaccttaagcttcatttcctcaatcaccttatcgacttccttgttgaactgaaccacaaaaatgcatggaatatagttggtgcatcagtagtcaatgtcattgtaacaataatacattactaataaagcttgcaaatcatctatatttgcattgtatgctcaccgtgttaggggggatctcgtccatgtcagtactggcagctaccttggtgctctggatcaagaatttatccttgcattgcatatctggtgggtactctttctgcgcctggagcgtaactacatcaccgaacaacaatgcagatatatatatccaaacatcaagaccaaataatgagcctaaagagagccatggcttggcacgccataaaatagccaaactggaaacatgtatttacttgttattgtgcaagaatcccatggctggatgatgctcgcgttcggccggacaaaatacttcctcggtgatgtcgtcttgacctgaaaaaaaaatttcatcaaaccttcttgccaagtttcagaaaatattggtcatgaaatggaaggccatggaccttaaatgcaacatgatgctcgctgttgttcaccaccttgagattgcaatagcatggcttatctagctcaactacacaggaaaatttaacggagttaaggctaaccatttgtaaatgttaataactttagatatttttaaaaagtcctatgaacttacataggaaagtgagatcctctgggtaaatggagatcagccttccgctggcacccattgccacacctaatcaaacaaattaactgaaaggatgccaaaatatacataaattgctgcattacaaaagagatggttttacctttcgctttgttcagagtaaaaatccaaccttttatttccaagaactgaattgcacgtaaacaaattgaagaaaaaagaggaatcaacgatttctttcgaggataaattggtaggacaggaggagcgagtagcagggaagagaaagagagaaacgaatgtgtttgctttgctatttttggagtgaagagaaagagagagaaacaaatgtgtttgcttttcttttcttggctttctggcgacaatgacggggcaacactcacttcttgggcacgtggcagtttcctttcccctatattttttcgagtgaacaacaaagctgtttttaattaattggtggctgatgatctatgttactgtttattgtttagggcatgactaataaaccaagaaaaaggttgagaccacctgaacaacgtcgagacaactaaatcaagccagcaatatgcactagagaacgatgcttcttcttggtaaaactgagtttaactagtgatatgcaatgcatagaacaagatatctcaagttctacacattataaaaactagcatatttagcagaagttgtgcaatgacagattgacaatgacacctagtagacactaatcccttattctttctataaagctaatacccattaaatacctaaagctcaacatacaagcatagtatttattagcactcctaaaatctaacatgcaagcatatcacatcaacacactaaacacacaaggctcaacatgtaagcatatactaattatatctacaatttatttcattctaaaactaaacatacacatactaaatcatcattctcaaatcattttcataatatttcaacccaaatcatttaccatttcacaatatctaacatcatctagttaactttagtactcaaagccacttgtccttagtggcaaaacactgcccagtctaaaacaaaggacatgtcaacaatccttggtcgtttcaagcacattgaaaagaaaatatcctcgtttatcatgtgtacgctttccaaactgctaaacggtgtgttttttaagaaaaaatctataggaaagttgttttaaaaatcatattaatccatttttcaggtttaaaatgattaatactcaatttatcatacgctaatggtacacctcattttgcatatctttttaatcttctctattctccttctctagtgacaggttgatattcttgcagtcacgagaaacacaagatgcatgtcaaaatctagtatttcattaggttgcactttcaaaaaaaaaaaacttttatcacttttagagaattaaccaagaaacaatgcgattgacacaaacaaaaaaaacatttttatcacttaagtttcatatatttgacaatgaaaataaacaattgcacggacaatctggcaatgaatggatgagagcacatcactcgatcggttggaaccaatactagggactgatataggtctgtgcgtgctgattaagtagttgaaattttaatggacaacacttggctagcactagagaaagacctctattggatagcagtggagacacgagtttgagtttggaaaaaaaatttgaaaagaaaacaagaagattgccttatatattgatagaacatgagagcatcaaatttattcttttgcgcaatgtccctggagaaaagccttttttttctcccgttcctcttgacaatggcatccagttgttgcgtcatgcatatttttgaaaaactctgcttctaatatattgacgtacaatccttttgtacgttcgtgaaaagaagagcatcaaatagctgaaaacaattcaaaccaatacctaaaagcattcaatccaaacgttgtcgtggaaaagaacatatgttgcaagtatattgatagagcataatgcaagaagagccaagaaaagccttttttttccttttgttccttgacaatggccttcagccattgtgacgtgtattttctttttttttaaaaaaatatgcttcttctaatgtattgacgtgtaatccttttgcacgttcatgaaaaggagatcatcaaatagctgaaaacataatgggcaccctagctgaaaacaattcaatcctatagctaaaaacaattcaatccaaacgccgttgtgggaaaatccatatgttgcaagctagcacctgtggttgttgaaaatattgttttagaaatcaagcaatcgtgctccaggatacttcaacttatgtctatagacacatcaagcattcttcccataattagcatacgcttctcttatacctatttgactatttgtgtctactgatagagcattgcaaacgttgtgatgtttgtgtcaagagcattacacatagactgatatcacacgttagacaaatgaggacagacaatcagccacaacgttagtcaatgggggtattcgctagtagttcacggtggcaattgcagcttgcaggaaagactgaacacccccaatgcattatgttttaatatcaatttataatatttgtttgattgtcctatgtatcacatcatcttcttatatacctcaccgtcctaaaatataatcccttcgtcccaaaatataacaacttttagccctcgggatttgtcccaaaatataacaacttctccaccaacattctcttcccaactaatcacaacccttaaccattcacttttcacacctacctccactactcatccaatcacaaccctctaccactcacttctacctacttttttaataatcgtgtccaacactaaaagttcttatattccttcttgaccagattcatagtactaaaatgcatcacatctatccaaaatcctttatattttggaatagagggagtatatatttttgtgacttcaacagatatgtcgctgaaattgaccatatgacaacgccaagagtgaggtgacgtgtcaataacaaaagaaccactagcacatctctatcctaaattgtaggcatttttaagatgggcatgtgtatcaagaaagttgatagaaatgattaaaggaaggttgtgattggttaagaatagaaagttgatgaaataaataaatgaaaaatggttgtgattggttgaaggaggtagatgaaaaaaaatagtttcattttagggacaagctactgtggctataaatagctacattttggaatagaggaagcagtacttagaaatcctaaaacaaaaaaaaaacagagagagaaataaatcatatccaagaaaaaaacaaaaaagaattgccatccgacgtggcgaaagcgagctagccaaagccaaagctaagttagcctattcttcaagccaccacttcttttttcccctttcgataccagcggcacggcggcaaccacgaacaacagagagtgcgaaggtgcgcgggccccacctgccagaaaacggtgtgaataaaataaaagaactcttatggagtaattttagatgaatcattactcctctcactagaaaagcattatcatggtaatgcccgaaatggcatgataatttcttgtcagaattcatgagagatttattgtcatactattatctaggtgtagtttcccaataaaatgataaatgcctttaggatcaatcgcattacctcttcaatgcttgcattcctcaacatctgcatatagttgtagtgcaaaacgtgagtccccttgcacagaagtttgctcaacattacacaagattccagcatagtattctcaccgtgagatcgtcagaccccaatttgaagctcatgcttcctaaagatgtgtggagattatggatatcccatatctacacggcgatggtatttggactgaatacaggataccaaatatagatagaatatcttatttgtgtctcgggtttgtttctcaacttgtacatcaaggaaataccttgagacttagtcggctacgactgtattttatctgtatctgcatattctgttagggatatagattatcttttgtaacacggacttcttcccatatataaggggggtccgggtgcctctagcggcagatgttgattttctccaaatcatataatcaataagacattcggcggattcatccccggacaggagtagggtattacttcttcaataagaaggcctgaacctgtataaatcctttgtctccaaacccatacacttttccagcttgatagccacccccttttattattgccgaaatctagtttcgacagttggcacgccaggtaggggctgcgtcaagcttttcgccgatcagtgcaatgggttccgtcttcggcatcgacgacctcgtcttcccacccgggcagacgtttcggttcggcagcctcgacttcgtcaccaacaacaacggcaagatctctctccttgactcggtgtcagaccagtcgggagagaaccggatttcagccccgtttggactcccaaacgcggctgaaagttacttcaagaccatctcaatcgagttggcttcaaaccactcgggtgagatcgcaccttctccaacgtcaccagatcaagatgatggggcttacccaccgatcctgatgaagctccccgacgatttggcggccgtctccatcacgacagcgtctccatcccgtaggcctaggcggaagtcggcttcaacaccgacttcgcctagcttcagggaagtcggcgtcatcctcttaccactcggcacggtttcgacggatcagctggatggctactacagttctcccaccgtcgactcgcgccccaccgacatcgtggagtacgacgagtttagctctcgctacaacgacccggatctcgacgacttcgacggaagcctagatgacaactacacccctctctacttcggcgtcttcatggctgataacgagacggaggagcaacggcaagcccgggagaccgaagcacgtcgcgagactgaacgtcgccgactggaggaggagcatcaagcacaagaacaagaacggctacggcgtgagcagcaggagtgtgagcggaccgcgaaggaggctgaggatcgacggcagcgagctttggaagtagggcgccgagcgcgtgatctcatcggccaacaagatgttgaagggacaccggttttccgcacccctcacaagaatgcggttgccgcgatcaccctcctcgacaccctcctcaaggaaaacgagctcaatcaatctgatcacgtcgtcaacatcttgaaccagacgaagaccatgattgcggtttcggtcccagttaactccgaaagcgtccacacgccgactggcagccgagtcccccacttccgatctcatgactaccgtcatccaagcctcagcatcaccggcgcaggatccaatcgcaaggagcaggggtcacgacaagcggtccgttcactcacctcccgaccatcatagggagcgccgagtggaacggcctcgctcaccacctcgtcgccgccccgtcgatcttcgcgacacaatcatacagcgccgagcagctcgaggccatcatcattcgccggaccgccacgacgacgaccttgacggagtagcagccttcaccgacgacctgcgtcgagtggattggccagccggcttcaagccgactggaatagagaagtatgacggtaccactaacccagaatcgtggcttaccatctacggtctcgcaatccgcgcagcaggaggagacagcaaggccatggcgaactatttaccagtggctttagcggattccgcccgatcttggctccatggattgccccgtggtacaattggatcttgggctgaattacgcgaccacttcatcgccaactttcaaggcaccttcgagcatcccggcacacaatacgacctctacaacgttattcagaaatctggagaatcccttcgagattacatccgacgattttccgaacaacgtaacaagatctccgacatcaccgacgacgttatcatcgccgcattcaccaaagggattcgccacgaagaattggtcggcaagttcgggcgtaagcctcccaagacagtcaagcttatgttcgaaaaagccaacgagtacgccaaggccgaagacgccgtcaccgcatcaaagcagtcaggtcccagttggaagccaaacaagggtacgccggctaagggaggaggtggaagtaacaatcataaggaccgcaagcgtaagcctgaggaacttgttgcaaccgccactcactcttctcgacagcattcgcgcgtcaacacgttcgacaagatcatgaactcccaatgcccgcaccatcctaactccaaccacgtggccaaagattgtttcgtctacaggcagtttgcggagcaatacaccaagactacacggaagaactccgacgaagaacaaagtacgtcgaggaagaaggacgacggcgacaccccggcaggatttcaagaccaccgcaaggagctcaaccatatcttcggcggccccctggcttatgagtctaaaaggaagcaaaagttgactgaacgggagatcaatgctgttcagcccgacacgccccagtatcttcgatggtcagaaattgcaatcaagtttgaccgctcggatcatcctgaccgagtggtccacccggggcggtaccccctggtactagacccagtggtccgtaatgtcaagcttcgcagaaccctcatcgacggcggcagtgcactcaatatcctcttcgccaagaccttggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgacgatttcgagacagcataccatgccatactcggacgcccggcgttagccaagtttatggccgtcccgcactacacttacatgatgatgaagatgcctggtccccgaggagtcctatccctacggagcgacatcaagcaagccgtcacatgcgacaaggagagttgcgacatggcccaaacccgcgagatggcgtcagcccgagaggatatccgactggctgcagccacggcgagcgaaggagaagtgcccgctaccaagatttcaaaaagtggagaaagcgaagccaagactaaaaagattcccttagatccttctgattctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttatatgtcaaagaagatgccaagcctatcaaacaacgactccgccgattcgcacaagacagaaaagacgcgatcaaggaggaattaaccaagctgttagcagcaggcttcattaaagaagtccttcatcccgactggctggcaaacccggttctagttcggaagaaaacggggcaatggcgcatgtgtgttgattatactgacctcaacatatcttgccctaaagatccttttgggttgcctcgcattgaccaggtagtcgactcgaccgccggctgtgagcttctcagttttttggactgctacttggggtatcatcagatccgactgaagaatccgactgcttgaagacttcattcatcacgccctttggagcatactgctatgtcaccatgccgtttggactaaaaaacgcaggagcaactt

SEQ ID NO: 17551 - DNA, 19252 bp, Oryza sativa
caacgtatgatccagagatgcttttcaccgcagatcggccgaaacgttgaagcctatgtggatgatgtagttgtcaagaccaagcaaaaggatgatttgatctcggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaaattactgctatcctcaacatgaaaccgccaagtacccagaaagatgttcagaagctgactggatgcatggcggcgctcagccgatttgtttcaagacttggcgagcgggggatgcccttctttaagctactaaagaaaacagacgacttccagtggggacccgatgcacagaaggccttcgaagatttcaagaaactcctcaccgagccaccggtcttagcctcaccacacccgcaggagccgttgttgttgtatatagcagccgcctcccaggttgtgagcacagtcttggtcgttgagcgcgaggaagaaggccatgtccagaaagtccaacgaccgatttactttgtcagcgaagtcctagccgactccaaaacgaggtaccctcaggttcagaagctgttatatggtattctaattactaccaggaagctatctcactactttcaaagtcactcggtaacggtggtcacatcattttcactcggtgatatactgcataaccgcgaagcaaacgggcggattgctaagtgggctttggagttgatgtctttggacatatcattcaagccccgaatttcaattaagtcccaagcgttagctgattttgtcgccgaatggaccgagtgccaggaggatacccccgcggagaagatggagcactggaccatgcattttgacggatcaaaacgactttcgggcactggagcaggagtggtcttgatttccccaactggagaaagattaagctatgtgctttggatacatttttcggcatcccacaacgtcgccgagtatgaggcgctccttcatggactgcggattgcaatttccctaggaataaagcgtctaatagttcgaggcgattcacagctggttgtcaaccaggttatgaaagagtggtcctgccttgacgacaatatgatggcatatcgacaagaggtacgcaaattggaagacaagttcgatggactcgagcttagtcacgttcttcgacacaacaatgaagccgccgacagacttgccaactttggatccaagcgcgaggtggcgccctctgatgttttcgtcgaacacctttatacgccgaccgtacctcacaaggatactactcaaattgcgggcactcatgacgtagctctggttgaagccgattggcgagagcccctcatacgatttttgacttctcaagaactcccacaagacaaagatgaagccgagcggatttcaaggcggagcaaactttacgttatgcatgaagctgagttgtacaagaaaagcccttcagggattctgcaacgctgcgtatctttagaggaagggaggcaattgctgaaagacatacattctgggatatgcggaaaccatgctgccgcacgcaccattgtcggcaaagcttaccggcagggttttttctggcccaccgcagtgtccgacgccgacaaaattgtgcgcacgtgcgaaggttgccaatttttcgccagacaaattcatctaccagctcaagagttgcagaccatcccactgtcttggccgtttgcggtttgggggctcgacatggttggcccgtttaaaaaggcagtcggcggttacacgcacctttttgtggccattgacaaattctccaagtggattgaagctaaaccggttgtcacaatcacagcagataacgctcgagacttcttcatcaacattgtgcatagatttggagtgcccaatcggatcatcactgacaatggcagacaattcaccggcggagtttttaaagacttttgtgaagactttggaatcaagatttgctatgcctcagtggcacatcccatgagcaatggacaggtggagcgagccaatggcatgatacttcaagggattaaagcgcgtgtttttgaccggctaaaaccctatgccggcaaatgggtgaaacagctgccatcagtactttggtctttgcgaactacacccagtcgggccacaggccagtcaccttttttccttgtctatggggcagaagcaatgttgccgagtgaagttgaattcgagtctttgcgctttcgaaattaccgtgaagaacgctacgaagaggaccgagtggatgacttgcaccgattagaagaagtccgcgaagcagctttgattcagtcggctcgatacttacaagggctgcgacgttatcataatcgcaatgttcgatcccgtgcctttctagtcggcgacctggttttgaggaaaattcaaactacacgagatcggcacaagttatctcctctatgggaagggccatttatcatctctgacgtcacccgaccaggttcctatcgactcaagcgcgaagacggtacactcgttgacaactcttggaacattgaacatcttcgtcgtttctacgcttaaacttatcattgtacttccctatcttgactgtcaacatcaagttttcttcttgacgttgtcagtcgggggctatcatcataataatggagtgtgattttttatcaatttaatttgcttacttggtctatcattgccttgtttggtttttctacttcgtctgcgaggactgaaagtttttaatagcttctttgggttctaggctcaacaaagcttgataaaagcttttaagaaatcaaagacttggctagaattatcaaacacagcataaatacaccagtattgtacaagttgaacctccatttgttacattcatactcagtcagaatcagttttttcatcatcagagttattactactcggctgaaggtcggtattgcggaattgctctacaacgtcacttgcaatcttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatctggagcaactctcagcttgtcgaagatttcggttgcgtcgagtgcactcggaccactgttattgaggaacatagcttggacaagtggtgtagcgacattagcgacttcatctcttgctccttcaagctttttgatcttaccaaccaggacgtcaaattgagcttgagatttgattttgcggtctacaaaacacgtttatgatcaaaatctactgccttaaaaagagagaagttcagattgtcagctggcggtaccttcaacctccttcaaggccgagtccctttgcgcagccaattctactttgtctcttttcaagacttcaatttgtttctccatctgagccatcctggtggcttgcgctgtttgaaatccaaatgtttgaggatacagttatgacaacataaattaatgggacagatctagaagattaccttttgatgaaccactcagctcgaagtttgaatcctggagctgggcaattcggtcccttaattccttctctgtctttttggcaagctccttggcctcgtgtagctggtccctgactgcttcaagagttcccaaatgaggaaccagcttttctaaagttgctgtcttggcctcattgcgaagatggattctctgcatgatggttcatggtttagttctgctaaagagaaaacaaagtcatcaaaggcagtcacccagaggatttacattcacaatgcgagtggcttctccaagtgccttcttcagctggcacacttcctcatcttctttttgacgatttatgacgatgccggcagcttgtgagttctcgtcccaccatttgagcaagataggaggacgagagtcgtcagccgcctttatgcgagggatttcttcttcgtcatcgcctggtggtcctgatgtatttccaagatattagacgaataagctggagttattcaaatcggcatcacttgagaagatgagttacccgaggatgttcctagctgagcgtgaggcgattcttgttctttatttgaagacccaatcatagcgtcgttaccagcctctggtccttgagaagtcgtcgtctgcgcttcaacttcgggaatttcttggtctggacctacgtccgactggtttccagtcgggggctcttgggttgttgtagtttcagttgctgccgactggtctccagtcggaggctggtcactcggatcggctgtatcacctgaagtatgagcgccagtcggctggttctcggcagtcggctcagaatccttggatgaacttggctctgtcacaaccggatcaggatcttttccagttggatctatgtcggatggtttcctgcaaagtgtcctttcaatattcagtattattttcatgagagaagcataccggagcgaaatggtaccaagaggtttatgcctggaagatgttctgatctttggcgttggacggccagccagttttttcctgggagtggtatgctttgggagtttattgggtaggcttttgttcccagatttgttgccgtcgtcgccttcgtcatcgttaagcatcagctttctcttgcgagaacctgtttgcccagtcggattggaggtttgaggttgcgagtccgatctgattgtcggccctccacctcccttaacggtgtgctggcgaggagaccggcgctgagtaattggggggtcagatttcatcaatacatattcctgaatgagatgcctccatggttagttaactcaacatgaagacaagattatgttttggtcatgggttgaaggtttcagatacatacctgcggaggcgaattgaatgcattatatggcacaactggcagctgatgtgagtagctgacgacaatagcatttgagaagattttatacattctctccttcatgattttaaaatccagagagtctggttcttcacgattaggatcatgcttgccgtcaaactcgaatgccgtacgggatctttctttaattggtgccaatcggcatttgatgaagtgccgagtaatctgctctccttgtaagccttgttctttgagttttagcatgcgatccatcaattccaaggcttgggctgcttcatccccaataggaagagagttccaggtatcttggtacaccggaggaagacaagagtactcaggaagagcgggctcaggattctgaatataaaaccagttcgcatgccaccctttgtttgaagtcttgatgggcattgagaagtacttctggctcagagttcctctcagctgaaatccggcccctccgactacacatggcttactcttgttcggttggggtttgagaaagaagattcggcgaaacagagcgaagtggggtttaattcccaagaaggcttcacaaacatggacgaaattggcgatgtggactatggaattcgggtttaggtgatgcaagctgattccatagaagcttaatatcccgcggaaaaatttcgaggtcggaagagcgaagccgccatagaagaaatgagagaagaccccaacctcgtgtgtatcgggggacggaaaagcctcaccgcacgctggccgccacccgatgatctccttggcaggaagaacgccgtgcgccaccatctccttcaggttctcctccgtcacgtcggatggcgcccattggccttcaaagctttctttctcttccgccatcgattttacccgaatgcgctgatttgattcgagggatggctagggagaggtgagggattgaggcggcggatcacgggaaggattttgatgaactttttgaaggtggattcgagtggaatggtgaaccctagtttgccggcgcagctctgtactgtagcagggagtggggaaaatggcgagagttccggcggggaagacgaagtgacgcttggatctcgggatttcttgttaagggtatcggaggtgcaaatgggcttaggcctgaacagtacctcagcccagtatttttgacagcgtggcccattgtgctccttagggacttaggcattttttgctttggcaatctatgcgcataatagtgttgcccaatgctgataaaatcctttttacgtggtcatataattctttggaattattgcaatgcaaattaaaaggtgcccgacagaaaggtgttatgctgtttttgtaagcttttttaggctacaaaagctgtctgggttaacttggaatgacttgttttttaccatagtcgtttctttggtatgttatatgcctgttctcattatggtaaatagtcatagcctaggctattagacttattcattaccataatttttataatttttggtgggtaatcttagaattttctattcggatgcccgtcaagtgtgttcattcgtgaaccttttagagtgttaaccactcggattctttttattatggctaaaaagcagtcggctagaatgcctctttgggcgtcgcgtatgcttttgtcatatgatgcatgattgtgctattattttgttctcaactatatgtttagtttgttaactaatcacatagttgggggctacacctaattaggtgcatctattcgatgcaccatattctttatcttttcgccctttacagtctttgtcttcgctactcggcagatcttggcatgaaatgtttgaagcactcggatcattatctttgagaaggctatgatggttgactgcaaaggtcgtgggggctactgtggagattatggatatcccatatctacacggcgatggtatttggactgaatacaggataccaaatatagatagaatatcttatttgtgtctcgggtttgtttctcaacttgtacatcaaggaaataccttgagacttagtcggctacgactgtattttatctgtatctgcatattccgttagggatatagattatcttttgtaacacggacttcttcccatatataaggggggtccgggtgcctctagcggcagatgttgattttctccaaatcatataatcaataagacattcggcggattcatccccggacaggagtagggtattacttcttcaataagaaggcctgaacctgtataaatcctttgtctccaaacccatacacttttccagcttgatagccacccccttttattattgcagaaatctagtttcgacaagatgtaatactagaatcatcaaaacttccactgggaactgtataaacaaccttaagcttcatttcctcaatcaccttatcgacttccttgttgaactggaccgatacaaaaatggcatatagttggtgggtcagtagtcatgtcattgtaacaataatgcatcactaataaagcttgcaaatcatctatttgcattttatgctcacagtattggggggaatctcatccatgtcagtactggtagctactagcttggtgctctggatcaagaatttatccttgcattgcatatttggtgggcactatttatgtgcctggagcgtaactacatcacccaagaacaatgcagatatccaaatatcaagaccaaacaaggagcctgaagagagccatggcttggcataccataaaatggccaaattaggaacatgtattccctccgtcccagaataaattaatctaatacaagatgtgatatatactagtactatgaatttggacaagtactgggatatgtcacatctcgtattagattaacttattatgcggcgaaggtactatttacttgttattgtgcaagaatcccatggctggacaatgctcgtgttcggccggacaaaatacttcctcggtaatgtcgtcttgacatgaaacaaactttcatcaagccttctcgccaagttttagaaaatattggtcatgaaatggaaggccatggaccttgaatgcagcatgatgctcgctgttgttcaccaccttgagattgcaatagcaccgcttatccagctcaactacacacgagaatttaatggagtgaagaacccacacaagtgggttaaggctaaccatccgtaaatgttaacaacattagataatctcaagaagtcctctgaacttacataggaaagtgagatcctcagggtaaatggagatcagcgttccgctgccgcccattgccacacctgatcaaacaaaataactgaaaggacgccaaaatatacataaattgctgcattacaaaagagatggttttacctttcgctttgttcagagtaaaaatccaacctttctttccaagaactgagttgcactgaaacaaactgaagaaaaaagaggaaccaacgatttgtttgtaacataaattggaagggcaggaggagatagtagtaggggagagagagagagagagagagacggatgtgtttgctttgctatttttggagtgaagagaaacgattagatttgctttgcttttcttcgctttctggcgacaatgacggggcaacactcacttcctgggcacgtggctgatccctttttgccatatttttttcgagtgaacaacaaagcttttttcagttaattggtggctgatgatttatgttactacttactgttcagggcatggaaagcataaaccaagaaaaaggttgagagttgagaccacctgaacaacgtcgacacaactaaatcaagccagcaatatgcactagagaatgaagcttcttcttggtaaaactgagtttaactagtgacatgcaatgcatacaacaagatataagatatctcaagttctacacatcataaaaaccaacatatttagcagaagttgtgcaaacacagattgacaatgacacctagtagacactaattaactaggactcaaagtcacttgtcctaagtggcaaaacactgccctagtctaaaacaaaggacatgttgtcagggttatgggtcaggcataccctctacccttcgatatacgttacatatcgacatggcatacccacacacacgcggatgttttctacatatcctaaggaaacctttcacgaaatctactgatgggaagagtccttctcggacagaactaggtcgtcgacgtatcgtattgggtctgatatctccgagtcctacttggagacctccagatctgtgatataaaagggacccccccggggagggcatagatcatcgaatctcagagccaacacaacgcacacagcctacaaagccgaagtctgcgaggagccaagtcatcgagagctagtcgaatccactcgactacgatctcgccggatccgacaagttccatcgttccctttgtaacctgtgttttccaccatataatcccatatcaactggattagggctattacctaccaaggggcctgaaccagtataattcttgtattttgattgttcgatgtcgtactacgtagatccttgtaccaacgtaccccaataccctttatatccggtctacgggtatcacccgtcgacagtggcgcgccaggtagggggatttggtactcaaggttctactactatgtcatccagcttcgtcgacaacaacgtcaacaccagcctcagccaagcgctccctgcttcaacaatgctggtatggactcaagtcggcgaaatcgtcttcccgttttacaccacgacgctgatctcaaccggtcctccaatgaccggaaacgagaacgcagtggctacaaaccaaggcgacttcatgtcgaaaaatccacctgtcgaaacggagaacggatcatcgacgacatccaagctcgggaaggattctgatacggccaaaccttgcccttctgacatgaaccacgagccggcaaagatgacttccgaagccacaaggtcttggtgtcctatccacaaaaccaagaaacacaccctgcaagattgctgggttttcctcaacgtccatgctgaaattcgcgcatgcaaagaacgtggaattcagcgtacttctccaactcgggatgtctattgtcctattcacaagacaaagaatcacaacctctcgagctacaaagtcttcctcgggccatgaaagctccgtctcctgagtcatacgtccccgtcagggataacggcaaggaacaaggagcgactccagcctcagatcgattcgttgaggtaatcgatatcgatcctcatgaaccaccggtcttacatcttctcgaagactatgggtcatcgacaatgagcgtgccgcaggaggtattggctatcgatgacgttggcacgtcaacgcaagccaacgcagaagcggcgaatcaatcgactactccagcccaacacatcagggccgttcaagccttactaagggaaactccttacgatcccgttctgaatgatgacctcgagcgttgacagaacgactacgggaatcggtgaccaaccttagcaacgcgtttgaagaagtcgctaccgcagcgcaccaagatcagccgccaactagcgacgccaatggtgaagatccggaacggagggaatcacctcaacgagccactcctccacctcgcggcgctggcgatctccgagatcaaatcaacggccgccgagaagcacgacgcacacgagacaatgtaaatcgctctcggcgtcatgtctcttcacggcgccatgataacggaaatcgaggagaccgctcaaacgaggaccgggatcacgacaaccaccgcaatcgcaacgatcgcgaatgacgggggccagacaatactggtcatggccgccgccgtaacgacgacaataatggagatcggcgccgagacaacagcgagagacaacgataggattcccgagatccaggccgtcatactcgtaatcgtacgccggaaccaagtgacccatcgtcatcatcatcatctgcgtcctcctcatcgtcagacagacatccacgaaggacacacgaccgctgacaacccaccgcccccaacgctgggtgcagggctttcggtcgttccctacgtgatgtccgatggcctgagagattccgacccggagcaattgaaaagtatgatgggagcaccaacccagaagaattccttcaagtctactccacagtactctatgctgccggagcagacgacaacgcgctagcgaactatttatcaaccgcgttgaagggttctgcacgttcatggctgatgcatcttcctccctactcaatctcttcgtgggcagacctgtggcaacaattcgttgccaatttccaaggaacgtacaagcgccacgcgatcgaagacaacctacacgcgttgacacagaactcaggtgaatcattgagggaatatgttcgacgcttcaacgaatgcagaaacacaattcctgaaatcaccgacgcttctgtaatccgcgccttcaaatccggtgtcagagatcgctacactacccaggaattggcgacaagacgcatcacaaccactcggaggttattcgagatcgttgagcgatgtgcccatgtggacgatgcgctaagacgcaagaacgacaagccgaagaccgggggagagaagaaatcagccacagacgcatctgagtcaagcaagaagaaaaatcgcaaaaatgggaaaaggaaagctcaagcggaagtcctcgcagcagaatacgcgaaccctcccaagcgcccagacccacaaggcagcgacacaaagaaatcttggtgccccatacacaagacggacagacattctctggaagattgccttgttttcaaaaagtcgctcgagaagcacatggcgtttgaaaaaggcaagcgagtacgcattgtcgagaagaacgaagagacggctcctcacgaatcggattatgcgtatccagactccgacctccacatctcacacattttcggcggctccacaacgtactcctccaagtgagaatacaagaaagtggaacgtgaagtctgttcgacatggcggggggctgcacccaagatgaagtggtctaagcagaaaatagagttctcgaaagaagaccaccccaagaccgccgttatcccaggacgatatccgatcgtggtcgaacccattattcggaacatcaaagtagcgcgagttctcatcgacggtggcagctcgatcaatcttcttttcgctagtactctagacgcaatgggaattccgcaaagtgagttgacaccaactgatcaacccttccatggaattactccccaatcatcatccagaccttttggcaagattacgttgcctgtgactttcggccaagccaacaacttccgaacagagcagatcaccttcgatgtcgttgaatttgatacagcttacaacgccatcatcgggagaactgcacttgcgaagttcatggccatatctcactacgcgtatcaagtgctcaagatgccgggaccgaagggaacaatcactattcaggggaacacaaagctggcagtgcagtgcgacaagcggagcctcgacatagtcgagcaaacgcccagcccacccgccacaactgagccacccaagaaagtgagcaagacaaataagacgccgaagccggacggcgccatcaagatcgttccactctccagtgccaatcccgacaagactgtcaagatcggggcgacactaaacgagaaataggaactcgcgctcatcaccttcctccgcgataatgcctgcatgttcgtttggcaaccgtccgacatgccgggggtccctagggaggtgattgagcacaaactaatggtgcgacccgatgccaagtcagtaaagcaaagactgcggagatttgcaccagaccggaaacaagccatacgagaagagctcgacaaacttctcaaagctggcttcatcagagaagtacttcatccagagtggctagccaatccagtcatggtgcggaaggccaatggaaaatggagaatgtgtgtcgacttcaccgacctcaacaaggcgtgtcccaaggatcactttcctctccctcgaatagatcaattggtggattcaacagccggttgcaagctattgagcttcctcgacgcttactttggctaccaccaaatcagcatggcaatagaggacgaagagaagacagcattcatcatgccgttcggggtattttgctatgttaagatgccgttcggactgataaccgtcgggaatactttccagcgcacggtccagggcgcacttagcaaccagcttggcaacaatgttgaggcttacgttgacaacatcgttgtcaaaaccaagacaagcgactcattgattgacgatctgcgggaaatgttcgacaacctccgacgatatcgcctcatgctcaatcctgagaagtgcacgttcggagtaccgtcgggcaagctactcggattccttgtctctggcagaggaatagaggcaaatcccgagaagatcaaagcaatcgagaacatgaagtcgcccacgagactcaaggaggtacaaaagctaactggatgcatggaagcactaagcagattcgtcgctaggatgggagaacgagcacaaccttcgctctattgaagaaacaagacaaatttatatggacacagaaagccaaagaggcatttattgcactcaagcgctacctatcaaacccccctgtacttgttgctccccaacctaatgaagaattattcctctatattgccgccacgccatattccgttagcactgtcattgttgtcgagagagagaaagtacagcgaccagtttattacatcagcgaagctctccatgacgcaaagacaagatacccacatatccaaaaaatgctttacgcagtcatcatgacatcaaggaagctgcgccactactttcaagctcacagagtcacagttgtatcctccttcccccttggagaagttgtgagaaacaaagacgttgtcggccgcattgcgaaatgggtagtcgagctaagccaatttgatgtccactttctgccgcgaatagccatcaaatcccaggtactcgccgacttcgttgccgattggactatgccggacaacaaatcagacaaccaaggcgacaacgaaacatggacaatggcgttcgatggcgcactcaacagccaaggagcaggggcaggatttatcttgacgtctccttccggagatcaattcaagcacgcaatccacctcaacttcagggcgaccaataacactgcagaatacgaaggactactcgccaggatacgagctgcagccgcacttggcgccaagcgactaatcgtcaaaggggactccgagctagtcgcgaaccaggtgcacaaagactataaatgctctaaccccgagttatccaagtatctcgtagaagtcaggaagctagagaagaggttcgatgggatcgaggtccgacacgtctatcgcaaggacaacgtcgagccagacgagaaccactcgaacccggcacctttctcgatatcctgacgaagccatcggtgaaagaagttagcggcgaagttagcccgaacacccccgacatcagctcggaggtcaccgaggcagaacgcgccgttgctgacatcgaaaccacagacgactggcgcatcccattaatcaaattcatcagcagcgaggagttgcccgaggacgatacagaggccgagaaaataacccgtaaagcaaagatctactgtatggtcggtaacgatttatacaaaaaagcgctaaacggggtacttctcaaatgcgtctctactgacgacgacagacacctcctcctcgacatacatgaaggcatatgtgggtcacacgccgccggtcggacattggtcggcaaagcttttcgacaagtctttttctggccaaccgcccttaaagatgcattcgacatggtccagcgatgtgaagcctgtcaattccacagtaaacacacaaagctacccgcgcaagcgctccagactatccctctgacttggccgttctcgtgctgggggctagatatacttgggccattcccacgaggacagggcggctacagattcctattcgtggcgatcgacaaattcaccaaatggatagaagcagtgcccacgggggaaatcaaggccgacaacgccatcaaattcatcagagggatattctgcagatacggactactgcaccgcatcataaccgacaacggctcccaattcatcagcaccgacttccaagattactgcatcgggttgggagtcaaaatatgtttcgcctcggtctctcaccctcaaagcaacgaataagtcgaaagggcaaacgacatagtactacaagggatgaaaacccgcgtctacgacaggctcatgtcacaagacaaaaagtgggttgaagaactcccatcagtactatgggccgtacgcaccacaccgacaacgtccaataaggaaacacccttcttcctcgtgtacggctccgaggccatgctccccggcgagctacgacatcagagtacacgagtacagaagtattccaacgagaaccaggaggaacagtgagacatcgatgtaaatcttctcgaggagcatcatgagcgagttgccgtccgagcagccagctatcaacagtccctccgccgttatcacgagaagcgcatccgagcacgcatactttcgatcggcgactatgtcctccgacgagttcaaacccaagcagggcaaaacaaactctcaccaaaatgggaaggaccttacacaatcacacaagtcttgcggccaggcgcattcaaaatcgcagacggtgatggtcgcgaattagcaaattcttggaacattgaccaactacgtaaattctatgtatgagtcaataccactgtacctgtaagtacccttatagtatcaataaagcctatttctaggtcccatatcacaatcaaagtgttttcacccgatgatcccttactctgatgacacctagcgttgaaacctgtccttatgtccctttacgccgtctcgacaaggcctccgaggaacctaagggatcttcggctggggatgcccagagccgataaggccttgtcagatcctgtagagacaaaagaccatgtaagatctggtcgtgtaagagttctcaccgtgcgtattaaccaagccgtgaaatcggaaatcaattttccaaactcacggctgggggctaggatcagagcttattcaaccaaggcaggtcaatggtccaagagccttatcctccgagaaaattcctccgacgacaaggctgggggctagggagagtgtacgactcaaacggctgaccaaagtcattaactgagaacacactcttacacacgacatctagagtaagatacatttgtttaaggaatatttctttattcacaaaataattcttacagtttttacataaattttccactacattacatctttccctaagatatctgtgacagggcatgagtactaccaagaaggccaacgctagtccatagactggaagatcttctcggccagcggcgacatcgacctcgccagatggtctatctccgccggagttctccgagaacgagcaaaaccatggcggagaaactcgaggtccaagcgcgggcggtgatctcgtaggcaagccagcatgtgcactccggcgtatcggctcactcgacgacactcttgcttcaaggcctcgtcgatatgcttgccgatgccatcaagttgggcacaggccccgtttagccaagagatgtacccagccgccgactcctcgggatcatcgcggactactcgaagttccctgcatactctggccatggaggcacagcaactcctcaagtaagagttgaaccacacctcgcgacctcggagcgtctccacaacctgctctttcttcacggccagcatggttctctcaagttccgccacttcaaatttcgtcttccagtattggatacgacgatcttgatttgcaagggcaccctcgagatctgctaaatgtgatgaccactaagacaagttggatacctcctttacaacataaataacctaatcaagaggtcactaagaggtgaaaaggctactcacttgaggtggccgttgccatcccggccttcgcatcaagagtttgatccacattgtcagacgaaacatgtggttcaaaatcgagtaccggaatcatcgccagtgactcaggctgcccgcgctgctggacatcctcatcatcaacatctctataatggacaaaaactcccgagatcaacatacaaaattggacaagggtggtaatcgcacgaacgaaggcggccagagttcaagatttacacaatatataacaaatacaagaagtcctactcttcaaaaaggggcagaacagactcccccagatcactgacttcttccatcacctccttacgcgtgtcgcttgccgccccctgatccaagatctcgcgcagatcgagttcaggacgcgacaatcttacacacgcgaggacgtgacacgctccggtgtagatgccgttcgacgtctcctccgcgatcctggccgcatgcttggaggggattttccccatcgccgtcgccagttccgcaagagaggaagtcagcaaaaactcgtcgggattcgccgggatcgtggacttgacgccgcactcctcggcgagctgatggaggccagtgtaggtgacccgcaacgagccatggatctcggagagattgttcccgagttccgacattcagtcctcgagccccttccgttgatgctcgttgccggccaccaactccctcatcttcgtgaggtcctcacgggcttcagctagctcgcgcaccaatctctcagcacgcgcattcgccgtcgccgcttccgacctcgcctccgagatctcgctgccgatgccgcgagcaccagcttcgagaagacgccccatctcgacttggagctcctcccaggtgagaacggccgctggcagaccacgacccgcagcgggattgttgatggggccactaggcgtcgcctcccggctcccggtcatgggcacgacatctgtcgaggccgtggcaggtgatgcgctagaagctcccccggacttggcccgtgcagccttcgcccgcgcctccctacggacaaccacgaatcaaacaccatttgaacgaaaagcacgagaatccaagaatctatttacttacttctcgccgatcgttacaatgcgctgtcgtcgtggaggtggaggggacgcgtctgaagcctgaaagacaatcaatacagagtaagaagaaaccctccttgctgcacgatctgacgacaagatgataccgaggggggtcgctgccttgcggcaatgtccgagtacagacgagaatttcctcgccttggtcgggactttgccaccgctagtggtggccgcatcagatgcctccttgacaaccttctcctttagagatgtcgccacctgatggtccgcgagcggcccgatgatgtcagtcaaaggaagggcctacgcttaatcaggtcataaggtgatttcgaaaggagaatacgagatgcttatcaaatacacttacgttgatggcttcatcgcgttccgccgcccccttttcacaaaggggcacggggatgtcgctagccgtggtcggaccgctgatcatcacttgaccgacgcgccgctccatagcttcgctgcttagacctgttaaacggaaaccaacttttgataagtcaagaggaacgcgactacaagcacgccaagatgaatacgagaaagataccccgaggagaaacccgggtcgcgtcatccgacccgaaatagttataggctggatgggcccgagcctggagcggctggatccgcctaccgacgaagtctgcagcgacttcatatcccgacaagccctgttctcggagatcatcgatgatgtcgataaacgactgaagagaggggctcaaagggggcttggcggtccaggccggaatcttgtccggttgatcctcgggaacaacgaagacagggttcgagtccttgatctcaagatagaaccacctgttccgccacttactgcgggaagaaggacactggaaggggatataacgcgacttcatgccatcacgaagtcggaacccgacgcaaccagacaccctattggattccatccaacgcagttcatagtagaaacggaagagatcgaaaaaaggctctaccccaatgtaggcctcacagagat

SEQ ID NO: 17552 - DNA, 2688 bp, Oryza sativa
taggaaacctttcacgaaatctacagatgggaagagtccttttcggacagaactgggtcgtcgacgtatcgtattgggtctgatatctccgagtcctacttggagacctccagatctatgatataaaagggacccccctagggagggcatagatcatcgaatctcagagccaacacaacccacacagcctacaaagccgaagtctgcgaggagccaagtcatcgagagctagtcgaatccactcgactatgatctcgccgaatccaacaagttccatcgttccctttgtaacctgtgttttccaccatataatcacatatcaactggattatggctattacctaccaaggggcctgaaccagtataattcttgtcttttgattgttcgatgtcgtactacgtagatccttgtaccaacgtaccccaataccctttatatccggtctacgggtatcacccgtcgacacatgtcaacaatccttggttgtttcaagcatattcggaaaaaaatatcctcctttatcgtgcgcacgctttctaaactactaagcggtgtgtgcgttttttaaataattatagaaaagttattttaaaaataaaattaatatatttttaggtttaaaatgattaatactcgattaatcatacgctaatgacacaccttgttttgcatatccttttattcttttttattctctatctttcaaacacaccttaaactagtgacatgttcatattcttgcagtcacgagaaacacaatatgcatgtcaaaaactagtatttcattaggttacacaaataaaatgcccttttatcactttcagagaattaaccaataaacaatgcgattgacacaaacaaaaaaaagttttatcacttaaggttcatttggcaatgaaaataaacaattgcagggataatatggctatggatggatgagagcacatcactcgatcggtcggatccaataccagggagccgggactgatctaggtctgtgcatgctgattaataagtagctaaaattttaaaggacaatgatttaaaaaaaaaataaaaggacaacacttgacttggactagagagagatctctatcggataccagaagagacatgattatgtgagtttgaaaaaataaataaaaagaaggcaagaagattgccttatattgtgatagagtaggagagcatcaaatttgttcttttgcgcgatgcccctggagaaaagcctttttttttctcctgttccccctgacaatggcattcgaccgttgcgtcgtgtatttttaaaaaaaaactctgcttcttctaatatattgacgtataatccttttttctttcgtgaaaaggagagcatcaaatagctgaaaacaatttaatccaatagctaaaaacaattcaatccaaacactgctgtgcaaaagaacatatgttgatagagcatgtggcaagaaaacccaagaaaatccgtttttctcctgttccctgacaatgtccttcggccgtttgtgtcgtgtattttaaaaatctatgcttcttctaatatattgacatacaatttttttacgcgttcgcgaaaaagagagcatcaaatagctgaatgggcaccctagctgaaaataaatcaatccaaagctgctgtggaaaaaaacatatgttgcaagctagcaatgtcatttttctgcggttgaatgttttagaatttaagcaatcgtgctccacaatacttcaacttatgtctacagacaaagcaagtattcttccggtaattagcatacgcttctcttatacctgtttggttgatagagcattacacattgtgatgtttgtgtcaacttgcacatagatcgatatcacacattagacaaaggaggacaaccacaacattagtagtcatgcaatgagggtattcagtattaactcacggtggcaattgcagctggtagcaaagattgaacacccccaatgcattattttttactatcaaattataatatttgtctgattgtctttcgtatcatattatgttcttatatatatatatatatatatatattttttatgtgactttaacagttatgccgctaaaattgaatatataacgatgttgagagtgaggtaacaggtcaataagagcagaaccactaccacatctgtcataaattgttgccatttctaaaatggatacaagtattaagaaagttgatagaaatgattagagaaaagttatgattaattgtgaagatgaagcgaatatgataattaaatcgaaaatggttgtgattggttgataagagaagcaaacggaaaaatagttctattttggaataaactattatgctaaaaatatctatattttgtaatagaggagtaaacctttaaaaaaagagaaagaaatcctaccaagaaaaaacaaaataaaattgccttccgacgtggcgaaagagagctagccaaagccaagtcggcctattcttcgagccaccacttttttttttgcccttttcaatacccaccgcagtaccgcacggcggcagccacgaacaccattgagtgtgaaggtgcgcgggccccacctgccagaaaaccatgtggataaaaaactatattttggttgctcgattaccgggcgctcctcatccagaattccagacacccccgtgcacacccgcgggatcccgagccca

SEQ ID NO: 17553 - DNA, 9704 bp, Oryza sativa
  unsure (1)..(9704): unsure at all n locations
tctattcaggtacgcgcgcgactaggccggtatttggtttgcacggtctcctggatgcgtttgtgctgtagatttctggatcatggtggctagattggcgtgtacggtcgaactggagatttaggattggattatatgttgttgtaggtgggatttgtgaagtgcttgtggagattanattgatgaagtccatgctgtttttttttatgttcgttttttattaaaatactgtatttgatactggtgttttctcgctgctgcagattcagaatcgactttattcgatgtcgtcgcttccactaaaggctcgaggcgtgagaagatgcgaggcttctctagcaagtgactacacgtgtgtgattcttaccataagctgcatgattcgttgaactgtatccctccaggcaggggacctgcctgtcaaattgtgacgatgtgttggtcatttcaggaataattctgatggcaactcttgcatattttcaggaaggcatctgaggtagctgattttgattgggagaaccttggtttggaatcgtgcagaccgactacatgtatatcacaaaatgcggacaggacgggaatttttctgagggtgaaatgattccatttggacctatagcgctgaacccatcttctggagtccttaattacggataggtttgtattggaggtagatctccttgcttcatatatcctgagtacattgtggtaactgaagataaggaaaattgagcctttttaaatacttttcgtcctaaaagattataattatttacagggattgtttgaaggtctaaaagcatatagaacaacagtgactctattttattatttcgcccggaggaaaatgcactgagaatgagaacaggtgcagaaagaatgtgcatgcctgcgcctagtgttgagcagtttgtggatgcagtaaagcagactgttttagcaaacaagagatgggtgggtttactgtaaaaagtaaatcatttcatagtgggctaggccgctgttcatactcttgatttaatcatttgttaaataatttttaattccaggtgcctcctaccggtaaaggttctttatatattagaccgctacttatgggtagtggtgctgttcttggtcttgcacctgctcctgagtatacgttcattatatttgtctcccctgtggggaactactttaaggtttgtgtttttttctttaattctgctccctcttttagccgcagcgttgttgccataaataaaaaaaaaagctatggtagatactgttataatctgcgttctacttgacaccgtgtttctgaatatatatttcgcagcaacttgacttatgaatttatgattttttttccacttttgttggttgttgataactgatggttgaatgtagaatttctaaacagctcatgtatcatggattttttttaatttaatttattcactcatatcttcaggaaggtttagctccaataaatttgatagttgaagataagtttcatcgtgcaacccctggtggaactggaagtgtgaagaccataggaaattatgcctcggtaattctacagtcaagtttgaaacccattacttacagcttttgatgcggaagttattgtcatggctatttctgcaacttcgctacctgatatttctctttctgatgtttttgatgtaatgtttttagttcagatctgcaaatattaaactacggaacagtcattctattgatgtgaacatgtggttgaaaggagagttgtcagtgcaattctcttaagaacatacaggccattatgaagctgtgaaatgaaaaataattgaaccatcagatatacttcaaatgaaatgctattttgtatgacgacttatatctccctgctatcttatcattattattttctgctatcttctatgttgaattctgttattattttcactggctttaatttatatactgtctttgcataggtcttgatggcacaaaagattgcaaaagaaaagggctattctgatgttctctacttggatgctgttcacaaaaagtatcttgaagaagtttcttcatgtaatatttttgttgtcaaggtgtgtttatgctgtcaataatacctgttagtttgattcgaacactttctcctgtaggtccagttaatattagcctttttagttctgaaagctaccacagtaaattaaccgatgctaagatttgtaacctactctattaagtattaacgatcagctttgttttctttactgatagatgtatgtccttatgtctatatagattaaagaggtttcaaataaatgaaatgagtcatacgctctttgaagtagatatttgatactcttagattgaacaggcttctggctcaaaacttttgaaaatctgtaacagatagcatggtagtacccaaaaaatatagatgtgttttatgtgttagttgctagcaacatccataagtaaatgcataccctgtgggttagtgtacttctataaatgatggagataatgtgtcaagggatctaatttcataacatacaaactcaaaactgctactccctccgtcccagaatataagaagttttagggttggacacggttattaagaaagtaggtaaagcgagtggtggagggttgtgattggatgagtagtggaggtaggtgggaaaagtgaatggtggagggttgtgattggttgggaagagaatgttggtagataagttgttatattttgggacaaatcctgaaggctaaaagttgttatattttggaacggagggagtaccttctaccatgcataaacctctatgaattgttacctaaatgaaaaccacaggcatatctacaacacatggtcataggtattggttcgctagcaatacagtgccatgactattctataggataatatcgtactaacaattggttgttctacacctattaggttcagccaggttgtctgtgtcgtatcctgaatggcaaactattgttgtatttgttttagtttatggtggactttgtatttccattgcagacaaaacatttattgcttatttttgcataaggatagtcaacaaattgaaggaatatcttatacatgctgcttttgacttgagatctatttagggcccgtttagttccccatctaaacacacccttattatttttcttggcttttgcaccagggcaatgtcatttcaactccagcagtaaaaggaacaatattgccaggcatcacaaggaaaagtatcattgatgttgctctgagcaagggtttccaggtaaattaatcatcaatcccatgaactaccaggcaagatgttttactttcagtgtagctcaaattagtagccctgtgatttgatatctttgacaacagcattaggtattcaacattgatccttgtgtatttgctaggtatccaagtccatgtttctatttgtccatatcatccttcttgttcgctgtgaatattaacaatgggttatctatatttcaatctaccaagggttatattcatggttaggttcatatgagctacggctacattgaagaagatagaacctatttttcctagcgatgtcgatccaattagaagcagcaaaacactgttctcaatctgttactgaaaattgttacatctattctcaattttttgggaaatcttctattaatgtttttttgtttcttgaaggtcgaggagcgacttgtgtcagtagacgagctgcttgaagctgatgaggttttctgcacaggaactgctgtcgtagtgtctcctgtgggtagtattacctatcaagggaaaaggtgatactcttatccttccttgcattgtttcaagaaattagcaagcatattacatgaaaattagacaatataacactaaaatagcaacagaacaccatccaagaaattcaacagtctaatacaccatctaattcctaattgtggcggctaccaggctcctaggtggcacccagtgctgacttttagaacattgcttccttgaaatttcagccgtttgctgtatgtgtagtcaaaagtcaaaatttaaattgtttcctttccttacacccgtattatgtattgttcctcaaataaatcaccaattaagccatatgaactacctaatgggccgaaacctagccaattcttcaccccatgttgcttgaataaaggaaccactaaagccatataaaaacaattgaaaggtgtatattattcactagtggctagtaagtcgtggctaaccttttttgttggatctcctactaagatggacttgtcttggtaaaatttccgaagtcagagaaagtttgttcttccaagttccatcatactatgcaatggatttttcgttgcagggtcgaatatgctggcaacaaaggagttggtgtcgtgtctcagcagctatatacttcattgacaagcctgcagatgggccaggcagaagattggctaggctggactgtgcaactgagttaggaagtaataaaatgttcatcaacatcaaaactcaaaagatggacatgattatgatcatgtgtacccttcagttttgtagtttttgttggtgtgacatcctgctgtatatgtatagacggcagtgcattatagcgcgaagcagttttgctaaggaacgacaccatgcatccagctttatgccttttgcatgagaaatcaaacgtggaaggctctcctgactgaaatatcgacaactataaaactattttgctatgttgattacaatatcctagataatctaaattaacttcttttttgggctcccatagagtcagatcttcctatgccctatttttcatattaaactaagaaacgattattttcatcctcgtctttagaaagtagtcaaataaaaacttgagccttttttaacttctatactcgtattagttcagttttgtcatatgatccaactattccaagcgcacaagtgaaagctattgaagaggattatagtgttattgccctatttagaaaactggaggaaaactattagcacccaactgttagggctcgatacttcccattggagctaatatatagtgcttgtttagatggaagctaattttgatcacacagttacaaattgatagtagtaccttagtagcggcaaaattttccaaggtttgggtatttaccaaaatattgataaggtaaatgacaaaattagctctaaaccaaacaagcgcataactacaactcattaacatcgtttaaatacgctcgtgcctgagggcatgtcatcaagaagcttaaccaatatagattcatagtacaattttctgtagcaacgcgtttggcgtcatgaagttgcataaagttattatcaagaaggaaagcataatccacgatcatctagaattttgtcgttaaaaagacccaatttcctttggtacttactgtccgaatcctaaagctacacatccgtaatttaaacacaatcagaacatccgacggcgacgcatcgtccctcagctcctaaacccctcgccgttgctcgcttcgatcggctcgccttccgccgccgccggacgcctcctcgcgccgcccgccgcccgccgttcgccgttccttgcgcgctgaggcggaagctatgtattccccgcaacctccgagcgacggcaaccccgacgacggagccctagcacgccctcgccgccagctctcgaccgcctccgctgccgattccctcgccgtgttcgccctcgccaagttgatcgacgaccgcgccacacatcaagctgatccccaactcgccctcgccctagccttcgcgatctgtgcgcggtttcaggtgagcgcctcgatcattgttactgtttgagtggggatttcgccatctgcgtggcatggcatctcttctcagcggactgtaaatacttataactgatatagtgatatgtatgtttgtgttttttgtgaaggaacgatcaatcacgttcgactcatcatcctatcacaagcttggtgacgattcaggtgcttttaccacaaaaaatgatgatgatttcaggtatatatatgcgagcatcttagttcgtttttgggttaaaagctctgtgctaactgtaagcctttaacctttttcaaacgaaattagacaggcaactagaatatggattttatttctttttactatagatggaggatgcaaatatacatgagaattccttgaaaaccttcgacggaaggatgctaggaaaattccatgtacatcacagaattcctatgaaaatttgctatttgaagcacacctcacatgcataaatttaggctctaggatttgaaccgtagtggacggagttatgcaacccacaaagtccacaactctactactgtgccttactgaaccttggaaataggctacatgcggattgattttgtgtttcatggtttccccacaaaaggactgatgcttattcagaagcacagcttcgataagagtggacattacccctgctattaggtgataatataactattggtttatcaagtctcattgagcttcattgggatgatagtgactgattttgagttttttttttatcggccaatagtatggggtgcctcggagaggcatatgcaagagaaagaagagcgaagaaaatgaacaagctccatatatgtcaaaactatatttatttattacaatacaactttgtgctattcactgaaaactttcttttttttagtttggttgtttctcttttatcgaaacaatatagtaaatcttttgctagttcctcctggtgaccctctcttctgagttgttcatcagagtatactgagtgtggacccccgtttttataacaggaatcaatcgtgtaatcagtaccatttccctggatcaagtagtttggtacacacgaattcatagctggaatatcaagtgcacatacacgagtgtctaatacgaattattacatcataggcccgcaggcatagtcttaaatcatcggaccgagaggtccggaatacatccaaaagcagaaatagataaggcagcggaattcaggcagcggcatgccattgccacaggcaacgaacgtactaagacctactggacgccatcgtcttcatctctctcctgataataggcatagggatcctccgaggcttcatctcccgcatctgataaattttatatttgcaaggatgagtaccaaccgtactcagcaagccaccacagcaacaatgcatatgaaaggggagttcaaaggatggccatagttcttttgcgcaaagcaagttttgtaattcttttcacaagcctaagacctagcattgaccgatcaaattttagtaccagagtttgtatttaaacaacgacggttctgtccaccatccattgtgatcccaaggatagcttcccgccattgattcgtcatggttttctgaggatgtccaccttcccgcctctcaggaagtggctccatcagcataaaaatcatcatgcaacatcccatcccacacacgttaaagaatttagagtctagccaagtataatacatgtctcggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctggcgctcccgggaaagagaagtctcacacacatattaaattatggttcaagttaagttctctctctcacacactcatggcagtcctaccaatggcgacaccgatgtagggcacgcctcttggccctacctcaacggctgtcccatcgtagcgcacctgcctcactcaggggtgaaccatctatgcagggatactgcctccgctcggctatctaatccgctaggtctatacccattcgagaagtacggttgtacgggggtcgtttcatgcttaacttcatggctcggtccttaattgaccggggacggtactagccttttccagataccacccaaatcctccgtccgccccagtcgaaaacagttgtttaattttatttctcctttcacaaatcatgtcatcaacatcatggcaatgtggcgctcatgtcttcacatgccgcatctcaattaccttcccaaaggtaattgcccaagcatatagcatttgataaatatgagtatgcatgattttagaatagcatttctaagcagttgtcataattgactagggactcatacgtaatcatgggtacaaggattttaagggtaaacaataatcaaggcatggcataatcacaagtaggacgttcatcattgcatgcaattttatttgtaaacaaacaatttcgcaattaggatcaacatgttcaacgaatagtgatgacttgccttgcttaaagtcttgcgggtcttggccttcgcttggatccgcaactccctcgggctctatagttacgtgcaaaaattgatttgaattcgattagaattcaaataaaaatccaaataaatccaaatgaaagtcgaatgcgaaagtcgattcctttttattaactttactatctgcaaactacggcaaacccaatttcgatttaaactactttgcgggtataattatttcattgtcaataatttactctccccgagcattgtatataataggttagaaatttctattacgagctaaatattggacgaaatcctagaaatattatacaatttaatttagtctatgactaaacgattaaatataatatacgtctaaaattcctagcgattaaatccgaatttctaccgtgaatcgattacttatagggattacccaaaaataatctataataatctataagaattcatctatttgtttagttattaattacatctaaattactaccgcgaattgatttcttatagaaattactaagaataatccataatttatattaaattttgtaattctacgactataattaatctataattaaattctaattattttaaattttctaaacttccccaaactccctctaatttcctatttatttcctttttctttttctccctttcctttttcttttcttttctcttctcccttttctttttctctttttctctcttttccttttcttttctttctctcctctctttctttttcccttcttctctccctcccggctcctttctctcttcctcggcttctccctcccttggtttcttttcttcttcctctctttctctcggctctctctctctctcggctctccctcctacccgagcggtggcggcggtgggcgcgagggggaaggagggcggctcaccgacggcagcagcggcgacgacggcggtggcgacggtggcatacggcggcacagaaccggcggcccggtggcaccggagcaccggcccggcggcccggaaccaccggcccggcggcacgggaacggcggcccacggcacggtaacggcggcccaccggcacggaaacggcggcccaccgccccgggaccggcggcccaccgccccggaaccgccggcccaccgccacggaaatgccggcccactgaaaagggaaaagggaaaagaaagggggagatggagtgaaaagaataggggagggg

SEQ ID NO: 17554 - DNA, 10731 bp, Oryza sativa
gctcacaatatctttgactatgaaaccttctatgcatgggggataatattctttcatttcttttcacatgcagtgggagttattttgcgggactaccaacctgggatgatcccactggaccatctgatgaattactttcaaggaactgcaggatgaatttattgctgcctgcaaaaattgtaacttgccctgggcatacaagatgccaatgcccgaacatttggaaagactcagagaacagaatgagtgcaagatgttagaaataccactgcacttgtatgtgaagcaaaaaaatattctggtaccaatccacgaatatctgtctaaccttgaatttctaaatcttgcatcgttcgttctggggagataggggaggttgagtctcgttttccgcgctcacgcttttcaaactactaaacggtgtgttttttgcaaaaaatttctatagaaaagttgctttaaaaaatcatattaatccatttttgaaatttaaaatagttaggactcaattaatcatgagctaatggctcacctcgttttatgtatcttttcaatctcctcaatccccttctcctcaaacacaccctattttagaagtgttagttttgccttggctgggtaaagttggaatatttgtttgtggattagaagatggaaatgtatctggactaatatcattatgtttcagcctgctgagttagaaatcatggaactgaaagaaaggagtctttttacggaacgtcgcaaagtatatggacacttcaacttcttggtgaaagattcagatggcactcatactttgttttttgctgaggtggatctaaactgcaaagaggagaaggacgtttatctgtgctgtcctttggaagagaatgataatggtattatctttcctttcttgtgaataattgtatttattctttcattttgttaaaatgtgtactaatactttttttttctttttaaggtcattgttttggatgtcgagagtgggacgtggcacttcagcatcccacttctgctgactatctgggtggccacaaggatatctgtgagccgtacatagatacagatgatgaatatttcgaatttatgtaatgaacctactaaagacatcggcttcaggatcactcacaagtaggaaggttgtgacgctgaacgttcatatcgatgtttggaaggtaatttaagcaaaggggcatggaacttcaccagactggaccatttccttttgtactagctatagtcaattcatgttctacgtatgcttgttgtgggttctacttagattggtgctagtatgtgatattgtcatgactgcatggggatttgtacatagcctccatcttaatgaaatttgatcggcctttcttccaccgacccggcaaaaaagcctttcttctgccgacccggcaaaaaaaaaagattgtatggggactttgtccatgcgtattattggaggcaggttaggaggctctttcactagcccatcgaagcaagcgaagcacgatggaacatggtgaagccaagtggagcttttaccaagatcgagtcaaggcgaaggcgagctgagctgtggtgaaacgcattggagtaggctgacaacgcctatctggcggcctaagcctggcctgctaaggcctagtagactcaagtgagccaaggacataaaaaaaatccctgtagatacccttatcatataggggtaaaaatgtaaaagcctatacatggtaaaccatagggttagatttggtgttgtaaacctatagatagctctcaggtagtgtattgtaaagggcgttcaataaaaaaaatacaactattgtttttttttgttccgtacaccaggacaagtgtttgtctttcgacaacaattggcgccgtccgtggggagcctagccaaagtcaatgccgctgaagagaagattgacaagaaggagggtggttctgcagaggtatgcgggtgctgtcgaagattatgtcgagtatgccttagaagcctaagccaaagcctagctcgagggacctctggcaatgaactcggacaagcaagcctcaagaggagataaagttgagtgcctacgggctacgagctaagctgctttggtcccaaggccggagtatgaggttatgaggtagtcaagttgcaagagatgcttcactagatgcagcaacaacagtagctttgtcggcaagagtcggcgtagctgcacgagcacctatgccgaacatgcttcaatcccaagtccaatctctctggtaggctcacatgataccgccccaaactatagtcccaggtgttgctttgacgacataggtttcgacatcacagtctaggttgaacctagcatcgatcctctaggcacaattccaaatcttcctcaacaagtgaatgcgggtcttcctcaaagcatccaactgccacaacaagcagtttcacctccgctgacgacaattgccagaggagcaagttaaaggttggtggtgtggctaccaggggcgtcaacaaaccacttcgcctagtctacgcccagcatacactgcaacttcgccagccaacctagtcgcgcacggagctttggtcaagggatgtccccccaccaccactggcccagcagcaaccagcaatctcatcttcggatatctgtgttgtcctttggaagagaatgacgatggtagtataattagaattttcactccttttgtaacaattatgtttttctttcatttttttaaaatgtactaatacttaattcccttttctttttaaggttagatattgttttgggtgccgagtgcagcatgtgaaagttaggcatcctacttctgcggactatttgggtggccatctatacatatcccttcaccttaatgagggctcattcgaactggaggaaaaccgccggaaaaatggaggatccgttatcctttgaattcaatcactaagagtggagtcggaaaaccgtgggaaaaatggaggatccgttattctttgaattccatcactaagagtggaaatggaacatgagagaaactaattgagagcaagaaaagaaatcgaacaacccaacattcgtcatatgctgtttccgccaccagatacagcaaaaaagaacaaaattcttaacacatatgaatatactcatataattcaacccgttgcaaagcatgtgtatcttgctagttaattttaaacatgagaaaccaactaacatatattagatatccttccgtccccaacaaaatataaatatttgtagctacgaatctagataaatgtttataaaaatttaatgtttttatattttctacgattccggttaggattgccgttagcgtgtccggccgccgggcggagtacaaacgctgttttggaaaaggttcccagcgacgcacttgcactccaggtgggacatgaatcctgatcggactccccccccaaaaaaaaaaaaaaaaaaaaaaacaaaaaaaaaaaaaaaacctttttaaaaaggggggggggagggaaaaaaaaatcagtgcccgctgaatatcgtcactccgctcccgaatcccgatcccgccggcgccgccggtcgtcgttgccggagatcagtcgcgccgccggtcgtcgttgccggagatcggaaggtttaaggataatgtatctcccaagcgaccgagctccagcagcagcaagccctcacccccagccatccacctcagctgctgctcccctcgccggatcatcttctcgcaagcccgctgcttctacccaaatagtacttaattataggtatgtggcctcctaagattgcaggatctgaaaacagctgattttttttggttgccaagctcctcttttaaagatatatatgagttcttatgctatctcctctataaaaagtaggaccataagcttccttgaattcctaaaagggaaaaagaagttaaggtttttgctcgatgtagtgtaactagcccattcctccttgaattccatcttacaattggtgagctaaagtttttattgtgtaccaaaacaacaaattagttaaatattatctaaaaaaacaaattagttaaatgaacaggcgtggtattagaaatataatctattcactgcatgctttaagttcaagtaggggaatagcatatgtatatatgttcacatttattaatttccacttgcagtggggaagaagatccaggattacagctcttggacaattacgatccccctcgaccatcgcgatttaaaaatgcccaggaaatgagagatgcttttgttgctgcctgccacgcgacgctaagccctttgcagagaagtggcgattgcctgaagatttggaaagactcagacgacaggatcattgcaagatgttgaagatagcactacgcgtgtatgccaagcaaaaaaatataccggtatggaaccacgaaaacgatggcgatatatattttggctcatcgtcaatctcaaatttctaaattctatcttgttcgagaagtgttagttttgcctaggctaactgggtgaagttagaaattttgtttgtgggttggaaattggaaatgttctacatatctggactaatatatcattatgtttatttcagcctgctgagttagagattatggagctgaaagaatatactcgttttcgtgaacatgggaaagtttatggacactacaactttgtggtgaaagattcagatggcactcttacattgttctttgctgaggtggatatcaactgcaaagaggagaaggatgtttttctgtgctgtcctttggaagcgaatgacaatggtacgaatataagaagatttatttctcttttttgtgaacacatggcaagataattttctttcgtttggtttaaatttgtactgataactcttgttcttttcctttttttgtgaacacatggcaagataattttctcgtttggtttatatagacgctgtttacaacgttcccatgcacttgtacaccacgtcgggcttttttttgaacggagcatcgggcttgaatataatcctgatcggatatactccgacggaaacattcttaaacgggagaatgtaatgagggtgaaataatccattctttccgaggaaaatatcagacaacgggtcctcctccgctcccgattgattctccggcgccgctcgattcgatccgttcgccgccggtcgtcgttcccagggatcggaagcccgttgtccgttcaagtgtaagaccgccagcgctccactacctcgccgacgcgatcgaccgcctcaactcgccctcgcgcggtttgttttttatttgccttctgtgaaggaacgagcaatctcaatctcgatggatatcaggtatgggaaggaaatgaagagggagaaggaatattctattattttattttagatatcccacacaaaaaaaatgactttttattttatcaatgacttggtaattactcggacgagcatacggctcgggcgatcgatccgtttggagtaaaatcaggctgacgtcagcgcccgatttacgtataaaactattttaaactgatttttcttctaaattacttatccaaatcatgattcgattgcaccattaaattcattgcaattaaatctttaaaacaagaccacacatggatatattccaacaaaaaaaaaagcttattattaaattatttttaaatgttgcaagatgttccaccatgtatatcagaattgtttcactaagtagatcgaaaatgtttcactcgtttaaatcgggtgttgtttcaccttatataaaaacaatgtttcagtaaatagcgaaagaatgttgcagttcactgcaacattagatttatacatagtgaaacatttttccgtggaacaaaaaaataaaccaaattcttttaatagagggttttaaaatatgtgggtttttttgttgcaatggaatgtttcgttcactgcaacattagatctatacatagtgaaatattacgagtacaataggtgaaacatttttggtggaacaaaaaataaatcaaattcctttaatagagagtttccaaaatatgtgagtttttttttgcaaaataatattttaattcactgcaacattagatttataaatagtgaaacattataagtacattaggtaaaatatctttcgtggaaaaaagggaggtagaagtgggtgggcccaacacggagggagggtgcgcagggggagcgcccgatccggctcccccgcgccagtcgtccgaggtaaagtattttcgtaattactctctacgttttatgttacaagacgttttgattttggttaaagtcaaactgattgaagtttaacagaaaaaagtaataatattttcaacaaatttattatgaaaatatatttaattatttatttgataaaattaatctaatattataaatattttattattttttctataaacttgatccaaatttaaaagcagtttaactttaaccggagcagtaacaatcagggcgtgaaacctgatcggaatctcggatacgctcgcagctcactacgtatattccggacacgctcgccggaggctgaaataaatcgacacctttctctctccccccgatttccctcgccgctgctcgatttgatccgttcgccggccgccggccgccgttccctcggtcggcgttcgttgcgcgttgaggcggaagctatgtattcccccaaattccaagcgacggcaaccccgacgacgacgccgagggagccctagctacacgccctcaccgccggccatcaaccgcctcctccgctgctacttccctcgccgtgttcgccgtcgccaagttgatcgaccgcgtcacctccaccgctcttgtcgatccccgactcgccctcgccctcgccctcgcgatctgccagcggattcaggtgagcgccctcttcttcctctcgtgtgaatgtgtccttggagtgattgatatctcttctcggtggactgtaaatatatatacatactgacctgcttgcgttttgtgaaggaacgatcagtcacggtgtatgtgaccctcgattcatcatgccgtcgcaagcactgtgatttcaggtatgcgaccatttttatttttctttttgtttcgagaacacgcacaaggcttgcgtatctttgtattacttcattcgtttcatattataagattttctagcattgcccacatatatatatatatatatatagattcattaatatctatataaacatgaacaatgctaaaaagtcttataatataaaacagaaggagtataaaattgagaaataattacatccagctagttacaacacgaggcaaggcgaaacaaagttgttgacaaaaggtttatatctcgcggcatagtttgtgcgaccctattagaacccagaatcttaattcgtcgttgggttaaataatctgatgctctatggtctgtgctacctgtaaggctgtaaccataggttcctgatgagatgagatttattagatctacctccacccccttgtcagttttaaacgaaattagagaggcaactagaatattttttttctttttagttatagatggacatagactgacaagtgcttcccctgaacaaaccttccacagaatggatgccaggaaattcctaaaaaatccctatacaaaaaattcctatttgaagcccacctcacatgcatcaatgttgacactaggatttcaaccatagtgagtggagtcatacacccacaactctactactacaccaaaggataaactactactacaccgaaggagtttaaccttcaagatagggatagctagacagtgatggaagcagtgggtattccctttataatcgggaatacccaaaaatttcacaaaagaacttaatatatgtaggtatttacatgtatatatactcgattgtctaatattttttctcaacaaatatactcctgcactcctagctcacaacacttagttagtcaactgcttcaaatcttctaaccctagtccaccaaacatcaggcacaagatgcttgcaattgtttgagtgaatacctgaccaataaatcctgcgtccgccactgtagatagacatggattgaaggctttcctcacgcagggactgatgcttattcaaaagtataacttagataattgtagacatgaggcctatgcaataatgcaaggtgataaaaatattggttagtcaaagtcttattgagcttagggtggtagtttccccgttgaggctggtgcagaccccagttttgcacccggtgatctatcggagcagcgcgggtatgcaatttgacccgcaggtagggaagggcattcggtgacaccaagcaattcagtctcggtctaattattgtgagtaagatgaaattgagccaatcatttttttaactggtgttccaaaacaacaaattagataaatgaataggcctagccttagaaatatattatattcacagcctgcttagttgattttagaagcaagaaccaccttaaaggtttatggaaatataatcgatgctcactatatcattcgagtcatgagattttcacatgcattttggggatgattatgctttcatatcttttcacatgcagtgaaggtgattttgcgggactacagatagaggatgatcccactcctagactacttagtcgatatatatctgacacgggactgtatgttactttaatggctacttacaagagcggtgtgttcccctcgtcatacgagattttatttcctgaacaagaagaggaggcatgcaagatggtggaaatagcactgcacgcatatgccaagcaaaaagatatgccggtatggatccacgaaaataacattgatgatacattttggctagacatcctcgaatttctgaatttgtacttttatatctgtataagttttagttttgcctaggctgggtaagagttggaatatttgtttgtggattggaagttggaaatgaatttacctatctggactaatatcattatgtttcagcctgccaagttagaaattatgaaagtgaaagaaaggagtctttttgaagaatgtgggaaagtatatgcacactttaactttctggtgatcaatgattcagatggcactcgtactttgttctttgctgaggtggattttctcaactgcaaagaggagaaggacgtctacctgtgctgtcctttggaagagaatgacaatggtaaataagatttctctttttgtgaaaaattgtagttttcattcatcttgtttaattaaatatgtactaatattaacttattttctttttctttttatataaggttattgttttgggtgccgagtgcagcatataaaacttaggcgtcctacttctgctgactatttgggtggccacaaggatatctgttctgaatatatagatgtagagtattgttttgatgactattgactaatattaatgtacctacttataacagattagtttcagaatcacccgcaagtagaaaggttgtgttgctgaacgttttctcggatgggctttagcaaagcggcatgtaatttatgttctgtgtaggttctactctggaacggtgctacaatattgtgatgtacactgtatgcttttgtataacaattaataactcattaattaacttatagtactataaatcataggtcgatttctaatagttgccgcgagtaccagagcatccaggtgtggacgccaaatgtccagacctggacgctatattcaacgatgtacaatatagcatctggttcgatacgaagaaaagcaaacagcatagttaaaaaaaaaagctattgcggtaaattatgttggttgttaatcagtttttaattttttagaaataaaattattatgggacggaggtagtatagaacgttcccacgagacgcattctctacgtcacgtctgactataaatcctggtttatactaaggtcatatttatttcagcttaggattattataatctgaaacaaacaagtagattataattataaactataagccatattactataatctggtaatctcctctaatgtgttttttttcatattattggatagctaaagccccactacccttaaaagttttatgcaaattacccaacattgtcatcgaacccaacagatcggccacaacgcatttgctttctctcttcctagtcgtgcacgaattcggcgtctcccccggccgcgcgtgcatccgctttctctctccctagtcacgtgtgaatccttccccaagcccgcacccagcgcgtggatccttccctcaaaccctaaccttgcgcgtgaatccttctccaagcccccaccaatgccctggctccttccccaggtcgtcgccgtctcatcctccacctattccacaatagctgagagcattagagcattcacaatgtgcatataaagtgggtggtaagaaataaaatactactactgcccggttgtatacactgtgggagtagtaagcaacaaataccaggtaatatgcttactacctagccataagaaataaacaaataatttctctcctccctctctcatgtctagtggttgtgggacccagcttaccacccacttttgttcatttaatattgtagctacaacaataactaatacccactgaaacaagacctaccattattcacaaagtaggtatttcctccgtttcacaatgtaaatcattttagcattttccacattcatat

SEQ ID NO: 17555 - DNA, 29975 bp, Oryza sativa
  unsure (1)..(29975): unsure at all n locations
attttctcgcttccgctgcatttgctgaaacttagtctgtgcccgtttttgggtcttcttcttcttttgctgcctgttgtggttttttttttctggggcgcctgtgcccctttctttgttttcagctcttgtacagtatttggttttggttaatcttattcaggtggggagtctttcccccgtgagcgttcaaaaaaggaaggtctagtttatagtaatttgattcgataatcagattattacaagaatcttaagtcgaaaccgacttaaatgaggggaaagtcaggaggctgaaataacccttgttccggacgaggtaaatatcaaacagtttgggggacacgcaactcctcggcgcggcgccgctcgattcgttccagccctccaccacctccgctgctgctgctcatcccctcgcgatctccgctcttgattcccaactcgcgatctgcgcgcgatttcagtttagggctgattttgtttgccttttgtgaaggaacgagcaatctcgatcgatctcgatgtatatcaggtatgtatgtggcctacttcgatcgattttaggttaaagattgcattgcacgcttccgggattggtgggtggagtaaaacaattatgaatatgatgcttgggagaaacatatgcaatagagaaagatgcaaataatttgtaggatgcgtccaagggagtatatccattatacagctttgtgcttttcacttgaagctatttttacattcgaaagtatatctattatatacagctttgtggttttcacttaaagctattctattcttttagctatttgtttgcttctcctttaataatacatgtgaattcttccactggttcctcataagagagggagagagattcatgaccccctttgaattatttgcaaagaaaacaaataaggtttcgctagaatatatggaccaaaacaacaaatctgcaaaatgaatagcctagtgttagaaacataatctattcactacctgattttgtttaatagcagcaagaacaccacccttagattatgttttcatattttcacatgcagtgaggacgaattcaacaaactacgtgatgcttttgttgctgcatccaaacgccatatgaggccactcacgttgcctaaagagatggaagtactcaaagggaagcgtgatgtcaagatcgcgaaaatagcactgcacgcttatgctaagcaaaacaatattccggtatggagccacaaaaataatgatgatacattttggctagtcaacctcataaattactaattcagcggtattttgtaagtgttaggcgaaagttggcaaagtttgaatgttcgtttgtggattggaagttggaaatgcaatttacacatctggactgatctcatttatgttgcaggctgctgagttagaatttgtggaattgaaaggaagcagtttttttcatgaaggtaggaaagaataccgacactacaactttttggtgaaatgttcagatggcacaactactttgttctttgctgagacatgtccctgctgcaaagaggacagtggcatttacctgtgctgccctttggaagagaatgacaatggtagcatctatgcttttttgtgaaaacatggcaggataattatattctctttcgtcgtcttctttttttcttcatagacatgcactaatgccttctccttttccccctttttcaggtaaatgctttggttgccaaaagtgtggcgtggaacttaggcatcccacttttgctgactatttcggtggccatagggatatctgtattatattctcagatatagatgatgaagttgcatgtatatttaaggcatccaggatatctgtgctgcagaccgcttatatttaaggctgtgtttagtttacgccaaaattaaaagtttggttaaaattggaacgatgtgacggaaaagttggaagtttgtgtgtaggaaaattttgatgtgatgaaaaagttagaagtttgaagaaaaactttggatctaaacacggtctaaataaaggggctgcaactccacaggacttgggctgtgttcgccatttatggttgccagccggaacagtatccacggaaaacggagcggtccattaacgcgtgattaattaagtattactgtagctattttttttcaaaaatggattaatttgattttttaagcaactttcgtatagaaactttttacaaaaaacgcacccgtttaacagtttgaaaaacgtgttcgcggaaaacgagataggtgggttagaaaaaggggttgcgaacacacccttggtccattcattttatactcgttaaatttatgttatagtattatgtactagttctgttatggaggctatactgtgccatatgtgatgaacacagtaggggaccttatccacctgtatttttaagttcatagtaaaatgtccatgtgttgcaagtgcaaagagcgaatgtaattctaattacgggaatgtaaggggatggcattcgttccgagcggtggaactggaacctacgggatgtgactagctctccaccatgtatgagcgacaagggcgagccaccccctggcgtgcctcgtccgaccaattcgaccggatgcacccattcagtatctaaatagaatgttctctatctggtgatcatatgctacccttgcgcttcaaccaaacacctaaaaaaatgagtggacaacttctaccaaacacctaaaaaaaatgagcggacaactcctatcaagacaaatccgaagtttaaaacgggaagtctattaccatatgattaattaattaagtcttaattattacaaacttgacaatagatatatttgatattttaaaacaactgtatatataaaatttatacataaatcgtaccgttcagtagttgaaaaaacatgctaactaaagataaaatctgtatcttaccgagaaaggtaaaatctgtatcttaccaaaaggtgtagtaatcctgatcggatacacttgaaggaaacctactcaaatgtgggggaaaatcaggcaggaggctgaaataaatacttcttccgaggaaaatatccgtcactcctccgcccgattcgatcccctcctcgccctgccgttctccgtccaaagtgtaagcgaccgagccctagcactgcacgccctcgccgccacatccgctgctgctgctgctgatcccctcgcgccaacgcgattgcccgccccaaacgagttgttgatccccaactcgcccggagccgcggactatatctatctctgcattgcagactgccaacacttactgattgggtttttttttttcgttttgtgaaggaacaagcaatcttgatggatttgaactcggtgccgggcagcgattcggatacttctatcccaaaaattgatgatgacaggtatgtggcctccttcaattttagcttaaagattgcaggctctacgcagctgtgctcgctgtaacctggtccatgatgagattaaagaggcacccaattttgtttgttacacggaataggcgaactcacacaccctgacgagtttcatacccttagcaaacgttctaggctttctagcattcagattcttggaaaattccataatattaaaatattcaatagcttattgaagcgcgcactgtgcgtgcataaatatttgtacaggatttggatttgaaccacagtggctagagtaaaacactgaaagatggaaagactgtgcacgctccaaacatgtgaaaccataattattttagaactttgtggcattcgctgaaatctgatttttctttccctgcctttgtttgcttcttctttaatgatatatatgagtagttctactatttcctcgataaaaactaggaccataagcttccttgaattcctaaaaggaaaaaagttaaggtttttgctcgatgtgtaactagccaattcctccttagcttgaattccatctttcaattggtaagctaagccaagtttttattgtgtaccaaaacaacaaaatagttaaatgaacaggcctagtattagaaatataatctattcactgcatgctttagttgaagtaggagaatagcaagctataggaatgcttctgtttacatttatttatatccacttgcagtgggggagaatatgtgggattacagcccctggacaatcgtgattccactcgatcatcgccatataaaaatgaccaggaactggccgatgcttttattgctgcctgcgaacgctatgctaagcccttcgcagagaagtggcgattgcctgaagatttggaaaaacgcaaacgacaggatgaatgcaagatgttgaaaataccactacgcatgtatgccaagcaaaaaaatatgccggtatggaaccacgaaattaatggcgatatattttggttcgatcatcaatccaaaatttctaaatctgtcttgttctagaagtgttagttttgcctaggctaattgggcaaagttgaaaattttttttatgggttgggagttggaaatgatttacatatctggactaatatcattatgtttatttcagcctgccgagttagagattatggaactgaaagaatatactctttttgatgaacatgggaaagtatatgcacactacaactttgtggtgaaagattcagatggcactcttacattgttctttgctgaggtggatctcaactgtttctctcttttgtgaacacatgacatgataattttctttcgttggtttaaatatgtactaataactcttcttcttttcctttttaaagttcattgttttgggtgccaagtttgggagttggaacttaggcatcccacttgtgctcaatatttgggtggccacagtgatgtctgctttccatacgtaggtctagatgatgaatatgaatattttatgtaatggatctattattacaagttccttgatggtagtttcagcctttcagggaaaaaaaacacatgagacattcacatcccaagaccatcgctgccttttattttccatctgtttttcttttaagggattctactcgtagtggtcgtgctatgtgttgaaaacagacagatatgagatattaataccactaggagtatgagtgaatgaacttcaaaatcgataggtactgcctttgtccataaaaatcagcctatgttcagattcgaaatattaggatatgtcacatccagtattagcttagttttctatgaggtcgaagggagtagctggctgctacattgaccgacggcgcctgcctcaccaaggcggtggcaagggctgcagagcggaccacggtcgacagcgagacgtttatattgacgctcatttttatgatactaggtgattcctcacgcttcgctacgagaattctcaatatattttgttagtaaaacatcagggtttattagtacttatcatgaagtatatgttaaatattataaaaataatagatatatttgttaaaatattgtgcaaatgatgtgagtgtgggtattggatatgcttgcatattgatttatggaattaaaaaaaatgtagataatgttatatgcttacatgagattatatatatatatatatatatatatatatatatatatatatatatatatatatatatatatatatatatatatatatatagctaatagatgatgatgtggcatggttgcatgttgagatttagaattagtgggctgtaactttatagaaagtatagatatcggttcagtgatccagtgactcagttttaagatgtactggcaaaaatgctcatgcgttgcaacaggtaaaaataatttatctattttcattataatgatttttactattaacttgttagatcatagcaagctcaaatataataatagtataaattgactgaatatggtggtttttgcgtggggaagcgatgcgggtgagaaaaaaaatgtgtcctaagcgcactcagttgcgttcttgtgcacgcacgatgctttattaagttggactcggacgaccgcgttatcatgcacacatgacacgcctattttctagtagataaaaaaaaccagcctctacattaataagtggatatacactgttttcaaatgaaaaagttgtttttgacaacgcacccctaaaccacgtccaacgtgaatgatgataggatacactctaccgaagtacctacggagtactcttacatctaaaaagtataaaaccttttattttatcatcaaaattaaggaggaattaactcatccaccatttaacaaaaccaataaactatatgtatgcatgcaaccaatgaattatgatggcttctagggtttagattaacaattaatttagtacataaaaactacaaatatgatcaattttttttagaaaaaaatatgcttaacacttgtttgatgatgggagtacattttaaaaaggctgaaataatccttctccggacactaagaaaagattaggccattggggacattcgttcgtcggttttgttggagtttcaccaatcgtccggagagctaggcccaatacctagacaaccgaggcccagtatgcccttaccggccctccacctacactgctgcatctttttccttgggagcctctgcgcgtgctcttattcagacaaaaaaggaaaatccggcaaaatgatgaatgaagaaactaaccatacgaacgttaagtagtaatatacccatttctaatacatgatgtcgttgatttttgacacatgtttaatcatcatgttattcaaagaattatgtaattatcatttattttcttatgagttattttatgactaaaaactactttaagtatgatttatattttatgtatttgcgcaaaaaaaattaataagacaaatggagtggtcaaaggtatgttcaaaattccacgacgtcatctattgaaaaacaataggagtatttatatagttcatggatttttttcccaatcattgtttgttctcaaattaatgaattacagagtctacggtctaattcccgtggatcggtaatttcggtgcctcaacgtggctggccacggtcatttctttcttttgctagaaaatgaattaattacaccatttacactctttcatctcaacatgctgttcctagctattacggtatcaaaatagaaaaatagatgagtttccttactaatatagcgtagatcgtagaaaaaggcttaaatatgacgcaatcaaagtagaaatagatatgggtccaactgtctgaggctagctagcgaaggtgttctgtcacgattccctgttattatcaaatcaggtcatagctaggtccacggtacaatgctttactatgacgctttatactagttttgtgtgcctgtttgcaacaattttctctccaaaatttataaacacgacgatggtagatgtgtttcgtcgtacacgtacacattgatcccgtatgctatttatacattgattgtcttcacacgaaaagaaagaaagaaattaattcaaaagattttgatatcgatgatgttcttgccttcttggccctggatttggacccctccgaaaaattgaagtagatcgatcaaattgcaacgtgatcgcatcccgagcttgccattgccataggaggccttaattggtcagcaaacaactaggcctattctactttgttggattattaccgtagattatttagcccattttttcaaaatatattttctctaaaaaaagttgtttcaaatgtgttgtttagaccaattattctaacctatttattgagtttatttttaaatacttaatttatctatattatcagatagatattagttgtaataatctatggattatactccctgcggttctattataagtttttctttaccttttttctggttaattttttaatctaaccaaatttatagaaaaatttatcaacatctaaaacaccaaattaatttcatgaaatctagcattgaatatattttcataatatatttgttttatattgaaaatgtattattaatttgattaaaaaattaaaacaacttataacaagaatcagagtgactggtatcttttttaaatcggccatacatatagtagcagtagatgctgctgatagtcaatatattccttccatcccatctctccccttctactacagcgaatcaggcatttaacaaagaaactcactgtctcaccaacccacaccacccacgggcccacaccccagatcacagctcacaactgatccgatttatattcgttatgccttaatgcattgttgacgaccctacgctcttgtcattgtgtgacctgtgctcggcaaaatgcgtacatgcagccggtcagaaacttatgataaaaagacagggacagacagagacgctagctctactcaacgccaagattacggtatcgcatcacttcagtatagtatagtgctgacagctagcgatcgaccatactgcatgaacacatagtatattgcaagctaagcacacaaaagcactgtcagtattataattactcggtactacgctttgctttaacaatcgttttattaggatcttaccgaacctgatgactatgcgtctaagccattgcgtttcacggcccccatttaacaaagacggatgagacataaaggcaggggagaaaggaccagggggattcaacgaacagatgaattaataggagttcataggctggggttcatcagatttaacaggagtgtgtaggcttcgccctgaatgtgaccaccatgcacgagcccctgtcgacacttgttgtaagccagcacgacgattctttgctttgcagattgatcacaagaaagaagtgatcattatacaaagagtgccatcatcttaaagttttgttgtacctggagatagtggcaatgtggcatcaatagccactcagcctacctcttttgtaatcaggatcttcagatggcaaaccacatcctcctcggctgtgtgttcgctcgacaggtctggcactgtgtgctgtcacctcctggttaggcttaccctctctcccccctgacagctggcttcaggtctggtgtacatcttctagggcctgcttacctgagcatattcgcgccggcttcgactccttggtcctcctggtctcttagcagttgtggaaggaacataacttcagggtttttgactctgcgctctcttcggtctcagttgttatggtgtccatcctctcggagggtcatctatggtttttagctagcattgttatttttggcgtttcttgggaatgtagtatggctctgctcccttcgtgctaatcggagttacgtttagccacagtagtagtttttctctttttctagctgcaatttttgttttgctttttctctcttcccctggcaaaagcctgtctggctaattacattgtggaacaactattttccttctattgacgtgcaatctttttgcatgttcgtgaaaaaggatagtgcatgtatttttttttttattatcgttttctgtatgattgaaaaccacatgatggggaaaatgaaggaattataggattgtgcatgcaaaagatatcatgtattataaacgttggaagaaaggagggttttgatatagctaatttgctcaagtttttgctatttaattggattcggagccatgtagcttagacttctgaaaggaagagaaaagaggtacgggcaaatagttaaatagcttattgacttgtgataattattcaacagtacaaataaatgagttaattataaagttcaaaacggatttaaaaccatttcttaagaaattcatataaagttttcacagaattgtaaagtttaggagctcaagaagcatgtgtaattgcattcatccattcattcgttaagcagaagagaaatcctgtgtaggaaaaaaattacactatttttcctttgctcgatcgtcctcccatacagggttgtatcaaaatttcccaaggacaaatagtagcgtatcgtaagcaacacaaataattctcacttttcctgaaagaaatactgtaccaagaaaagttggcagatgactgtacaggactcaatgagagattgtcgaaaacagttttgcaaaggtgttgtctcatccagagtgtgtttccatgatcagccaagctacagcatactttaaagtcgaaacctcgatccaggcaggcatgatgccccgctcacaatcgaatccaatgatacacaaagaagccccttttcttctgggacaagaatttatcgagtggtgcatggggacgagatggtcataatttagagagacttatcaattgatgaagggcagacagctatgatgttgtctactactatctgctacatgctcacagattatgcctggcctagattttcatgtagtatgatgtgattcttctaacaaaaatattttggaggtacccattataaatctagggtctgaaatctctacaaaagaactaaagaaattccttcttacaagaacaatattggagtggacggccacaacttgatttcctaagtacacccaactttgattggcaaagatagggaatatctcatgtagctgtaggagtagtttgcaggtacagtacaatgccacccaaccaaccaaagtaatatcttaatcaaatcaccaccaacatcagtacagtctttccctctcttaatataaaaccagcggtagatggcttaggtttcaaaaagaaaaaaaatcaccaccaacacacacctcaatactgcatcgcattgagctaacatattattgctactattcagtaggagaaatctgatggctgatttggtccccaaagtaggagttaataattaattaattaacggatttggttactactatttggtttggtggcgtacgtgaggccaaccaaaccggagggaaggtgatgacaaaaaggctccggtgatccgtcaggccaccgctgtctccgtgtcctgcatcacacctcacaaacacacgatccatgtcacaacagcagccttccgtggaacgcaagggtagtaggagtactgtattatttagggttaagtccctacactaacctaagccctgttggaatagtggatgggagtcgctgacaggtggggtccaggttgccttttgaatcggattccaggtgtaaagcgaggatagaaaactgcaggatttggcccaccagatagatcccatctaaaccactaactcctgtctgagagctgaaataagtaatgcatcttgcaaaaattagctgtatatcaaacaaactgatcttggaagagcatattttcttagcatactgttacttttttactcctacctgattgtttaacttgtagacttatctggaatattgttaagcacaaggcagagtacacaacactacactgtgtatagaacgtgtaggcagaaacagatattgcaagttctttttttccttaaaactagtgctctctgaaaatcggaggtgaggtatagcatctctctctcggatggacaggtaacaaactatcaatcgcccctgcagattgtcgctgggcaattaaagtctgtgtcgtattgggcatctagcaaagtagcactcaatcgccatctcaatatttgacatgtaacacgcgctcctctttttggcttttcctcagcaagggccttagaaacaaaaatgtcaatattatccaaagttttaaatctctggctatagctgccgctatagccggagatagctgctgggaacggacggagctaaaagatgcatttttagcgctaaaaatagcgggacgctaatagcgccatttagccggcaatagccgctaaactggccgtaatttagcgtagctaaattgtaaaacacggccggtctggcccaagaggaaaccggcccaactagaccagagtcgagaggtgggtaaagtgctgcaaaccctagctcgtaagctcccagcagcacactatccattccaacttcgaagcgctcactctccagctgcaagaaaagtggaggtggccggcggcggcggcgcaaaggcgtccggcggcggcggtggcttcaagcggatcgaccaacgcaggtggctcgtggaggcgaccggcgccggctgctgcttcgagcgggcgtccaaccagcggcggcggctttgaaggcagctgagcagcggcgcaagtccgacgaggaggtccgtcagtgcaacgtctccgaagcactgaagcagcagcaccaaaggtgacggcatggcacaacaatccggtcagttctcacatcctcctctcttttttgcttgtatgttgcagatcttacaatatgtgaacaagttgtccatatttgttacctctaatttcagatacttgccttatgatgtagatcttactatatgtgaattattttcttactccctgagatctctcgtttgcttgtttcgcctgtttaggtggtaatgataatacgtgctatatcagtttgcattattttgatgcttaggcagctttgacgctagcattaatgtgggctaagtttgctttttgtataggtaatccgtccagtgctgcctctgtctcagtagaagctggaccaaaacaagctggtatcaactcagatgatcctgcatgggctcactgtttctgcccagacataaccaagaaacatcacctacggtgcaagtattgtgacaaggtctgcactgctggaattacaagaattaagtaccatcttgctggaattaaaggtttcaatactactaagtgtcagaaagttccaagtccagtgcagcaagagatgtttgatttgcttaccaagaagactagtaaaaaggaacagaaaaacaaagaaaaggaagtggccagagctgaagttgacatagaaaattcagattgtgaaagtggcagtgaaggttcagatcatggcaataatgttcttgtggtgaagccaaaggagacaacaggatctagtagctctagatctgtagcaggtggtcatactattgacaagtactacaagcctccttctatagaagaatctgccagtatgacacaaagagtaattaagctaagcaataaggttcaaacagcattgacaactcagaaaagagaagaggaggaatagaacttgtgagtacatatgtcagtggttctatgaagctagtattccacacaacacagtaacccttcctagctttgctcatatgttagaggccattggacaatttggtagaagtctgaaagggcctagtccctatgagatgagtggatcgttcttacagaaaaggaaggaaaaggtgatggatggattcaaggagcacaaggaatcatgggagctcacaggttgttctatcatgacagatgcatggacagataggaagggtaggggagtgatgaatttagttgtgcatagtgctcatggggtactcttcttagattcagtggaatgctcaggtgacaggaaagatggcaaatatatctttgaacttgtggacaggtacatagaagagataggggaacaacatgttgtccaagtggtgactgataatgctagcgtcaacacaactgcagcaagtctattgacagcaaaaagaccatcaatattttggaatggatgtgctgctcattgcttggatctcatgctcgaggatattgggaagcttggaccagttgaggaaaccattgctaatgcaagacaagtgactgttttcttgtatgctcatactagggtgttggatttgatgagaaagtttcttaacagagacttggttcgctctggggttacacgatttgccacagcttatttgaatctaaaaagcttgttagacaacaaaaaaagagttagtaagactatttaaatcagatgagatggagcaattgggttacttgaagcaggccaaggggaagaaagccagcaaagtgatcagatctgaaaccttttggaaaaatgttgacattgcagttaattactttgagccattggctaacgtgttgagaagaatggacagcgatgtaccatcaatgggattcttccatggtttaatgcttgaggcgaagaaagaaatttctcagagattcgataatgataagagccgcttcatagaagtttgggatatcattgataaaagatgggacaacaagctcaagactccactacacctggctgggtactatttgaacccctactactactacccaaataagcaagagatcgagagtgatggatcatttagagcaggtgtgatttcctgtattgataagttggttgatgatgaagatatccaagacaaaataattgaagaactcaacttgtatcaagatcagcatgggagttttggacacgaaattgccgtaaggcagcgaaagaacaaaaatttcaatccaggttcagatctcaacatgtgaacttaattttattgctgaatatcatttttgttgtaatttgtgtaatgtttatgcaacaaaatggtggctgaaccatggcacaagcacaccaaatcttaggaagttggctgcaaggattttgagtttgacctgcagctcctcagcttgtgagaggaactggtcagtttttgaacaggtaaaaagaaatttgtgacctgtagctttatgtgcatgctgtctattttgaattataatgcttatttatggaatttagatctgacctgcagctttgtgttcactacttggcttataggttcatacaaagaagcgcaacaggctacttcatgaaaggatgcgagatctggtgtttgttaaatttaactccaagttaagaaataagagagagaacaagggtagagatcctatagagaaggaagtggatgatgttgtggcagatggtgacaatgaattcattactggtgttgtgccttcatcaagtgaaatggatcaacaatgtgcaaaagagtcagcaccagctaaaaggaaaaggcctgtgcacgctaagaagaggaaagtcagaagcctacagtctttgatgcgcaatgccccagtgcatcttgaagctccatcatccgactcagaagattgtgatgatggtattccaatgcagacttctgattctgataagtcaccctctccctctccctatgtctctgagaccgatgattgatgactagaagaaatgaagattgcaatattgcctcatattagtaatttagtatccactatccagaattcttgatgacctttgtgttgtactgttgtctttattccagaatgttgtacttttgtgaaactgatgtttcagtattctgttaaccacttagcttgtgatgtaatgtactcctatgaacctgtaatgtactcatttgaactggttatgtatcaattggtaatggttatgaagttatgccaagatcatgtcttttatttatttatttatttgcaaaaacagctaaatggcttagctgcagctatctccagctatagctgtgcttagctgttgagaaggtcagcagctaagaggcttagccggagatttaaaactttgatattatctcaaaccaatttatttatttatttttcttttcaaaggaaagatttctattgcctagtattacacgattccatccatggtagtggtgtcaatctttttcatcggtgtgcccccacaggattcattgtactactacttaccattagtccattattattaccacagggattaaccacacagccattaatcagagttaggtccagcaattgtaacttgcttgcagctattgtctactgccactttttctgcactggaaagcggtggcgcacttgccgaaagtccattctacttgagaaatggcatgtggtgggctgctgtggtgccgtagctagcgtgctgcgctcattccacaaagcaaagcaaagcgaaggaaaacaaagggaagagaagactgaagaagaagagagggagagtaaagctgatagcctgatactgaccaggaattggattaggctagctaacagcgcaagaaaagcctccgattcctttcgtcgtcgccggattgccgaaaggatggacagctcaaggttgcaggtcccaacgcctgttcacatggtcaagaacatgttctgagtaatctgttggctcttcttgtatgtgacttgctgagtgagagagaggagaggaggggagaaagagaaggccggttgctggagcttctcttcatgatctctgcattcccaggtaggttttgcatgaagccctgctcttggatgtgcttcttgttggttttgtactgttaggctgttttgtctctgctttgtttggaacccttgaaagtttggagttctgttttaatccatgaagtggggagtttgatgagctcccatgcttgcgaaaggggggaaacttatgaaatattatgcaactaattgtttggattagttggattggttgtacagaaatttaactgaaactttcggtttcttttttcttttttgacatcaggtttctctttaccatggttctgtattgattattcagtcaagcattcaggggttctccctagtccttaccatgttttcttttaattaattggattggtttaacagcttgtacaaacgattagcttttttaatataagaaaaacaagaacagtacattgataccttggatggcaggtttccatggccagccatctcccttatgctgctgaacaaagcacagttcttctgttttggcttctccagagatatttgccattttccatcaatatatgtccggttgctgatcttgatctgcatgcagtgtttctgaaatccggctagcggtgaactccctgatgaactgaacaatcaatagaagatacaagaaaagttatttccactacagaaagaacgctgattatctgaaatgggaaggcgaagccacaagcggtccactgaacaagaggaaaacaatgtaggctgcgtgtggggcctcatgcgcatgctttatttccggcgtgatgcaaaattcttattggatacaaagcaagtgagcaggaggcatacgttccgggagctggcaggtaatttcttcagtaatcatagttgctatgaagttgtagtttcttatagcagtacggaaaaagctacgtgttttgcttcaagtttctattacttcaaaaaatgctgtcatttgacccaatgctcactatcttttcaataaaaacaagaaaaaaaatgctaatgttatcaaaattttgtttgcgtgtacttggttattcttgctggcttcattacttaattcaggagcctgtgcagcgtaattttctcattctctgcatcacttngtgaagtcatataagacctatcagtgcatctgatttacagtccagaattaatcaatggtgattgctacgatagttcaactgagtaacgcataaattttctatccaatttttatgctgttggatgattattctgatgatgtacgctgtattttcagacggaaggcattcagttaagaattccagtgattttgtggaaacagatgatgatgatgatgtaagttacaagaactaagcaagtaactgtctcatgatctgttgttgttttaaccataaacaccaaaatcatctttgttatcaatagcaacactgacacaatttggtattggacagcatcttgttacaaagcaactcaatggctagtttgtattacaaccaaatcattgttttcagtatactggattatgcgtgcatctgaaagtcgcaactttcctaaacatcattttacttttcttcttttcagaacaaagaagaatgcgcttcacagaaacgaacagtcaaaaaacttatggaggacgaattggggaaagtaaatcttttgaaaaaaattccaagcaatgagattcaaagaggattacctgacttgggatatgatgtctccctagatggaggctcagagcatacaaataaaccagtggcagccttaaatcagcacacggacatcttcgcgtcttatttatcgggatcagtgtattctcagggttccaagagcttgaatcattctgaagaatatgatcttgaatctgtcttggcaaattttttaggtgaaatttataggtgccatggtgaatgcccgcatggtgattgcaagaataagggtgaattgtgtccttcactgaagtccttaatccataacaagctcaatgatttaaataatccccatgccactcatggtaatgagcaatctccagagagcaagggagaagggctactgggtgagaatagtcgttctaacagcagggcagctcaattcaaagaattcaaggatgcggtagaaatactgagttcaaacaatgaacttttcctgaagctgcttcagaagccaaattcacatatattagacaatatccgaaaataccaaaatagcaggttaacaaccaagttagaacctgacaaaagtcttggacggtctagtattcttgaagagaaaaggggctcaaatcatgagttggctacaaaagcacagggtaaagagaccaagcatgtgttcttctggagaaaggataggtcagatagaaagcaaaagccagaaagagccaatagaccccagcctgttagcaaaatagttatactaaagccaaatcaaggaagacggattgatgagacagagactacaagttcaagatatttacatcagcaaccatgtacatcgcaagctccagaattcagtggaagggaaagctcaaaattttcaatcaaggaagtcaggaggagattcaaaattgtgactggtgacagcaaaagagagaaaaatgcaatacctgcagagaaccttccaggagattcacatcagctcaaagattctgtcgttgaagataaggatcctagacatctcactgaagggagcttgccagacaaagctgcatcaaattttaagaatggaatcaaaccttcagccagcagtaagcaaaagcaacaaaatgacagccagagtgaaatcagtgatcatacaacaggagcatctatcttctatgagaaagccaagaagcatttagcagatatgctaaagaacactagtcaatctgccagctatccgacagcccaagtatcaaaatctttggaaggaatgctttctcaacctcattacaacgtgtcacctcctaggagtgaccataggggaaaatgccacaatgccttctcacctgaagagccagaagtttgtcttgtaaaagctgttgatgtagaagaaccagcccaagagagaagccaactgcatgataactcagagagcaatgcatatagtactagtgtagcagttgatgatcaggtggcggttctagaagaatgtggcatcaaagaagacacccaagaaggtaactttagtattcacaattatcatcagagtggtctgcgtagtgctcttttgttctttaaatagaaataactctgaatattgagcaggtatcatatatgctactgatgaggtagacaccgtgcctgttgaaggagttggcaaattggattgttccaaaacaatttgcaacatacagtgcatcccagcagaacaatacacagacagccccttgccagtaagctcaaatgaatgcctagccttattccatcttttgttagtgtattttaagatgtacatgttcatacttctatttataggaaatattagaaggaactgaaggaaaagaacctgttcaaatgttcatgagctctcctgagagcatggttgaaaatttggagcaacaagatccaaaaacacctgaaccaaaatcatcaccaaaattaccagatggttgtcctgagcaaagcaatgagaagaaagaacagccaagtcctgtatcggttcttgattcattcgatgaagatgacagctctcctgaatgcaaaacaatgaaaaaatgtaagtccaattaatacaattgtttgcaagaacaatggtttaaattagtttatcttctttccctgcacagataaaaaatattatgtactctagtatctgtattactcaccattttatgacatacagatgagctgcacgaagtttcctgtgggaccctgtacttcccagataatgaatcaggtgtaaaggtcttttgggaggataagaatgccaggttagattatataatgctggtgctagagctctcagaattatgtgcagagcaaaatttagaggtgtggtatctagaggatgaattaatcagcccttgcatgttcgaagaactacagaatcaaggggaccgaatagatgatatgaagattttgtttgattgcatctgtgaagcactaacagagatccaagagagatattttagactctcttcttggttatcttttgtcaaacatgacatacggacacctccggtaggagaaaaactcatctcagaagttgacaaatatgttgatggttatctcaagtgtagtttcccaagtacattggaacagataattaaaagggatttggaggttcaggcatggatggacattagatcaaagacagaaggaattgtcgtggagatatgggagtttgtgttagatgaattgatagatgaggcggtttttgatttgtggatttgaagttctgatcagatcccttatcagtgttgctttgtgacgagtataggcagtatgtagatgaactgtagaggttttgattttgatgctgacaataacccattttatgcggaagaataacaagggcactatgttctggcggcccaaggaaagtatcatgtgattggggagacatttactggtccaaatgtctgactggagtggacagtttcttgtgaatgacagctgaagttacaatgctgtgaatatctgacttgttcagtttgtttggatgaaattggccagtctgtaacagccatgcctctaggcacccaggcatacagcagtccgaatttttctcttgtccattgtgtgcatgtttgtgaaccttaccccgatacgcttgtcaacaaagagggctagatcacttcaatgtacatgtttgtatttgtaagtacatgtgtaaaaggctttctaaacaaatcacacaatatacatttccactgaggttttttcttttcctgaacaacactcagtaagcttacagttttcatgcattcagttatttgaattatgcttcaaaatacatgtaaacctccaagaagcatgagcatgccaaatccaaacagcacaaataacagaatcacttgcgcgctaaatttgtgcaactgaaaggatgagaaataagcatccctactaaatcaattgccaacatgcacaccaaccggtaaaacaagtagatccaaaatccaactcctaatgtgagtgaaagtgcaaactacattagttgcaacgcggctcagctgtcaaaaccacccaatccagaagttccgggaggcgggagcttgggattaaccagttcactacacaccacccaagcactcggcagtcggcacaggacgcagttcatccgttgttcaaaattccagacaccgtgagatccccatgtatgccgcattgggtttaaactgcccccaaacccaacaacccagcaaaaaataaaataaaataaaatgaagcgattcaaattattcctacaaaatggaccaatcggtgcttaattcgaaaaaattgataatttgacactttcttcgttgtccaattactttaattgacatttgtgaggataatatatgggaccatctgagtgaatgaaagtgggctaggatgtcaaataatagaaacccattgaaaagagtgttaaattatcaaatctctcgcgtaattcacccaaattttacgcattcgaacggcaaatcggtcactccaaacaccaatccctccctccaatcggcacgtacgagggcagccgcagctactactcccaaatgccgctgccgattttcgacatccccaaccgaataaaccccgaaaagagaacgcggattcattgggattttggggatcgatccactcacctagtcggctggtctgcagctggaggctggagcggactcctctcctcggtgggcgacgagacgaacacgatcctctcactttgtccgccatggttggttcgtcgagagcgcgagaacgaaaatggtggagcgaaaaaatggcggagaagaggttaataattaataaagctggcggattctgcggcaagatgggcctaaaccactagccctgccggatatttatgggcttgtgaggatgggctactgggcctattttattttcagtctgctgcaagatgggcctaaaccactagtcactggacctctcgcgttcgcagttgtgcttgtgcaaaacagcaacaggcttttcttcttcttcttcttttcttaaaaaaaaaactgcagttaacaaggtactccctccattccagaatatatgaagttttatagttagacacggttattaagaaattaggtagaattaaatggtggagggttgtgattgaatgagtaatggaggtatgtgggaaaagtgaatggtggaaggttgtgattggttgggaatagaatgttggtggataagttgttatattttgggacaaacccagagggctaaaagttgttatattttaggaaggatggagtaagagtctgagagatttgaaatgtccctagcaaaaaaaaatgtcctaagagattaaaagtatgggcacttcaaattattttgatcattatgtaatctattcaacaaattcacaaggagttagcaaagatgaaagatataaggatatattagattaccaaagtcgaaagaaaagggagttagcatgttgcactttaaataaaaaaattgacgatgttgagctctttttatatatagagagagcacattacaaatgtgtaatgagggatgcaattccactctcatatgcgccacgtgaaagttgccatcatgacatacttatcatatctaatgggacgattgtcaaggtgagtcatcaaccttagaaatgttttaacatgaacggtgcgcttgatgacggagaagcttggcttagcatgatgagagggtgtcaatatgagtcaccggtagaggatatggcaaacgtgaacgatgcatatgacgtcagagcaacatatatgatagcaggcgacaatacatgcttagcactagcaacaacaataaatacacccctccttggtcccttgaggtatctatcttcctctctctctctctcactgtcactccatcttctattcgctattcatctcaaatttctcgcatcagttcctctttctctcctctggtacatcgtcaaagcctcttccaccaagatgtctgactaaaaggtatagtttttcaagccctctactccgtaattgaaccgaaatagattggagatctatccgaactcatattggtttctcttagaggagacaggcttttgcttttaatctaatttctcaagtttgttgcattgatccatctagtttgttattgatgctgttaagattcatatgaacttggattggtttatctttttttatggatttttccttttctccatgttatttttaccctggcaatcgctaatctttaagcttgtttccaatggtgttgagatctatccaaaatagtattgatttcttgttttgacggttgacttttcgcttacttcctactactttcttattgagttggttcctatagatctataatcttggtttggtgtgtacgctataaagatccccacaaacttggattagtttatctattgataacaagcatttcactttctcacatctatttacaacacggttgctccaatctatctagattgttgtgtgtgctatagagacccacatgaattgaaactagtttgttgtgcgtgctacggagatccatgtgaattcaaacgggcctctctctcgttgcgtgatagactcttcatttttctcaatatctctacgccaactattatactttactaattggtttttagcccaaagcccctaatacaaccaaataaagaaaccaagaaaccaaaaccaagacgtgtaaaggggccattttttgtcaaataaataacccaaaaagaaaccaatttaaaatcaattatcacaatttcaaagagattggatttttgtttctctccactccaatacctctctccatctcccttgtgcgttttccgatcggcagtgccggaggcacacgcccccgcccttctctgtctccgccgccgccgccgccttcgccgccggcgagtaggcccggagtcacggcgagaaaaccggctcgccctctccttcccgcccgcgccgcccgcccgcccgccctagccgcctcctccccaccctgtgcggcctcgtcgcgcgcgccgccggcgaacaggttcggagggggcggcgcggcgcggcgcgggcctcggctcgaatcggattcaaggtcattctcctcctcctcctcctccttccttcctcttcgcccgcaacgcttccatgaggcgggcgtggatggaatggagatcaatccgacatggattgatttcttcgccctccattccaaacacagcacatgcagttctcttcccccggattgcttcgatgcttggagttactaataccaatttgtttttattttcttttaataaaaatgggagttcagttgggacaggcatggcctgcgttagctctgtcgccatggctgggccagtgttgtggtgattgcgagggaagatgcaaaggtacacgggcgctgggcacaatgctgggtttggcggcggcgtgccaggcaggggggtggtggcaggagggagggagaagggcaggctggagcctttttcgttccatggtgccaattaccccgcgaacttgaggtggttgctgtttttcttcccctctcaagttgtcttgtttccaatgcattcggctttgtagactgtgatatttgctgatagtgattgctgtgaagttattaactcgttacggtagaagaaacgatgatgtgacgataatgtggcaacgttagcaaccagtaggtgaccacggcaatggtactgtgatttgtcgttactcgtgatgacctaaccttgaagaaagccatctcatatcaagaagacaagaacttcatactgatatttttttaagtatattattcagtaatactttggccactgccatgtagtctgttacaaaaccttgttcttacagaagttaaaaggaacatctcaaaatataaaaaggaattcagaaaaacaatagcaaacttttggaccattgttgttgcttcaaaagtcttgccagtgttcatcctggtgaatttattgactgttcagtgtttggtcagtttaacagctcaactgttggtttaatgaaaagatggaaaaatgatacttgattgttatttggtagaaacagtcacaattttcctggtatgaataagtagttaattcaagctcattgtcccagtttcgaaacccatgttgcatgtaaaccctttgatgtgatttgtgaagtagtcggtccaattgattccttcaatacagtggtggatccagaaattttcttgagcctgagcatgcttaggctgtgtttgagatgacatctatgatgagattatggtccacatgcaaaacgagacgagtgattagggtatggttaattaggtattaattatccatagttttaaaaaaatataacaaagcagaagagagatagtgacctctgacaataatctatcagcatcaggagtccaataacatgttctgcttgtttgccatttttttctacctgtcttaaactagtgcacaattaaaagcctgctttggtgctcaaatagtcgtgcaggacaccatactaactacaaactgcaccgtatagaagcatgacgcctggtgccgtttgttgcccgggagcaaatgccattggctagcagaggaacagcaccgaagtccattgcggcaaagactgggagcccgggcagctgcccatgctggctgggccctgaatccgccgctgcttcaatatatcatgaaactagctcatcgaattgtattttcaccagttcagagttgcttacttgcttcgattatcttgtgtccaacttggatgagtcactgtctgctgatcaggtccatttttaaaattatggcactagagatggttgtgttctgaacaaaaattcaatcaaaatcagtcgcagtctactctagtgggatttgtcctttgaatcagatggacatttttttaattcaaaaactagatgaatatcataaaaattgcctttttaatttttatggtgtgatatcatttgaaaacgtatcactgttagttatggtaaatgaaagagaaaacattttgttctttagtaggtcaaacaatcttcactgtacagtgctcttttttatggttgttactccctccatcacattttgatcatcctctaagtaaatgacaccaagaccaaagacaccaaaatattcatcattctcaaattaatcctcatcgattaaagtgtttcatcgcttcgtgtcccgtggattgctcatgttttaaatattgcatgccattgcaccaatagaaattaatcttggttggttgcatgtaacacattcaacgatgcacatgtactctttgcacaaataaacaaaaagacacttgttagatgatgatcattttaggaagacttcaaaaactttaggaaatgatcaaaatgggatggagggagtactttttaccttattctggctgatggaggcttcttactagcagtttgagaggtcggcaaacggaacagacaaaaaacctgtttgcataatgtaactatcagcttatacctattgatcaatagataatgctttttccatgagggtaactccccacgttccattatcaaagataacaaacacaagatcctgttacatcactctggcacatctctcctgcccttgctaagcaatatggttgaaccaagtaactgacgggtagtttataggatggttgttcttatggggacttcaaatgcatttagattggcatggatgacaagattgtattcttcttattttccagctgaagatgggaagattatttgttagtggcgggtaaactacaattgcaccagctgagaatgtaaccatggccaatgctgtactgtgacatctcacatggataatattttattgctggaatattttttttgagaaaattgctagaatattgattctaggaaacagctatcgccaacaccgtcgaatagttctgtttgcatcaattttgctttaaaatctcagcaagaaattataggagaacattagctctttccttttttattttctctctttcaggaagaatgggggtattagttgtaggagtagcactttcaaatgtatgatcttccacatttaatttttttcaaaggacttttctacattttgttcagactaaggttctacctatgtttgttaagacattaacttagtgctgactgatgagcatatgaacctcctaatatgcttatgattctatttttcaggcggcaaccactggtagctccttacaagctgaagtgtgacaaggaatcactcaatgccaggcatgttttactcaacaactgatttgttcctattgtcttattgactatgtacataaatgttttccattttctcatatctagcttttctattcttcaatattcttacttttttttcatttgcatggagaagttgcatatttgtattcgaaaacaactaaaagttagtgtttcctttgtactatggattttgtaggcttggtgcacctgacttctatccccagacattgagttgtgcagaagagaccttaaccaaagaatatgtgcaatctgggtacaaggataccgttgaaggaattgaggtgtgctccagaaaccaaaagtttcaaatcctatcccttttttgtgacactgcttatctagggttaatcttgtttcatatattgtttgtctcattttcacgagtctcatgccattaaaatcttgagtccataattttgtgtacattaggaccgcaatttctttgttttgttttgactgaaatttgttcctggtggtgtttttacaggaagccagagagattgtactcagtcagattccatacttgagcaaaccagatattgctacaaaatgcaaggaggtaaaaaggcaaccaacatcaacctaactagctttatttttcatgcaatcttatgttgttagaacatttcttcctgtcagagtgaagtgagaagtaggttggtatgcggcatgattgaatgctgctggagatcaggaactaagatgggtagaattatgggaatcacatcttttatatataagctgagatatgcatcacagggggttaacagccaaaactctacagcctacttggtgctaattttggataattgccacctttggattgttactggctgcatagtctgtcagaaacttaggattaatattatgtgaatacgtagatccatatggaagatgctgaagaattgcttcttttccctaaggttgatggattgaactgaatggttgaatggattgaatctaatatttttcttccccctttgacctacccgattattgtgttttccttctctaactgatatgtcttgtgaaaaaacttatactttgactaacaattttattttttatttatcaaggcactaaagaagcggttcagagcgatcaatgaatctcgtgctcagaagaggaaggtattttgatttgttgtagttactatgattaggatctctgctgtaaataaggatattttttgttaaaccatttcacaacttcaaaatgtttgtattgaaaatttgacaaatggggacttaactgcattaattagatttttaccacctaattctagatagctagcatctatttacatttttcctgcaaaactttgatctttttaaagttaatattggtctaaaatattccaaatactctttcctaacaggctggccaagtttatggggtccctctttctggctcgttgctgacaaaacctgggatgtatccagagcaaatgcatagcaatgaagacacacgcagaaaatggatcgaggtcaatcaaattagcctgtcattttcatcttcttttcctgtaatgtaatatttcatttcatttatgcactttattgaataaagtgaggcaagtttgctacaattaagtgcggcgagtgtgccatccaaataacccttcatcttaagtagctatctttctgtatattatgagttcttgaaacatttcatactgtatcaaactgatgcatttcaaactggactcactatgtataaacgggagcactgtgccgtccatctcccctaatgtttcatttaagaaactacaaatttagggcgacattggtaccaactttttttttggtagaattgaagactaactgcaatataattagaaaacgattttctctaaagtcttttctttttttgtcttgccgatctgcgagggatctcattgcaaccttaatcttccacctgacttgaaatggctgtgtaattcattcctttgcaggcccttgtgcaaccaaacaggcgtctatggtcattagcagagcaagttcctcgtggttttcggaggaagttactctttaattatcttatccgatataatgtcccactgttaagagcatcatggcttgtgaaggttacttaccttaatcaggtccgttatttctgtgccaaactgccactgctcactagaatttagttctgttatttcatgcttattagaaaattatatgatgttcgcttgatgatgcctctttaattgcaggttcaaacatcatccaataatgtttcatctgctgctcctgatagtttgcgattctcagcactggacaaaggatgttattgaatacttgcagctgcttttggacgaattgtgttctaaaaatggcttttttggacttccatctctcaagaacagtcattgccatgccttgttgctggagacagcccaattaagttaaaaaccggggcatcacctgctagtgcagatgttgaggagccttcgctacactttaaatggtcgtatatgattcgtat

SEQ ID NO: 17556 - DNA, 770 bp, Oryza sativa
acaggtagcattgatgagaataacaaaaaggatatcttcagcagcccaggtccactgcatgaattattgtatgctggttggatcaacatgagattagtgatgcttcgggatttaaaagtgtggatgttttcatgactgaacttattcgcagtggtatattttatcctcagacatatgtgagacaactaattgttagtggaatcaccatttggaatgatagcttgtttgatctggaaaagaaaacgaggcattacaaaattctgaagcacctgccagggttttgcttatttaatatccttgaggaagctaagattgctgaagatcaagtcctttatgaaattgtgtcaacatattctagtgagcgtcgacttgtgctttctgagctttcaagtggtctggctactgatgcaaatgttgaaggcagggtccctttgagttcctgccttcagaaacagcctgatcttctaatggattcaacagatgataatcatggcagagtggcagttcaagtagaagaggtaaaacttatgatatcaggtctgttgaatttgggatactctacactcttggctgaatcaggaagagaagaaccaaaaaaaccaagaaaggacaaacagatttggtagactcagaagaagatgttgggcatgcaaaaactggctgtaaggatagtagtaggaccaagagacagaagttggataagaacgtgtttcctttccaagggtccccattggttcaatcagatgaggaagatttttggtgggtaagga

SEQ ID NO: 17557 - DNA, 822 bp, Oryza sativa
tattttggtatgtcagtcaataaaaaaaatgattggctcagtgtaacaccctgaaaattcgaccgacaaaatcaaaactctaaaaatgcagatattcaaaaaaaaaaacttttcaaactaattgcaacatgccgattttattcgcctattttacctggatttgatctcgaagaatattaatagtgagtaaagaacagttaatcaggaataaaccttaaaaacaaattggtaaaataaatataaattaaaaataaagattaggtgtggatagtaataaataaaatattatcgcgaccataattggatcaattaaatttaattgcgatggaataagaatttaccctaattaaaactcaaataaattatataaaaataaaatatgagtaatattaacctagggtgaattcattagttgagataatacacatattgagtaaacttcgtttatgcaagatttagaaataatagaatcaaattcatataggaaataacctaaaatcgggaataatagggaagtgcactattcattgcccgcaaggtgttcgatgtggtccctagcctttccccttctcccccacctctgccctagccgccccgagcccgcgcgtcgccgccttgcgccgctcgcccgccgcgccgccgtcgccatcgtcgccgtcggcctcgcgccccgtgccgccgcctcgagccccgtgccgttgcctcgcgcctcgcgccgccgttgccacgctgtcgccatcgccgtcgcgccgcgtcgtcccatcgccgcgcgcgtcccatcgtcgctccgagccgcgcgccgccgctgccgagccgttccca

SEQ ID NO: 17558 - DNA, 12748 bp, Oryza sativa
  unsure (1)..(12748): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccacacaccggaggttctcgatctcttcgagccggtgtgtgtccaaacacttccgctcgcggttccggaaaatccttccgaagctgtctccgcctgaaccggtacctcctcaacgacagccgtatgaaccggtacctcctccacagatggtggagttggagccgatccggaggcaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgcactgacgcactgtccgcgcctgacgggccgccggcgtgccgtgccgtgccgtgccgcgggccgtgccgtgccggcccgctacagtagccgtgccgtgccgtgccggcccgcgggctcggccagcggcccaagcacggcacggctactcgtgccgtgccggcacggcccgttactgtagcaggccgtgccgggccatgcctgctacaggttcggccatgccccgggccgcccgtttggcccggcccatttggccacctctaatggggccacgggggaggagagaggcaaaagcggcggcagagatctagatggaactatgggagtcgtgtctgtgtcatttctcgtgtggagccgagaggcaaaagtgtcctcgtcgcgctgcgccttgagccgagccggcaaacatccttctctctggcttctctgctgggaacgagtcgaactcgcgtgcgttcgatcagtcacttgtcaccagcgcccgcatttccgtcgcgatgactccacctccgcccctgctctggtcaacgactctcctcccctgacgtcactttgatccccttcacaagcctgagcaacccatgtgaaggacgacgcctcttggtgcatcgcctccaagccatcaactgcggccagtatactggaggtgatgaggagtctagaggacaggtttgtgttgatttcttccctcccttctttcttttgctcaggtgaaaaagaaaaatcccctttatttatactccattaggtttgttttgcttccgttactggcgcactgagacatgagcttttgattctttctagcacctacttttggttcgactggatgacgcaattagccaaacaatagcaatggcagggatgcaagccatgacagccacgcatggaggcaagcctatacatcccaatctcttttatatcatcttatatgtctgttagggtgtacgttagattcaccatgaaagaatgtactagttacaccatgaatcagaaaattaatgtttggcgtttgtttgttaatggctatgcaggtttaatggactaatgatatttgtattagaattattcaaaagagtaaatctcttggtggtaaattcaggctagttgcaatgtactgcttctaacctctaaggctctaataatattttttcccagttccaccttaactgttgcatatttacttacttaggttcttatcctgaatggatgttttggttttcagggagcaacatctgttcctcctacgattggatcttcaaaaagaattgttaggagagtaaatactcagacctttctcagctttaatttgtaatggtctaaatactcaatttgctgtttttttgttcctctgtttcatattgcaggctatttcattgctgccgcccactactcttccagctctgccgacaaccacacctacaagagctacagctgaagcaacacatagggcagaggaggcatcacaggtctggcttggatttagtttgatgttgcactttgtatagctatatgcaggttcactgattttttatatcgttcaaacatctaattcagcttttgtactaaatgtacctcacattctgaataattatgcaaaattgtaaagacgttaaatttgtctacttccgcttcagccattacaggttgaggcaaaatctgttttgttgatagctaatatggttgctcaattagtcccaacaagtagttttcatattcatatgaataactccacttcgcaatatttttaattaaaatgccaaaatctattctatcatactgatgttacgtttacatttcaattggcggttgtccccaacctcatcaatttgtcggttgtcacatccaaataggtaaattcttttctctgcaggacaccaaggccccaagcctcaggttctgtaaatgatcctgattggggtgaccagtagaagtgaggattgtgcaactgttattcaatttgtgtaactgtgttaggcgttcccgtcctgctttgagcaaagccatcctaatttatatcatgtttctcttgattggtcgcaggtttggaattatgatgagcatgtgcatgatgatttgcaggtgattccgagcatatcacgcgcacctagcaaagtgtcggtactgattacatatttgatttttttaaaaccaattggatacattcttctctgctagatcacctcatcggtgagatgtacgtgcagttccaatttgctctgctattacactttgtttcaaaatagctataggttttgcaggtctgtttgaatagatttggaataccacaacgcctacctctaaaaacacaataaaattactgttcactttggaatcttaaggtgcagaacaaaggtttttaactgcaatacaaattttgtgcaattccaaatgttttccttgacgtactaggtgagatttttaatcacggtggcctaattgatatatgtatttgagactggcaaggatgtggaaagcaagcattcatgcaactatctgggcttgtccaattaaatcaaaatgatttcttgctattccatttaattaatgttgaagtcacgtgaaagttctcttagattatgggtgtgttcggttgagccgtggcttttgaaaaagctgatgtgagctgtggactgtggaaaagcagctgtgggaaaagcagaaggccgtttggttagagcagctgtgaaactataggttatagaagaaatacctgtaatgcctctaaatgcatgtgggactgtttatatgcaaattactcgtgaaaacctaacccgttcaatattacgtattttaatggctaatctggaaagaaaaaaatatataagtttttcatacatcaaagtaatatggtcaacataaacagaacaaaagataaatggttcatacaatgatgccatatctcaaaataacaatcatcctcttgcactaactgttggtatttcttaacgacattactagaaatataattctcagcaatggcatagaaatacttctggtatattatggttacagagttcatccgcaagcccacggatatactattatagcatttcacccgagagtatttcaaggatatcatatttattttatctcgtgggaagatcatgtagagagaacttgacaaataatttatatataacttgtgattatcaaagtctaagcaggggttaataatccaagggtagagtgacacacaagcagagagcttttacttgaggtgtgtgttgaagtgaagagagtgaagtccttatataggctgccaatgacggttctggtagttggaatggtcggaattgccctccaaccatcattgggaagtgatccacgccgtccagccaaaacctggatccaactacgctaggggaggttcggctgaaccagggggcggcccaacctgacccaaattcggcaagtggcctcctttgttgcttcacttcttagacttgtgaattttggcccaattcatcgtgttaattctgagttcttggcccattcatacataagcctggttctcgacatcgtccgattgatttatcgtctgtgttgatgccaattctcctccactttatggttattctctgcaaaaggttagtaaacctaatactagtggaatattattattctaacataaatatgcattgtaagcatcactagttctcgtctattttggtaatattgacggtcaaaactgatcgataacgaccgtcaacactaactaaccaaagcatcagctatcctagtacgaatagtattcatggtatcatcattctctacatctgcactcacatcggctgttgtgtcacttgtatcttgtagtaagtagtccacatcagtatcacatctctcaaactccttatcacgtaaattgctatcacgaacaaaattatgcgaagcaagacaatccatgatgatatgcttctgagtagtaggtgagaaacttggtatgcccttcaaaatacgtcacttttgcatcaagactctaaaatacctttcaataacatttcgaagggaggaatacaagaaattgaactaggaggtcctgaacgatgccaaaattctggtatatggtatgtggttccttcgtaaggtgcaagatacctattcggtttggataacccgagtcgacgagataatattttcctataaaactaagttagtaatgcaaataataatactagtgtacaaatatcaaaattaatgaagtaaccatttaaacctgtaggagagatgggaaatgaaggaaaattttccaatgcatgactgaggatgcgcgagtcatgtgtagaacctggctaaccagcatccgcaaaggtaaacctcatgtcaaagtcacaaatagctagcacattctgagatgtatatccatggcggcatgtgtggctaatagttttatccactggcactaccactggaatatgtgaaccatctattgcttcaatcacatctttgaagtatggccaaagatgtccttatgcatgcttctacaaagaagtacttttcatcttgttgggatgtcctatttgttgcgaatcacattgttgggttatcctgtacaacaattaccccaaagtatttgggagagagaagtttctgtgccccaaagaatttgaattttgataatgtatataactgactcgttaattcaaggtcctcttctcctaatcgtttttccatgtgattcgcaagggtggggcggcgtaacccccatcttcccattcctatggagtgtatgtggatttgtcatgtcatgcttgcaagttcaacgtaattatttttttgtttaggtgattaatggaattcccttgtacgggagtttctttcttctgtatcaggcttgtttagaggagaaagggaagcgagcaaaatttgtgggtgaagaaactaacagatcgaagtccagtccctggttagtgtgattttatttttgcgattgtattcattagctccatcactgacaatctgcctgtcatactacccaactaaaagatattgatagatggtatgatgtttcatatagtggttagcaagtaaatcaatgttatattcaaaaatatttgccttgctacccaactaaagcaattttccttgcaggttcatgaatatatgtatttgatgtagatgtaatcaaatagattgatgttttgatgataggcaaaatttgctacagggcatcgaagaaacgtgtaattagctggtggacatcgcaagaatgagaatttgctgttgggcatcacaaaaaacgtgtaattagctggtggacactcgcggacttattttattatttccggtggatttggagagagaaacactggtgagagtacgattttgcccctgtcattgttccacttacaacaagggagtgagaaggcgagcaccgcgtggtggattggattggattcatccccgcaaaccttagacgctgatccccccacttcatctccgactcgatcgccgccggtcgccgtaccgtacaagcatgtttccgtcgtttctactctgggcactctccctcgccggtcgcaaggctgcgtgcccacctcacccccgtgacctcgtcatgctcgccggcgcgcacagcgcaagccaggccaccaccatcctgttgtcgtcccttctctaggcactctccagctgcggcgtcggtggcatgaacctggtgtcacctaccaccactgcctctggtggcgacgcatggtcggaatcaggatatctgcaaagcccgctccttggcagatcagcccgctggtgcgagcgcggacatcaagttggggtcggattcggtggcttcggcgaccgctcgcgaagactttgctctcctccgtgctcgtcatctcttgaacaaggtagaagtccaggcagagcaacatcacctcgccatgcacgacggctacgggggagtgagactggactgggtcttggttcgaaccagacacagtctactgtaagcgaaacgatggcaggagcaaaatcgtactctcactagtgtttctccctccaaatccatcggaaataataaaataaggccgcaagtgtccaccagctaattacaccttttcttatgcccgacagcaaattctcgttcttgcggtgtccataagctaattacacgttttttcgatgtcctgtagcaaattttgccttgatgatatgaccaggctgccgctaaaaatgtgttacaggtaccccaaatctcacaccatattatggcacttaataaattaagtagatctcatctactataaagattttttagtggccatgtttaatgaaatcacgtggtaaagacatattcatgttttttttagaaaactagagcttcacatagacacatacctaatttgctgtcactggtaagcgtgttgttgttagtggattttacagttttctaaagtttgaaattaattcagtttctttttaatgggtttctcattgatatagtgacataatcataagaatttccacattttttttctaatcaaagtttcatatatttgtgttgtacatgatttcagtcgtctgaaatctgcatattgtttttcgagaaactgggcacaagaggtatgcccctttacatctaaaagggcatatatatatgtgtttcaaactagtgtattacttgagttcattttttgagtggattatgttgggatatgcgtaggctacgataacataaatcaaaattttctatcgtgtaaaccaggaaccatgcaagtattagatcatagatcgttaccactcgacacgctgcacagcggaagaagacgctaagaagtcgaaggaactctcgcgaagtagcgcgcatcgatgtagagaaagtagtcgatcgcaccggctcgaccttctcctcctcgtgcgttctcctcgccgtactcctacgctgatcagcaccgcaaaccagcggcgcctctaccggtatccacacatacagggacggaacgccacgcgcagatatgatagcacccgcgcgtggctagggttttgctcggggagggaagtgacggctagggtttctcacgtgatacaatacctccgccggtcacacccctcacgaatatataggatccatcactcgggcctccaaggcccgtaggactcctattcggatccctatccgaattaatctcatattggatctccatgcaatccctttattccggcccattaagcgtgcgacccgaacatatatactcggttgtaacccgaaaactcctttcggtccacgcgtcaacagcgttagcataacgtattgacccccgggcatacataaagatcatatcagctgaacctctagtgtatacttgtatgaacccctttgcctcacgatatcgattaagctcaaggctagatatgtgccatcctctaatagctcaatcattcattcgaacctgttgatagattatataacttgtgattgactcctcaatcacctttggcatggccatgcacttctataatctacaacatcgaggggcccagagatatctctccataggaggggcaaatcccatcttgattattcatatcccactacatgtaattcatagcatacccgaaaactacttttatagctacccaattatggagtagcgtttagcagtccctaagtaagctactacacatgttgggaaccatgataatctcaggtctaaggattcaacaccaacactaaatgagatcactgatgacacaacacatatggctcttgcagtgtctcatgttgggtctatccaacaacctgttcaataacatgtgtctacattattaatttggtatctctatactatgatccatgagacatgatcatcaattaatacatgtgctgatcatctaaatatatttgttccacatatgatatttgatcagggatcctttagaaatagcaacacacaacataaagagtctcacgaaagaatcacatattcattaaccaataatgagtttatctatttcaagaaacaaagtcggataaatatgtaaacatagtgtgtgatacaattatctctatgattggctctagggcatatcactaactaacagattatccagtaataatgtactatactgctttttcttgtctttttcttttatcacatattgagccatggattctttttcaatcattcactatctcactgtgggtagaagacgaaacttcaatttgttttcatatcatttgttcctactaactattatttttttagtccagaaaattaggtggcaggtaccatggtatcattatctagcttgcatgagccaccaataatctcaaattcaagagaacctgcatagcgacggcacagtacgatttattcaaatcatgggatcaaaatttaatgcagtggagttgtatgttcaaaaataaaataaaataaaatcagcaagtgttgtttaattaaccaattgttttcttccttgaagcccctgtcttgatgaattaaaaatcccctaaacagtcagcaccgtactacatcacgatcacaacaatccaatcggatttgatttcgccatcctactcaattatttatcgtcacaaacaagcttccccacatttcttttctgggagccacttttttttcaatgattatgtggaaatcctagtacatcaccaggtaatcctttttttcaatggtaatcctagtacatcaccaaattggttggccgaaagttactagccatccgattccaaagaatgggaaactgcaccaaggttgcaaactttttattgaaaccaagatgtagaggtgcaaatcgatagggaactgtggcgttgccatgacgattgtgtatccttaggcctcctttgacgtacacactgcttgataacatgtaatcccttcggttgccttcacagaaatgacataattggaggtttgttgctgagctgtaaattttggtgtgggtttcaccaggctcaataggaattcgccacggagttcaccgctgaatcagaggagtttgagcttaacccgaacgacaaatcttgcatgcacactgcttcaaggaaacaataggtagaagatacccaaatctagccacccataaagacccaagaacatgaatggtggcgaatgaactgctgtccggaagacgaggcagtcgactagcaagctgaagacgatgttgtcgcgccggaacatcaaatcagagctacggggagctgttccctccccacccatccagatgagcaagccggcgctgcttagaggagacaatttcaatgtccgattccgccgcaaatcatcgattcccacttctccatcgccaccaaccgctgccaccgccgtctactccagcatccatgagaccatgctagcaaaagcccaactcgggaagaacccaagctgcagtgaatacttcacaacaaagaaccgacctaactaaactagtacggggggtggccaggtccctcctttgaccctcgccggcggtctggaattaacatccaaaaggttgcaacaaatgtgaaaaaagaaatctgagatatgcaacaatatgacatgtaccaccacacaaaaaatcagctcaaaatatgatgtacccaatgagaaaaaaaaacaaatttgtactccagtaatattcaaacagattatgttactattcacctgagatttatctttttattctctcactgtgtacgtcgtattgtgaactgattttttttagtggtggtgtatgccaagtgttgcacatatcataatttgtttacattttttgtgacttttttggatgtatttttcgaggttggtagcacggtagcacattattgtgcagtagcacctgatattctctctgcttagacggatatggtggtggtgggatattctctccacttagacggatatagtggtggtggtggaggaatgatggtgagcggcggacattgacggtccactactggcgtgaagactatgagagccccacaaagaccccactaaaattttttaccatatatagataggagggaggactgtaactatatctagtttgctcagacctactgctatttctttctgaatccgccactattaatggataggaaggtagtagtggcacatgattgtagggttgaaggagggtgagtagggtctaggacagggtatggaagtcaatagtggcatatctcgttgcctgagcctcgaaggatgggaaagattatgggacatgggtatcttgccaccactcggcttgggggcggagtagaagaatagatgtttaagattgggatggagggatggggagaggaagagagacctaggcaggaaggtcgtgatgatatgacttagtgacgatatgatcggtcgatctggtgttatgcgttagtggggaagagagtggaaggaagaaaacatgaagaaggttaacatcatagcatcagaattctttgtgtaatctggtctatctaaaagtgacttaaatgtgtgaataattttacattcgctccctttgtcgtagaaaaaaaaatcatatcccaataaaaagacagggagaaggacataagactaaaatatccctcattactactactttggtccctaaaacaaataatcttttactggtaggtactaagcggcattaaatagattaaatttctttgatttgtacaacaaaaacagctataggagggtaggaattaatatatttttttagataaagtttttatctttggaagttataatttattttgggatggggagggagacaactacagtgtttcgtttggatcgttctgtctgttatgcccgtgatcttttcagttcagaacttcagagagcgataaaactgtgggggcaagtgctctggcgccggcaataatggaggcggcggctagaggcaacaagaagctgcaggagagggtgcccatccggcgcaccgcgtggaggctcgccgacctcgccatcctcttcctcctcctcgccctcctcctccaccgcgtcctccacgacagcggcgcgccatggcggcgcgccgcgctcgcctgcgaggcgtggttcaccttcatgtggctgctcaacgtgaacgccaagtggagccccgtccgtttcgacacgttcccggagaacctcgccgaaaggtaaggtgcccaagaattaatcaggaatgattcaagccaacatccagaaaaaagaagatgattctgacgagctggttggttttgcatctctttcttgttgttaggatcgacgagctcccggcggtggacatgttcgtgacgacggcggacccggtgctggagccgccgctggtgaccgtgaacacggtgctgtcgctgctcgccctcgactacccggccgccggcgagaagctggcgtgctacgtctccgacgacgggtgctcgccgctgacgtgctacgcgctgcgggaggccgcccggttcgccaggacgtgggtgcccttctgccggcggcacggcgtcgccgtcagggcgcccttccggtacttctcctccacgccggagttcggcccggcggatggcaagttcttggaggactggacattcatgaaggttagctatggcaaccgcaacacctctcagtttctttctctctcttttttttttccattttggaagtactaacgaatttaaaaatataaggaaacatgataaccacaacacgtctcagtttctttctctttttttaatccattttggaagtactaacaaatttaaaaatataaggaaaacatgataaccacagcacgtctcagtttctttccttttttttttccaatttggaagtactaacaaatttaaaaatataaggaaacatgatttgactcgtgctctaaattaaaatcgattagatgaaatccgggata

SEQ ID NO: 17559 - DNA, 10652 bp, Oryza sativa
cagggcgagaaggcaccacaggtgaaattgggcaaacactgatgtgattgtcatacattagggctccatttggtattgcggtagatcataataatcacgtttgctgcaaatgttttttgacgtttggcagttggccaaccgcttttctttttaattatctacgttagaaatgataataattataattatctaatcataatttggtatgtaaacacaaacaacaacaattattagtattagttttcatgtcagcctaaactagtaagagaattcaaatttaattcttcaggttattcatctaacaaggagctccatagtaaattcggaagttcaaataattttaaggaatcagccagggatgtcatttatgggaacttgtcaacagagccaatagtagatatatcaagttgcgttgatgttgccaaagaagtagctgcctgcaactacgagattggcacatgttggggtcaggaggtacagccattgccacatgtctataggatgttactatgcagtttaatttactattctatatgtttcataaatgtcattccatatattcacaggttggttgggtctatggatcactgacagaagacgtgttgaccggacaacggatccatgcagcgggttggagatccacgctgatggaaatcgaaccaccagcattcatgggttgtgcaccaaatggagggcccgcctgcctaacccagttgaagagatgggcatcaggttttttagaaatactcatcagtcggaataacccaatcctcacaaccacatttaagagtctccaattccgacaatgccttgcatacctgcacagctatgtgtggcctgtgagggcacctttcgaattgtgctatgcattgttggggccttattgcttactatcaaaccaatccttcttgccaaaggtactactgcatcactaaccaatgcatcggttataatcttctgtactctccttgccttcttaacacagtgttgcacctcatttgcatattcaaagataaaaaaatctttccaattgaatggctagagagtgaggtatatatgaactattaactctactattgcagacatcagaagacggtttctacatcgcattagctctattcattgcctataacacatacatgttcatggagttcatagagtgtgggcagtctgcacgtgcatgttggaacaaccacaggatgcaacggatcacctcagcttctgcttggctactggcatttcttaccgtcatcctcaagaccttaggcttctccgagactgtgttcgaggtcacccgcaaagacaagagcacatcagatggtgattccaacaccgatgagcctgagccagggaggttcaccttcgacgaatcgacggtgttcattcccgtgacagcacttgcaatgttaagtgtcattgcaatcgctgtaggagcatggagggtggttttggtgacaacggaaggcttgcccggtggccctggtatcagtgaattcatctcctgtgggtggctggtgctgtgcttcatgccattgctgagaggtctagtgggaagtggtcgatatggcattccttggagtatcaagatgaaggcctgcttgcttgttgctatattcttgctcttctgcaaaagaaattaattgcagctggtgtgcagcaacaattagtccatactattatttgagcatgcaaacactaggtttcatcttcatattattatgtccgcaaacgttgactaagctctagaaaagggaacaattcaatcactaattcgaagcaaaaactggttgtttactgtaagagagaatctactcgtccatggcaagttgtcccaccggtgcaaacttgatcttagtggcatatatatagtagatttcctcttattgtacggcctgtatgcatgcatgaatccttcaaagtagaagcattggagcggtcccgtgcaaatttattttcttggatggatctactattataaaaattgaagatgtttttgctgatactttgatacgtcatccgtgtttgaatcggttgtaattttatgttttatttttaatctctatctctacctaaaaagaacaagaaatttccataatcggtaaaaaggaaaaaaagtccgactaaaaaggtaaaaaaagggaaaaaaaagtccgactcaaaaaccgataaaaaaaacttctgtcgtgaaaaaaattgtccgactcaggtaaaaaaaggtctcgccagtaaaaaaagacaaagaaaagtccctttttttttcatcggtgacttttttcacgcgaaatagttttaccgtacgcacgcgctattggttttttcgtctggttttttaaatccgatctgttcaccacgcatctccctggtgcttttggttttttcatcaatttttttatcaccgggtttttatcccatgcgtttttggtttttcttgtacgattttttaatccgatttattcgtggcacgtctaccgagttgaaccttggcgtcacgctggcgccatattaatcgtgcgtttttacttcaatttgattgcaaaaagaaatcgattcccactcatccctcgtcattttctccatgattttctgggctttatttcgccggatttaatctaatggttgccgatgatgacagcgatcttccccaattgtttttatcctgagttttacgctctgattttgggtaaaacaaccaattttgggtgattaagaaagattcgaccggatttgatgggtcgaacgaaacatgccaaatgagggaggtagcggaccagcctagggctgaaaactgcttcactcgtggctgggtggaaacaagaaggccaaacggagggaggtagcgaactggcataggattgaaatgtaaggaaggcttttggcccaaaactcaagaaagattttgggaaggaatcgggcggcgccgggcaaaggagggagggaaggggagcttcacggggtggcggtggattgggaaggccggcgcggcggtgtggagaagaggaggccggcggcggtggggatagagaggatggccagcgaaggtggggatggagaggatggaccggcgtggtggggaagggcgacacgaggagaggctgccgcgggcgacgccggcgcagccgtgctcggctgagcgtcggccgactccgcgtggcggtaggaatggagaggaggggaaaggttcgacacggtggggagctcaatccggggacgccggcatgctgcgatggacaggagtcggtggagaggggatagagactcgctcgcctgccggctgccacttgccccgctccatcggtcggggagagagaggggatagagagaagaggggagaaagagaggaggaagaagaggagggtgagatggatgacatatggggcccacgtgggtcccaccatttttttattattttctgtgtgagactaacttgtggggcccatgtgggtcccaccacttttttattattttttgtgtgagattgatatgtgggtcccgcagattttattatttttccagctcgaattaccacgtaagtgccacgtcaatgccacgttagatgaagaccgagtcaaattagccacgttggcgccacgtcagtcaaaaccgccctcaaaaccgtcgagggacctaatctgcaccggttttgatagttgagggacccgttgtgtctggttttccggttgagggatgaaatcggatttgttgacaagttaagggacctcagatgaacttattcctctgggtagcgacgcagggacttgggagaggcccacgagccagccacatcggaacaagcaggggacaccgtagcacctgagcccagcgaagaggtctccacctctgtcggctgggagagaaataagttcactttaggtcccttaatttatcgtcgagtttgaaattcatccctaaaccaaaatacgatataactcatcccccaatttataataacgtatcaactttgatcctggcggtatagcggccgcttttggctgatatggtgagtgggacctacctgggctccacatgtcagcggacggagttaggggcggtgcttgtcttcctcttctctagcgcggtggacggcggggcagggacggcgctcggccttcctcttctctagcagcgaacggcgggggtagggtggactgtggcggatgttgcacgatcttctctatatcaccagcccatcccgcgactccgccttcgaggcttcaacttgtccgacaacaacgtagttaaattcatcctcaccacgtggttccccttcggcgccagcagcaatgcgtcgcagccggtgacgcagtccgtggtgtggttcgcgaagcagtcgttgtccggcgagacaaccgttggcactatgcattccgtgctcagcgtcacggtagacggccagctcgcgctcaccgaagtagatggccgcatgctatggcgggcaccggtctcccggctgatgcgcggctccatcctcgtgctccgtgactctgatagcctccggccggttcgtcggtgacgccagctgaaggatcgaacaacaagaactaagccaaccaaatgggggtgaatggttgtagtatacatacatattatacatacatcctagttatattattacttaactaataccctctttccgatgccctcctggtgcttcgagaagccacccttgattgccgagttccttacaacaatccgtcatgaccatccaactgtggctaaatacggaggagtacccgccccaggaaattaacttagtactatatacacgcgcggaggaatacccgtactgagccatcaccatcagcggcccacctcgcttctgcagcatataacctcaaataatgatatgtagtaatctaaacaccatgcttaaattaccaaatgctactctaatatcatcgtcatgacatagagtcatcataaatacgatcattatacccacaccatcgcatcttccagataagctagcatcatgataaatgtaactcgggcatataataaagttggtattcatatactcggatagtaatacaataccaaaatagtataaagaaatattttaataaaagtacaagtcttacaaaagaaggaaaagctactagagctatacccgaattcttccgaagactccgaggattgaagattctattctatttctattccactatactctataaactatactaaacttgagagatgtatgaagcttcttgcttgaggtgtgtcttgaaatagagagagtgatggccttaaataagcaggtaatgacagttatggtggttggaaaggtcggtaataccctccaaccgccatagggagtgaatctcgaccattcccttaaaaccctgaatccaacggagctggtgctggttcggctgaaccctaggctggcccaaccagcccacaacttgccaggtggcctcctggacttcttctcttcgtagacttgtgaaatttggaacaattggtcgtgtcatttttgagttcttggcccgttcattgataagtctgattctcgacatcgtccgattgattgatcgcctgttttgatgtcgattctcctccattttgtgttcattctctgcaagaggatagtaatcctagttctagtggaatatttattattttaacataagtatgctttgcaagcatgactagttctcctttattttggtagtattgacggacaaaactgatcgctaacgaccttcaacattaggagaaggctagcaacggaccggacgccgctaagcgcgactgaccgccgctaagcgcgaccaaccgccggtaggccaacaaagaaacatagccgagatcgcacaaaacccaacccttacaatcaacacaaagcctcgctctatccagtcttcaggagttagggagagagggtgagagagagaacggaactcctctcccccctaggccctccgacgcagccaacttgtagagactaggatgccgccacaagagaatgaaatctagagtgggcttgcaccaattggttgggggtttcaactaggggatgcctaaacgacgtctccaaggagagaaacgacggaaaacgccgccgccgccgtccgtcaaggtctcaaagagaaccgagactgggctttcacccgacatctacacatgagggatgagacggcacgacaacgccctcgggaggggaatgacacttcgagcgtcatcgttgccagcccgaccgaggttgagctgggttttcaccgaccgctcaccacctgcgagtccacggctggcgccccgatgctccaccaccatccatcctctgccggcatgtgggtccactacactagcatcccccaccgccagccttcgtgcgccgaagactgcaccgcactcaccggcagttccttctccttgcaccgtgcccgcctgtgtcactactggcctcgtccactgccggccacgcctcttcgcgccaggtcggtctcccgccaccggccgcactaccgctggctacgcctccttgcgccgtgccgacctccgctgccaccggcggaacctctatgcaccaagctagcctctgagcactcctcccgccgatgccgcgccggccaaatgctgtcatctgccacgccaccctggctagccgcccgaggccgtccttgcctcctctcacaatcgtcgtagcccgtttccagacgtcgacaccgcatccacaccttcctcgcctctacatgctgccaccggcaaccgacgccgcattcacagccgttgccgccgtcagccaccgccgtcgccagccacaaccgccgccagcagcgcctccagccgctactaccaacggccggccggccgctgtcgccgtaggcctcacgccgccatcgacctgccgcgatgggcgctcctactgagagctcgcccgctatcgccgacccatcgccgcgagctccgctgcccccgtgcgagctcgcccaatctgaccgccgggtggccagatccgcctccggggggccggatccggcgcgccgtttacatccctgcctccgtcgacccagccatgcctctaccgtcgtcgtcgccatccccgccgccagccacccccccctcctcgggcagatccggccagagcggcgtggatctggcggtcaccgccaccactatccttgcggccacgcggcttggccggcggccgctcaggcggcggcgaggcgaaggaggaagatggggggagggtgtggtcggagctcgtctcctcccgtgctgcccctggtggagggcgacgcgagagcgagaagtgcaggcttcctctgccttgatccagagacccggtgttgctgtgcatggtttgagtttttcctttcccgcatgcaacaaaatcaccactatgggagcgcgtttggacttccagaccaaaggagagagcaacactatttgtgtagagtcactacaaattgccttatagggacattttcctaatactatgtaggcatttttaaaatgcctttacgatgttttagagacattttaaagaatgcctcataggtgactttttttagtgaattatctctataaacgaaaatgcattttatataatatctctatgccttgcggcatttttgtacatacatttttatatctataagaaaatagagacactttctagatgcacttcgttgtgcaggaactatagcaaatcaatgtgaaaaaaaaaagaaaaaatatcataccatgccaatcttggaattcatgacctcttgagttcataacttttatcttcaatatactaaccatctcaacctcaaatcattatttgtgaatatatgtcttgtattagttatatctagtttcttagcatacattaagatttggaaaagtgcctctacatagctaggttaaaatgcctttacaaatgaggcaatatttaaagtgccaaaaaaaatgtctctacagcataaatttaacaaaatgtgttataaatgcctttgaagtgcttatagattaaaagtattctaggagattttgaaagtgtctctaaactgtaaactgtagaactcctgattttagtggcaaattaaatattctctacaaaagtacgtctatgtaagatttttcttgtatgagtgctccagcgaggattaatggagattaccaatctccgatacctcggaaaaagctccactgtgttcttattattattgcttcttgcttttcatcaactataatttgtagaattgcaaggaaaggctataggttgtaaaacttgggctacactctttaaacctagacacttaagctagtatgcttacacttaagcttgtcccagctgcagcttttcccaaaagctgcttctgctagaagctgcccaaacagtccatagcttctgagaatttgtagttacagattctgaaaaatgaactaagaagtcagaagctggagaagctaggtttcagagcttttccaaattctcagaagctggctaccaaacagctgcttctcagaatctaaagctcccccaaacaggccctacgtataggattccaatttaccaccctctacaacatctttgaacatacaaggcaatcatccttgtgttgcttaaaagcatctcaattgacaatttgacaagtctatggtatgtaagtattacatatcagaaacaccaaattcatagaaattttacatgctatatgccacgccttacttccttaaaaggcatgatatgttataatgttttaatggagtactgttaattacaaaccagcaaacaaatttattgtaaatctataggtagcagtgacgttgaatgtgaacctcccgtgatagcattcagtagtcttggcaatggtggcattttgagttctagtagaccctctaggaattgcaccacctcgcccattgtcgggcggtcaaactcactgtcttgaatacaccaacaagcaactttgcaaactcgttcaacctcctcgagattcacatcaccatgtaattttgcatccaccaaattttcaatccctccattgataagctggcgggcaacttgcataggaaaataggccgaatgacccctacaatattcttgatttgagttcctccttcctgatattatttcaaacaaaaccatcccatagctgtaaacatctactttagatgtaacaacagtcccgctaatccattcaggggcaagatatccaatagttcctcttactgtagtaagagcatgactaaattctctccccaaaacctttgccattccaaaatctgctattttgggaacaaaagatgcatcaagaagtatattctctggcttgatatcacaatgtataatgcaatctcgacaactatcgtgcaagtaagcaaggcctttggcaactccaatagctatttggtacctaatattccactccaaaactttatcattatccttaaatagatgcacatcgagggagcggtttgtcatgtattcatacacaagtaacttcttaccatcttcacagcaaaaccctatcagtttaactaaattgatatgctggattatcccaattgaatttacttcagctctgaattgcttcactccttggcaggcaccgtcaagccttttcactgcaatgataattgagtcatttaggtatcccttaaacacagaaccaaaacttcctccccccaacttctctgaaaaatttttggttgcgcattgcaaatcggtatatcgaaatgccctgatcccaatgccttcctgagcattttccactccacgagaaaaccatttctgttttctcatccaaaacaccagtacaaatatcatcaaacacaaagcactcatgcttgcagcaatggtgacaccaatgacggttccgctctttttcttcctttccacactttgcacctcatttgcagcaacgcgaatgtaaagagtttccccatttccatcagcagatccatcagattgttgccttacattatacagcgcgtcatgccaaacagagcatcctcctttcccataggaatatgcagtacaggagcaattgctcaagcaaacttctgagcattgatctttactgccagctgtctgcacactcatggcattatggggcaatataatgttttgcacacagtagaacttatctgtgaaccctttcttgttcatggtactgccacaatttaaaggagtattcctcatacaacctcctgatcgatcttctagatcccaattcttgggtgatcttatagagaaacccttcaagcagtcacagaatggattgttactgtcattgcagactgagaaaggtccacagattgcgtaaacatcgcagtgaagtatgggcatcctgtagttgatcaaccaattctgcaagctgtccaaccatatacctgccaaacctcgaccattgacatctattccagcatgtgtaatcttctccttcgtcagggtatatgagaggtaaacctctctgtcattgttgacataagtgaaattgggtatggttgcgccaatcatctctggcgctaagccgaagaaatgcccattccaatccccagtggaccaatatactacagttgagttccataacaaatgaccagtaccattgatatcaaactccaccgagtataaaccagcagcctggtcaatcgaatttttcctagaaacaagacggttcttctggccagtcactttgttcctgaaaatctttgcg

SEQ ID NO: 17560 - DNA, 9379 bp, Oryza sativa
gagcacgaacttgctgttgttggagacaagcctatcgcttccggtgagtgcatggccaggtgacacggtgtctgtggcggcagagattctcggagggtacagggagaataggaggaagcaaagaaggagagacatgtagagaatacagtgaagagaagctaagtggaggagtggaatttgtaaggaaaacgattgatgctcacgaacgcaatgcaaacatcaggtccaatggtttagaagccagaccactgatcagttgtctgtagagctcgcagaatctcaggtcaacgtggtggtgcgggtaaaacgtcctaatcagtctgtattaacaactgatagtgtgctgacctcgatcttaataaatcttccctcattgatcagacatcaacaaatggagcgttttgactgcgtaatgatctgtggtttgtgcatattcaagagaaatctgtttggcatctcttccagcaacttccagttgaggtattcttttaagaggactcttttttttaaaacattgcaattaggttgacttctcaatgcaattggcgctgcttgttggagactctttcgattcttccccttttttgtcgaccaatcatggatttatttccaaagtgaaaactttagccaaaatgaaagctcagtttcacaactgatgagatcaatctgatattacttgtccagcaggaaatcaatgtcataatgatcacagatttgggcaaagcattaccaagcgatgtgagataattgatggcaacttaaaatgggttttgattttggcactatcagaatgatgcataatccagtccatggcaaacaaaataaaagtgcagatatgcaattagtcactgcggaatgaagtaatagtaattttactatccttgtaccacattgtttatataaaatcttcagaaattatctatcttgagataccatcattttacagaaaaattgagtaaattttataaaaccccaggtactataatttgtttcaaagaacccaaggttttgggccaaaatgtttcaagaaacctcacgtttaagcatattatcacaccccgatccggcaccgccgtacaacggcacctgacaggagcgtgtcgtaggaaaaacggcgcgaaccgcttcctacgaaaccgcgattacagtaccagtcccaggacatagtgctggtacccacggtgacaaatatgaaccatcgcaaatccttaaaataaataaaggacttatttaccttaacttacgttgcagctcagaacagcccgagaatgcaaccgacgacgcggacaaggaaaacaccaacaacagcagcagcagcggaaccaacggactaacacccaacaccacaggcgacggctgggaaccaggacaaaaccctattcttcacttcacttcatcttcagcttcaggacggaggaactatatatatatttatatagagcaagggtgagtagttttgtactcagcaagtcacggggatttaggtgtttaatgcaagcttggaagagaggcaaggttgttttgcaaatcctttgtttgaaatcttttgaaatcactaagtgatttatttctttctaagtttgggtcgaaaagagacttgcgtctcgatttgacttaagagatgcttttcaataactcaattggtaatgtaccgacctcccgggtcagatcattacttctcggctccaagagccatttcacttgattaatcggctcccagagcctttttcattttctcggactcccagagtccagctgcccagcagcaaagcaatccgcttcctctcgggaagcctagtctataatgcccgcagacatcccgaatcacacagattcgtttctgaccactcaggtcatccatctgccacataggctgatctggttacgattcccatcccacaacaacttttcacaaagcacaggcaaacaaatctacgcaacaggaaccacctcacatccgcccatgaccgtgggcacggctgtttgaacagttagttaacctctacagaggggtacactttacccacaagatacgaacttattctgaacacccgtcggtatcggaggttcgcaacaaagcctttcctaagccgacccagggttacctcatgccacgtagaaggatcaaatcctcatataaatataggccattttagttttcacaaatcaaactccaaccacctcgatcggtaatctggcaagcttcgcgttcttgccttaccaggaacccgggttggctccaaccgaccctgccccggcattccccaactattggcatgcgaggtttccctgaaccgactagttacttagctagggtgtcccattccaccttgtggttgcactttgttatgcttgatgaatttcccacaggaatcggtccttatatgcgaatacgggacagtgccacacaggcacaacccccgcatcgcgagttatcacaattcattttatttttaaacacaccgacaccacaggttgggttttcaaggcttctcaaacccatttcccaatttttggacaatcaacagtgtatgtgggatatttgatatacgcgctcaaagagcacggataccgaagtcccacaagggtggagcgacaaggaatcagggtagtacaacctataggaattagtgcgactactgggtaggtccgtcggtttggcacgcaaaccgaggccaagcaagttaagtgtgtgactctaataatgcaagttgcaaacaaaacaataatgattttccaattataggagcaattggtcaaaaggtgacttgccttgctcaaggtcttcacggagcttcacgaatcttcgagaaaacccgcgatcggcgaaaatccggtaaccgcaactatacgcaaacaaacaaaaacctaaacaaaagaccaagaaaaagaccctatttagactaaataatagtgccattaaatagatctcaatttttacggaattactggaaatagaacggagtcaatcggaagagcggttgggaagatatgaattttggaagtttaattggaatttctggaagacgagaaatggtttatggaatttatagaaataatattctcaagaatattattgacagtcactgacgtgcgggaccaaaggaaaatgattcatggaattttggaataaagaattttatttatggaacaaaggaaaaagatttattaaatcccttggaaaattaaagggatgagggatgtgatttggacttatctcgggtggcattggtgcggcccaaagggttgaaggaggctcggccgagccattgggccgggcgcggccacggggaggcggcccaacagagggggcgcgggggagagagagacggcccggtggaccgattccaccgcgcggggtcccgggtggggcccgcttgtcggtgatacggcccacggtgggatggacgcacgcgagggtggcgctagggttcggggggggggagaagcggtccacgcgcggcgcgcgggtggacgcggtgtgcggcgggcccacgcgcagcctgttggctctccgtggaccgtgcgcgagggtgggggacggagggaggtggctgaccgaggtcagctttgacctggtccgtcgaggtggcgccgacgtggcagctacgtggcagccacgcgggccgggcgagaggaggaagaagaacaggagctccaaccaacggtggccgacggcggggtttcaccggagcacgacgtggcgattcgatcgagagggagttcaccggtacaaaggggagcacgagaggggttgagccaatggctcggatccttcgaagaggggccgacgacgacgaatcgcggcggcgcacgccggcggcgagaaaagggggaaacggcggaggggtgacggggattcaattcaaggcggtgggagcgtgtccggggttcaagaaatccgtttccggcatcggatggggtggaggagcaccgaggagggctagcgatggcggcgggctccggaagcgggtggcaatggcggcgaggccatgccgagcggcggcggagctcggggcggcgtctacgcgcgttcgaggggctagtagagctaccacacaagctagagagggcgaggaagaacgaggaaggagaacggagggagtctctaccgagttaggacggcacggtgacgagtggccgacggcgcggagtgagttctccgttctcagaccggggaaggggaagaaggagggtgctcggagtcccgcgtcacgcgtcctcgcacgcaccggcctccccggtgcttggcgacgaacggcgacggcgagagcggagcgagcaacaacaatagcgcggcggtgttggaagtgaaacgagaggaggattcgatgggaggggctcgggttttataggtggccgggtgaggagcttcgaggggaaggaactgactcgggagaggcggtcaaggagaggagctggcggtcacgcccgtggtccaggcggcggtaggcggtcacgggcggtgtcgggcaaaatggaaaaagggggggggggcaaagggagctctgttcttgccgaaacggggaatgggagagggagagaagagcgcgtgaggcagagagtcgcgctgcctatatgtcttggacgcacgcgcgcacagggtgggggcgagcggcagggcggcatgggcggctgcgcggcgcaggcggccagggctgacgcggcggcgaccgagcggtctgccacgcgcgggcgagcgcgtgcgcgacgcgagggcgcggcggaattcagaggcggcggcgggaatcggcgccgggaggggagagagcagagagagagagcgaagacgggagagagaaagaacgagagagcgagagagctctctctcggctcggctcggcgcgtgcaacgcacgtgcgaggctgagggaggagaaacggctgagagagggaggtgggctaaggggggaaaacggcccacaattggagtttgtatttggattcaaattcgatattcgaactcgagggttcagggaggaatcaaggaagactcaaggtagggtttgatatttttcggaattgggagcgagtatttgccgaggattcaaaggatgcgattgaatttcggaatttgatttggagatttgagtcgaaggaggaatttcgaggtggaggattttgattttgatgagagggaacaaggggattgaattgagatcctggcacgacttagactctcacacaaagaacgaaaattttcgtaattaggattttgccgaattagttttaaacgtctcacgaaaagcggagcgttacacatatatattttaatatatttatgcataatatttgtaaaaaataatatgagatattccggagtatatataccttagcctcttttaaacgattatctttgcatcaattattggtagtatgattaatgtttatctatacaagtaattaccaattaatacatcactattagtaaggttgtctaatgtttttcaatcgtgcaatgtaagagtagggaaaaagatgaagtgcacgagaggggtatgtattttgagcctactaatgtaaatatatactaaaaatattatatataataataaaattatgagtatgtgataaacatgtggtttattgaaacactttacccccaaaatctgatattcattgaaacaaaacataatacataaggttttgcattagatgtatctcaaaacttggagttttctgaaattctaaaaaatttggtatctgtagataatctactaagaactgtaaaattaccctgaattaacaggagtcaattgtaatatgtatgtttactgttgacgtgctgagacgcaaatcacttggtctctgatttggacctcctttcaattattaattccagattggtgaagtgtcctgcccagttgatctatattggcagatcatggtgtgatgccaatcctagaattctttcaacgccaaagatcaatattagatcactgctctataagctctatgtgccaagtcttctgtttctatagcccactagcagcaaccacagaccggctccttgtaagggcatccacaatgttgctttttagccagtaagaagcatttaatgctctcttcctactgggtaggaagcattgtgagagtggcacagagttaaaacccggccatacctctactaccgatgaagaagagataaagaatattatttgtacagtgtttctgacagtactttaaaaaaaatgaaagttgccgttgcttttcaaccgttgcttgctacccgttgcttagtcactgcattgtgccattcttcagtctcatactacagaaataacacacaatatatatagattgttgaacaacacagatacattctaccagatagttgagatggatccctccaacagagttttcacaaacttgttgaatcaagggtccccaagccaatattctgggaacagtagccaaaactcccctcctactcaattcccctcaaccttcacccaatcacagtatccccaatccccacagtttccacaatcgcaagcactaaattttcataacttccacccttttggtcctccagcaaactatcaattatatggcaatcctcctccaagttttcatggttttcagcagcaaggcaattggttaaaatctgcagcattaagctttcaaggttttcgtcatcaagaaagttggatgcactcaccaaatcaggttggtggatctgcttcttctcatggatctgaatcaacttctccatgccctgcaacatcgcaagccaaaagtgttgttaacattgaagagtctagtggcaacaatgaagaagctgggaggaaagggacatgggtcaactggactgaagaagaaaatctacggctccttagttcttggttgaacaattcagtggatccaatagatagcaatgacaagaagtcagagtactattggagggctgtagctgcagagtataacaacaatacacgtcgtaatgatcgcaaaaggacagtcgtgaaatgtaagacacattggggtggtgtcgacgacggcaagagagtgcgacgggatggggacgagaatcgtgtcgccggcggcaagagagtgcgacggactcgagagagaaattgggggtcgagaacttgcaggaaggaatcacgcggcagtcacggaattttactatcggtgatttttttttgctggccccaccttattcccctccgacgcgcagaaacaatgtggagggtgcgatggcttaataccgcctgacccctgcgcccacagtattgccgaactcagcaacaaacattgcgcttgccctaagggagcatatgtgtgcgattccatgtcaagaagttgagccaatattttttttatttcgatggttcctgttcattgccacctatattatagatattgaagtaaaatgcattactggtataaacttataaaagagtgcaatctagttcatgaacttgtaaaacgcttattttgttgtatgaacttgtctcgtatgtgcgacccaagacatataatggcatgataaggcaaattataataagttgaccacaaaggagtacatgacatgttatatgaggtggaatgcttttggtttctactttatccttcttcatttctaccccttgcattattatttagtttgagaaatttgcatatgtgtgatacttaaaaggtggtttcgctacaatatatgccatcgttaaaatatgattctctcggataccattctcaagtcatgggcattcgctaaaatgccattttcgttgtatctttcatttgcaaaacatttttcatccaaatattttttttctcagacacttttgcccctgactatggttgaaccaaactacatcttctacctcaagcttctcaggaccaggcgagaggagagaagggcgaccactccggcgccgccgcccgccagacacgctgccgccttccccaaccgagctgtgccacctctccccaccatccgcgccgccttgcatgccatccatttgcccccaattccacgccgccgcttccccccccccccaccatctgagccagactaaggagctgcagttgctgaaactggagggggcgctgcagctagaggaggcacaacacgcagaggagaggcgctagcgctcgccgagatggagaagaccaagttccgaggtgcgcacccgccaggagggcgacaagaaggtgcgcgcccgccgggaggctgacgggaaggtgcgcgcccgcaagtaggccgatgagaaggtgcgtgtccaggaggccatctccagccacgacttccactaccgacaacatcgagctcaccaccgagcgcttcttcgacgggcacaagatcggcagatggcgggggaaggcgacgcggtcagggaaggtggcggcgcagatggcgggtggaggcggcgcagatggtggggagaggcagcggcatgtgttcacgggcggtggcgcagagtgagagagacgacgacgacgctgtccccagccgccccctgccgagccgagcctccttccccaactgcgccggtgtcacctgctgccgagccacgtcgcctccccgtcgagcgcgcggcagatggtgggtgccatcggcgttgtcacccctggcgccgcttctctctcggttcgtgaaaaacgcggtcaccagaaaaagaaagaagatgtggtttggttcaaccacagctaggggcaaaaacatccaacaaaaaattatttggatgaaaattattttacaattgtaagaaatagcgaaaatggcattgtagctaatgcccatggcttaagattggatgtgtagcgaatctcattttaacgatagcatttttacgaagccagttccaaagaatggcacatatgcaaatttctaatttagttttgtatctctttctttatgcgattgttatgcctatgttttgctgaataaatatgtctacttgatatccttctgagatactccctctgttcttttttctacgatgttggttagttcaatttgacaaaccaacgtaataaattatgggaaggaggtaggcatgtttacacagcattcaaaaacaacaaaatcagcaagattaaccttgttgtaccattttgaccttggttaacatgcaccggataagtttgtgctctaaaatgagcattttacatgttcaaacactagatcgtagagtttgtgtatcaccaatgtaatttattctagatatttgctcaacttatttatttgttttatacaaattcccacaacaacgtgtgagcttttttctaatttctaataaaggaaaattgcaaaactcagtccaaatgtcactctgaatttgatattcctccatgtaagacgatttgttgcaaatgcctcttctaattcaccttgagatccccacaacccccccccccccccaaaaaaaaaa

SEQ ID NO: 17561 - DNA, 7425 bp, Oryza sativa
agaataactattatacaccacttccaacccaaccactcctactctcagcctaacccaatcagcccacactatcccatcgccccatccctcacccccctccttgatcgatgtctttttttctcatccattttctcgtttctttttcaccttttcttttctcccaatcatcctgatcctgcatctgtgtttcaaaaaaaaaatcgtcctgcgcctctccctcttcttctaatcaactctcttttctcctcattttctctttttttttctcttcgaaatttccctcctcataaatatttttcttttgaaattatcattgtttaaggtatagatggctataaggcccgcccggcacggcccggcccaggcatggcccacggtcgtcgagccagcatggcacggtcagcacttcgggccgtgccgtgccagcctgaaggcaagggtagcccatcgtgccttcattaaaataagtttatttcccctcccttctttttggctgtgatatatatatatatatatatatatatatatatatatatatatatataataagtctattttacgtctctactctttgtgacgtgctttacatatgtttgagaataagtctgtttcgcatccctaaactttgggccgggccgtgtcgtcccagagtgccgaggaagcagcccaagcatggcacggctgttgggccgagccggcatgggcacgaccggagtcggaccgtgccgtgcttgggccgggccaaatttatcgggccttgggcgggccatatggccattgttgggatttcttaacgacattactagaaatataattccccgcaatggcgcagaaatacttctggtatattatggttacagagtgtatccgcaagcgcatggatataccattgtaccatttcacccgagagtattccaagggtatcgtatttattttatcccgtgggaagatcatgtagagagagattgactaatagtttatatattccttgtgataatcatattctaaacaggggttaagataatccaagggtagagtgacacacaagcatagagtgacacacaagcattaacaactcattctcataataaatgatctaagctaggtggaaagaaaagagaaagagaatctattcctatacctctaatatacataatatacatatattctagttaactgatatactagcaaataccctctatccgatgccctcctggtacttcgagaagctacccctgactgtcgaattccttacgacagcacgtcatgaccatacaaccggggctaaatacggaggaataccctccccagggaattaacttaggattatatataggcgcggaggaatacccgtactgagctgtcaccatcagcggcccacctctcatccgcaatatataaccccaaataatgatatcccgtaatctagacaccacgcctaaactaccagatactactctaatatcatcgtcatgacatagagtaattgcatatgcaaacattataccgcaccaaagcatctcccagataagctagccgtatattcagtataacatgaacataatgtaaagtaggtactcatatacttagaaagtatttcaataccataaatgtatatagaagagtattctaataaaagtacaaagcttacaaaagaggaaaggaaagctgctaaagccatacccgaactcttctgaaggcttccgaactcctgattcctgttctatttctatttcaccagctagatactactaaactaaacttgagagaaatgagagagctcttgcttgaggtgtgtgttgagtgaagagagtgagctccttatatagaggtagttatgatggttgtggaaggggaattatccaaagtgccctccaaccgtcattgggatgcaatcctggacatccacgccaaaacctggatccaactgcactaggattggttcggccaaacctggggctggcccaatccagcccaattttggctggtggcttcctctattgctccactctgcagacttgtgaattttggcccaattcatcgtgtcagttctgagttcttggcctattcatacacaagtctggttctcgacatcgtccgattgatttatcacctgagttgatgtcgattctcctccactttagtgtcattcccttcaagaggttagtatacctaatactagtggaagtttattattctaacagatatatgcattgcaatcatcactagttctcctctattttggtaatattgacggtcaaaactgatcgataacgaccgtcaacggccatctatagtttaaggtgtgtatggtgcaagtttgttacattgcaaatacttttcatctatagtaaaaaagactttcactaattgaataatcaaaattttaatctttggtcaatatgatatagcaaaatacccattcatcaatttatggaatagacatccgatcgatttgcgaggctatggaatggtgtatataaggtattcttcgtgtgatgacgcatgaggtgagcgctatcgggttcaatgttatatatgatttctgacttttttttgccattgttttgttagtcttatttcagtttgtcttttaaattggttgagtttttatcaattgtaaaaattgtcttcacctgttgctacacacatgcatttttgctagtgaatactaataggtgaagagccatgatcgttagtcatgtcggccatgccctatgacatgatcgtggcatcccaattcaggaagcccggcacgtcgttgggcggtagtggtcacgagtcttcttctaaaacattgggggcactacatgatgaattgttgtgcttacttcatggggttcggtggtggatgatttctttggtagattcaagatgataaagatgagcttggtgcaacacttaggtcactgttagtagactggtgagaaaagaagtcatagaatacatgcagacaaaggttaatgaatgcatggacaacggcaattggggaggactcacacaaagctaaatagtagggcgtattagcaataaatcattttataggggggaatcttaaactcaaggagatatttgggatggtttttgcatttttttattttagttaaccatggagctgttacacgccgagacgatggtatggcagcgagatggtgtaaaaggggtgcctagactagagaggagagtggtcgaataggaagttgcggagtgggtatcaggatcgctcacaatcgccttttgggactaacaagagttctttcccacactacaacatattcggccttccttgacggattgcctttgacaaatagggaatatgtcattgatgtttgacaaatattaaaagaagtcggcataaagttccgcctcaactgattctagtgatgactcaagtgtgatcataaaaattggtcacggaggcaaacgtggtcatcacaaataccgtgaaattcatcattagaatcagggatatcacatgcgaaaagtattgtgtcataggagaattggtaggcaagatccacataggtccatagcaagatgatcccatttgtaagtatgagattgtacggtgaaattcatcatagactacccatgctatgggctagcacgcggtgatgaagtttttttttcatagaactaaccaataatagttgtaaggaggtctcacatataagtatgcaaaaaccttagaggagacagtttgtcatgtgtttattttgactgtgtgtgtttgtccgatgtttacttggtgaaatgtttgctaattcatacacaactgtggaagaattggcaggcaactgatttttgcaagtttgttacaagacttatagtgcggacatggtaaatcaagggttttactagagtcccttcatataaaatctttctatcgtataagcatgttgcatttagtgcacttctcaagttgttagcgagaagaacacaacaaactgtcgccactggctctgtttcacttgctcctagccgagtctaggattccaggattgactatccgtgttggatggattgagcggagaccggacgaattaatgaaggatgaaaaaaaatcaatgtgcctcgcatggcagatctgtcacatgttttgttccctcgcattgcgtcgagtcattgggattgatctaaaatgtatataatgaaatctcaattggaatctcatgccactaatcgaggtgcaaaaaaccttatagcgatggacgagagcgcttggtgacgatcggaaaattgcaaactttttaagtaggttagatttgatcaaaccaaaagaaatttgattagaaaaaaaaagtaaaagcgacgtataatacaaataatacaaaataaaggtattatgtagttttctgttacattcatttaaactagccataaattgatcatgtttaagatggtttattagtttaccttagctcttaataaggttttgatataagttattttgtttataaagtatctatacttggctagaaacctccgaaaatttttatatggttagcccatttgtgattttgttttaatacatgcaatctttcgatccaatggccattatttatctgaactctttatctgacggctaatatatttttgatgatgtggcgcatcctggtaccagaaagcttgttgcttctgacggctaatatatttttgatgatgtggcacatcctcgtaccaaaaagctctgctttccctatataagataagattcgtagttttattttatttataaatgacaaaaatctattcctactcacagatcttgagtgattttttttaattatttcctaaataaaattcccggccaacggagtccggagccgtccaacaagattgttcctcacgccggcgtgccccccgccaccgcgcgccatcgccgtagaggctaccactgggacttcgaggtcgctcctctctccatctgggccgccgcccctctcgcgcaccgcgcggcctctctccctgcccctcgccctcgccacctcgccgatggcctccggctgtgcggcggcggcgggatgctggcttctcccagccgatatctaggccctgatccgagaggtgtgttcctcatctgtgatgcctaaagttttccttcgcttgttgcttggaacctcccgtagataatttgtgagaaccatacacgacctggtaatttttgtttaggtcggcattgaacgagctttagattttggggaagctttcttaattaggtgaggctggttgtttgctaatgttaattttgagagtggattgcgagatactttaaatttcgacgagtccacaaaaatgggtatttgtattggtcgaaattaaaaatattctgtttggatagaatcacaatttggaatcaaatatcaaaattgagttcaaattaatacggtgcgtcctactactacttatcgtactttggacgctaagatgtgttcttttgtgctctttggtgatagattttgacatggatctatgaatatggccagcagcactaaattaaaaggtgaggagaggctggataagcccaaagggtgcccccacgtctctccgtactacaatgccgccgatcctattatcatcaatggcaaagggattgatccctttgagctgagtgaaggtatggataaaagaagagtggcttcaattcttcaaagtttcacttgaggcaaccgagagaaaccacgctgcttcacaaggcaatggcgattccaatacggacagtagcagcctctggattctagattctggaaataaaagaggtattgctgaccataatgtgagtaaatgaacgaaatcttttatactgctggtgttatctacttggttcagagtttcagacaggaaattgcacctagtcctaggtaatgtgtgattgttttgttagctttatgaagacatcttatgtccaaattgctctgacagagggcattcgtcatgctatctggccagccagtaacattttcaattaaaatatcttgagtttgttttgcataagttgtctgctatgttaattaccaatcataatataacatatcagatcctgcacaatgaaagctggccaggaaatttgctttgtactttgtactcactgtcttatgtggcaatttttctcattaaaattggccagtgttcccgttgatggtgcctctgtagagttctactaatactcagcagtgcaggatttgagtgatccattatgtagttatatcatccatcgtagcaggagtaatcatatcatcctacagttatttcgaatcatcacttcactcatatcatgattaaagatgaaacccttcacttgcttaggggcgataggttgtgtcagtatatatgttggaaaacataaaaaagttagttatcccatataaggaggtccaatctactccaaatggttttgtttgggccttgtagaaagggtacagcactggattgaactttgcagaatatgcaaaaacagtaagtcatatgaagttgtgcacattcacttgcaattgctatgttagtgttcatcctagcccgtagaatgtgcttatttccttggatcagcagttaggctgcatatttttgtagtctatatccattactgcttcacatgcatgtcatctgtgcatatatcagtatgacttgcaggttgtcagtacatttctctatattggactcaacaatgtactctcaactgggaaggaaatcttcttgtgttgttaaaagcatctcaactgacaaaatgacaggtctacggtatgtataacatgtcctactgtgtacagacacagagatatggatcttattatgaacactgatgtttcttattttctatgcctagttttcttgaaatgagacagaaactataattttctcataaactactggaaattacaaattagcatacaaatttacggtaaatctaaagatgacagtggtgttgaatgtgagcctcctgtgatagcattcagtagtcttggcaatggtggcattttgagttctagtacaccctctaggaattgcaccacctcgcccattgttggtcgatcaaactcactgtcttgaatacaccaacatgcaattttgcaaactctttcagcctcctcgagattcacatcaccatgcaattttgcatccaccagatttccaatccctccattgataagctggcgggcgacttgcattggaaaataggcgaatggtcaccatccttgaaatattcttgacttgagttcctccttcctgataagatttcaaacaaaaccattccatagctgtaaacatcaactttagctgtaacaactgttccgctaatccattcaggggcaagatatccaatcgttcctctcattgtagtcagagcatgactaaattctctccccaaaatctttgccattccaaaatcagcaattttaggaacgaaagattcattgagaagtatgt

SEQ ID NO: 17562 - DNA, 17732 bp, Oryza sativa
tccaatccaaacttttatcataatccttaaatagttgcacatcaagggagccatttggcatgtattcatacacaagtaacttcttatcaccttcacaacaaagcccaatcaatttaactaaattgatgtgctggatcattccaattgaatccacttcggctctgaattgtttctccccttggcatgtgccgtcaagccttttcgctgcaatgggagttgactcatttaggtatcccttaaatacagaaccaaaactgcctcctcccaacttttctgaaaagtttttagttgcacgctgcagatcaatatatcgaaatgcagtaataccaatgctgccttgatcattttccgctccgcgagcaaacagtttcccttttctcctccaaaacatcagtagaaggatcatcaaacagaaagcagcagtgcttgcaccaatggcaacaccaatgatgactccactctttttcttcctttccgcactttgcacctcatgcacctcatttgcagcaaggcgaatgtaaaagttatcaccatttccgacagcagaagcatcagactgttgccttacgttatacagctcatcatgccaaacagagcatccacctttcccataggaatatgcagtacaggagcagttgctcaagcaaacatctgagcattcatctttacttgcagcttcctgcacatgcatggcattacggggcaatataatgttttgcacatagtagaacttatcgctgaaacctgtcttgttcatagtactaccacaatttaatggagtattcctcatacaccctcctgttcgatcttctatctcccaatccttgggtgatcttatagagaagcccttcatacagtcgcagaacggatcattgttgtcattgcagactgtaaaaggtccacagattgcgtaaacatcgcaatgaagtaagggcatcctgtaattgatcaaccaatcctgcaagctgtccaaccatacacctgccaaaccttgcccattgacatctattgcggcatgcgtaattgccttctcattgttcagagtatatgtgaggtaaacctctctgtcattgttgacaaatgtgaaattgggtatggtggcaccaaacatctctggtgctgagccaaaaaattgcccattccaatccccactggaccaatatgttacagttgagttccataccaaatgaccaacaccattgatatcaaattccaaagagtacaaaccagcagcctggtcaattgaattcttcctagaaacaaggcggcggttcaggccagtcaccttgttccagccgatcttcgcatcggcaaaaaggctatctgttgggtagtcaaagctctgccagaaaaccatggatgagtttgatgaactctgcagcacaagattaccatcgttcaacagcacaacaacggtgccgttggttgtggtgttaacacgggtagaccatatgatggacttggtagcctggtccatgatgaccatgtttccgtcgccggatattgttagctccggtgaagcggggtccaccactgggttttcgccattggcggaccacagtggagttatcatggggagcttgttgtaccatatgcaaaggtaagagttgcggctggtgtaggaggagttcttactgtccatcttgaagaagccgagagcgaacttgctgttgttggagataagcctgtcaccgccggccagtgtttggccgggtgacaccgtgtccgtagtggcatagctcgtcggagggtgcagggagagtaggaggaggaagccaagaaggacagacatgatggacaggacagtgaagaaagggaaggttagtggaggactggaatttgtaaggaatatgatcgattctgacgactgtgatgcaatgtttcgaagccagaccagttctgtgttttttatttagacaatatcagttctatgatcagttctgtgattttttagacaatatcagttctgtgttcagctctcagaatccaggtcaacgtcatggtgtgggtgcacgtcctaatcagtctgtattaagaactgacagtgggttaacctcgatcttaataatcttctcattggtcagacctaaacaatgcatcgttttgactgcgtaataatatgtgcaaactattcaagaaatatgtttgacatctcttccagcaacttccagttgagttaatcttttagagaaccccttttttttaaaactttgcagttcagtggaagttctttcacgacatcaatgcaatgggcgctgcttgttggagacttcttccattttttggaccaatatatcatgcttttatctccaaagggaaaacttaatccatgccaaagatttaagcactgatgagatcaatctgatattctttttccaacaggaaatcaatttcatgatgttcacagatttgggcaaaagcatgaccacgcgatgcgatacaatgatgccaacttcaaatcatcaaatgggttttgaatttggcactatgagaatgctgcatagtccagtacatggccgacaaaaaagtagtccagatatgcaagaagtgaagactgaaactgaattagggggagtcaaccagacgagtaaaagaaaatgttcagcacaggcttcatatcagaaagaatgacgcgcattgcatgtttgcatgtgcgcctgtgtgtgttgactgttgactgttgactgttgacgctgagccgcaaatctatctcgtggtcacgccgagatctgcaatttttggaagtgctagctggtataaagccaagagcatttttaagagtgggaggcaaaggcattttctaatttgaaaccactttggattgcaatcggagagcatactggagtagctctttctttcttttttaaataggctacaaaaatacccgtgcgttgcaacaagtgaaggctattttaatcttgttattgttatatggtttaggtaggatgaaatttattgtgttaaaatcgcttggatatatattttgttagaaaatcatgagttacaattaggagtccgatcgtcttaagttgacatacgagctttttttaatgagatttcttatacgatttcttttgtatttacaaaagtgaacgaacttaaaaacgggcttaaatacggatctgtgtttccaaaagcgaatgaatttaaaaactgactcatagacggatggcgtaccaaagtaccggcaaaaatatcttcaatttttataatagtagagattaagctgatttatttttaccgatctgtcctatataaaaatttagtccatataatacaattaatacttaagttatcaagtcatgataaaataaaatatgtttagtgatttttttaaattactagaaaaaatgcccgtgctttgcaacaggtgaaactattttttcactgaaattcactgtgagaattcatttagatatatatttttctaaaaaatcatgttaagttagcatgcgagttttttttaaaagaatttcttatacgactctttttgtattttcaaaagcgaatgaacttaaaacccgactcaaatacggatatgtattcccaaaagcgaacgaacttaaaaaccgacttatatttggatgtgtcagggttacggataagatataccctctacccttggatgtacgctatacgacaatattgtacatcggcgcgtgtacggacattctctgtatacgttaaggaaattcatctcgaagtccaccaatgcaaaggttcctacccgtataagactgggtcgtcaatatatcgtgcagagtccgatgtctctgagtcctacttggagaccacctgacctgcgatataaaagggaccccccgggaggacctaagggatcgaatctcatagccaacacagtgaccacaacctacgaagccagagtttgcaggagccaagtcaccgggtgatctagtcgaatcaactcgactacgatctcgtcagtatcatcgagttctgttatttcctttgtaatttgtggttctctccatataatcccatatcaattggattagggctattacctattaaggggcttgaaccagtataatctttatctcttgtttccttgatgtcatgctacgtagatcctcgtaccagcgtaccccaataccctctatatccggtctacgggtacccaccgtcgacagtggcgtgccaggtagggggacttggtgctcaagattctactactatgacatcaagcttcatcgacaacatcatcaacaccggccccattcaaggagtccctacttcaacaatgctgttgtggactcaagtcggcgaaatcgtcttcccggtttacaccacggtaccaatctcggctgatccatcaatgaccgatcccatgtcgaaggatcctcccgctgtagcggagaacggaacatcgacgtcatacgagcccgagaaggttcctagtgcggccaaaccttgtccttccgacaagaaccgcgagccgacaaggacaacttccgaggtaacaaagttctggtgtcctatccacaagtccaggaagtacaacttgcaagcttgctgggtttttctcaacgtacaagctgaaattcgtgcttgcaaggagcatggaatccagcgtacttctctaactcgtgatgtctattgtcctattcacaagacgaagaatcacgacttcttaagctgcaaggtctttctccgcgccatgaaaacgacgcttcctaaggtccagcagtcaggaacctcccttaaggatacagacaaggaacaaggagcgacgttgacctcggatcgattcattggagtaatcgacatcgatccccacgagccatcagtcctacacttgctcgaagactatggctcgtcatctgacagtacaccacgcgacgtgtttgccatcgatgggactagcacgtctgcacacgctaacgcagaggcggagaaccagacggtcacaccggcccaacaccttggcaccgtcaacgcaatactgagagaagctccctatgaccccgtgcttaacgatgatctcgcacgatggacagaacgactacgggaatcggtagctaatctcagtaacgcgttcgaggaggccgcaaccagagcacaaccagaacgaccgacaactgacggtgccgacggcgaaccaccggagcagcggacgtcgcctagacgagctacccctccacctcgcggcaccagcgatctttgcgaccatctgaatggccgccgagaagcacgacgcgcgcgagacaacgagaatcgttcccgacatcgtgtttcttcacgacatcgcgagaacgaagagcgaggaggccgctcgaacgaagaccaacaccaccataatcgtcacaaccgccgcgaccacgacaatcgcgaacagcggacaccagacgatgctggtcgaggccgtcaacatgacggtgatgataatggggatcggcgccaggacaacaatggtggacgacgacagaattctcgagaacctgaacgtcgcctcggaatcgcacaccggagccgagtgaatcatcgtcatcatcttcatcttcgtcatccgatagacatcgacggaggacacacgatcgccgacaacccaccgcccccagcgccgggtgtagagctttcaaccgttctctacgtgatgttcgatggcccaagagattctgacccggagcaatagagaagtacgatgggagcactgaccctgaagaattcctccaggtctactccacggtactatacgctgccggggcagacgacaacgcgttagcaaactatttgccaacggcgttgaaaggttctgcgtgtttggtgctgatgcacctcccaccctactcgatctcttcatgggcagatttgtggcagcagttcgtcgctaacttccaaggaacttacaagcgccacgcgatcgaagacgatttacacgcgttaacatagaatccgggtgaatctttgagggactatgttcggcgctttaatgagtgtagaaatacggtccccgatatcaccgatacttctgtgattcgcgctttcaaaactggtgtcagagatcgctatactacccaggagttggcaacaaggcgaatcacaactactcgaaggttgttcgaagttgtcgatcgatgcgcccatgcagacaacgcactgagacgcaagaacgacaagccaaaggcgagaggagagaagaagccagccaaggacgcacccaaatcaagcaagaagaaaagcggcaagagtaggaagaggaaagctcaaccggaagtcctcgcatctgaatacgagcgcccacccaaacacccaaacccacaaggcagtgatacgaagagaatatggtgccccatacacaagtcggacagacattctctggaggagtgcctcatcttcaaaaagtcgctggaaaagcaactggctttggagaagggcaagcgagtacgtgtagtcgagaaggccactgaggcaaccactcaggactcagactcggcgtacctagattccgatcttcatgtctcgcacatcttcggaggttccacagcgtactcttcaaagcgagaatacaaaaaagtggagcgtgaggtttgttcaacatggtatggggttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctagcagcggaaattaaataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagagtttcatttgcaaaagcagcatttagcaaacatttgagaatttaataaaacagttaagtattaaacaatattaatccaacgctatacaacataccctgttgtacaggcccaaccattctgaacaaccatcccggctgcacagttctatctccaaaccaggaatgtaccattccaaaccaggagctaatcaaattattaccaattatagcatcatttactatggtgagaagggtgagactaatcacgaaagacattgttagacccgcccataaccgctggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccatcaaaaccatgtgctcacaacccaccattaccaggttttagttggcacattaattaattaatcaatcacgattgaccatcgtgaactatcattaggccatcattaaataatagtgagtcataagttatcccaatagtgagctaatgtttctaaacagggctaagcaattatatctaatatctagttgaaccaatataaataaagctcaactagttaaattataataacccaaggtatcaaggaataaagtaatcaagaacaaaagggctataacaatgaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgattttttaaagattaaatcggattaaaacacttaaatcggtttaaattgaattatgacgcaataatgaattatttttgaaaaggaaaaggggatttattgcgtcagcgggctagggtttgggtggaccggcgcacgggcggcggttcacacgaacggacggccgagattgatccaatccaaaacggacggccaagatcgatcggtccacgaccggctcacgggagaggatcccgatgacgtcaacgatgacgtcaccgacggcggcggcggctcggcagctgggtcggctcgggcggcgcacgcttgccggcgaacggcggcgcgagaacgcaaacggaaggcaccgggacgaagcgggcggcacggcgaactcaccgacgaccaaaagagcgacggagaagcaacggacggcgacggcgacgaggaggaagcggcggctaccttcgggttgtcgacggcgacgaagctccggcgggttccgacggctgcgaaggggcggacgaggacggcggcgacttggcgatgacgacggcggtcttcccgagcgacggcgacggctggaacgacggcggcgcacggctggagcggcggcggcgaaggcaaagctagggcacacggcgctagggctactccggcgacgagaggcgaaggcgagggctgcgacgggtagaggagacaccgggggtccttttaaaggggctcagaggcggcggcgaaggcccacggcgacggcaacggcgaaggaaaccttcggcttggagagagggaaaaccgatccgaatcgaactcgattccaaagctttccaaagcgatttaaccaaagattccaaaggagaaaaggtagaggagatcccgaggatcatttcccctctattgattcggccggagaaggaaaggagcggccggatttggaaaggaaacggcggcggcgcgaaactagggtttcgggcggcggcggccgaaggtagacgacgactgacgggtgggccccacctgtctgcgacagcgcgctcgcgcgggcggctgcggactgggccggactgggccgagagagagaacggttttgggccgactttcggcccaaagccaaaagagactttttaaaacctttttcaatttaaattattccttaaatgcaattccatttattaaaaatactttcttagctcaaataaatcccagaaaaatctaggaattatagaattaagcaaagtatttaatgaaattttatctggcccctttttatattggaatttattaattaaacttagattttcttttcaagacttttaaaattatttctaaaaattccatttaaacaacaatttatatattttgaattttcagggtgtgacaggggttgcacccaagatgaagtggtctgaacagaagatcgagttctcagatgaggaccgccccaaggctactgttatcccaggacgatatccgatcgtggttgaacccactattcggaataacaaggtagtgcgagtcctcgtcgatggcggcagctccatcaaccttctcttcgccagcaccttggacgcaatggggattccacaaagcgtgttgacacctaccgatcaacccttccatggaatcactcagttttcgtccaagccattgggcaagatcacgcttcctgtgactttccgccaagcgagcaacttacgaacacagcagataacatttgatgttgctgagtttgacacagcatacaacgccatcatcggaagaactgcactcgcgaagttcatggccgcatctcactacgcgtatcaggtactcaagatgcccgggccgaagggaacaatcactattcaagggaacgcaaagctggcggtccaatgcgacaagcggagcctcgacatggtcgagcacacgcccagcccacccgccacagccgagccacccaagaaagtgatcagaacgactaagacgtcgaaatcagacggcacaatcaaaatcgttccactctccagtgccaaccccgacaagacagtcaagatcggagcatcactgaacgagaaataggaactcgcgctcatcaccttcctccacgacaatgcagacatattcgcttggcagccgtccgacatgccgggggtccccagggaggtgattgagcacaaactcatggtgcgacccgatgccaagccagtaaagtaaaaactgcggagatttgcaccagatcgaaaacaagccatacgagaagagctcgataaacttctcaaagctggtttcatcagagaggtactccatccagagtggctagctaacccagtcatggtgcggaaggccaacgggaaatagaggatgtgcatcaacttcaccgacctcaacaaggcgtgccccaaggatcacttccctctccctcgaataaaccaactagtggactcaacagctggttgcgagctgttaagcttccttgacgcttactccggctaccactaaatcagcatggcaaaagaggacgagaagaagacaacattcatcacgccgttcggtgtattctgctatgttaaaatgccgtttggactgataaccgcaggaaataccttccagcgtacgatccaaggggcacttagcgatcagctgggtaacaatgttgaggcctacgtcgatgacattgttgtcaagaccaagacaggtgactcattcattgatgatctacgggaaaccttcgataacctcagacgatatcgcctcatgctcaatcctaagaagtgcacgttcggggtaccgttaggcaaactgctcgggttcctcgtctctggcagaggaatagaagcaaaccccgagaagatcaatgcaatcgagaacatgaagtcgcccacaagactcaaggaggtacagaagctaaccagatgcatggggcactaagtaggttcgtcgctaggatgggagaacgaggacaacatttcttcgctctgctaaaaaagcaagacaaatttgtatggacacaggcagccgaagaggcgttcatcgcactcaagcgctacctgtcaaatccccctgtacatgttgctccccaacctaatgaagagttatttctctatattgccgccacgccctactctgtgagtactgtcattgttgttgaaagagaaaaggtgcagagaccagtctattacgtcagcgaagctctccacgacgcgaagacaaggtacccacagatccaaaaactgctctacacggtaatcatgacgtcaagaaagctacgccactacttccaagccaacagggtcatagttatctccgccatccctcttggcgaagtcgtgagaaacaaagacgttgtcgtccgcattgcgaaatgggtagtcgagctaagccagtttgacgtccactttgtaccacgaacagccatcaagtcccaggttctcgccgatttcgtagccgattggactatgcctgaaaacaggttagacagtcagaccgacaacgaaacatggacaatggcgttcgatggtgtgctcaacagccaaggagcaagtgcggggttcatcttgacatcaccttcgggagatcagttcaagcatgcaattcaccttaactttagggcgaccaacaacacagccgagtacgaagggctactcgttgggataagagctgcagccgcacttggggtcaagcgactaatcgtaaaaggggattccgaactagtcgcaaaccaggtgcacaaagattacaaatgctctagcctgagttgtctaagtatctcgcagaagtcaggaagctggaaaaaagatttgatgggatcgaggtccgacacgtatatcacaagaacaacatcgagtcggacgatctagcacggcgtgcgtccagacgagagccactcgaacccagcacctttctggacatcctgacaaagccatcagtgaaagaggcaaacgacgaagatagcccagtcacccccgacatcagctcgggggctacagaggcagagcgcgatgttgccgacatcgagaccacggacgactggcggaccccactcattaaattcataagcagcgacgagttacccgaggatgatgcagaagccgagaaaataacccgtcaagcaaaaatctactgtatgatcggcaacgatctatacaagaaggcgccaaatggggtacttctcaaatgcgtctcgtccgacgacggcaaacacctcctcctcgacatacacaaaggggtctgtgggtcacatgccgtcggtcgtacattggtcggaaaagcctttcgacaaggatttttctggccaaccgccctcaaagacgcttgcgacatggtacaacggtgtgaaggttgtcaatttcatagcaaacacacaaagctaccagcgcaagcactgcaaaccatccctctcacttggccgttctcatgctgggggctcgacatactcggtccattcctacgaggacagggcagctacaaattcctattcgtggcaatcgacaaattcaacaaatagatcgaggcaacatccacgggggaaatcaaggctgacaacgccatcaaattcatcaaggggatattttgcagatatggattggctcaccgcatcataacggataacggctcccagttcatcagcgccgatttccaagattactacgtcggactgggagtcaatgtcacgcccggaatttctatccaaaattccaaacgcttacatgtgtgtgaaccctcgtccaggaatcagccgaggcacacaataacaaattgataatagagtgcaaatattactctaattaataagcgaataaaatgtcattacagaggtagatagttcctctcaatcaataaagttctaagcagcggaaattaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaattttaacgaaacagttaagtaataattaaacaatattaatccaacgctatacaacataccctgttgtataggcccaaccattctgaacaaccacccggctgcacagttctatctccaaaccaggaatgtaccattccaaaccaggagctaatcaaattattatcagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccatgttttagttggcacattaattaattaactaatcacgattgaccatcgtgaactatcaataagccatcatgaaataatagtgagtcattagttatcccataagtgtactaatgtttctaagcaaggctaagcaattatatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaattcggattaaaacacttatattgattttaattgaattatgacgcaataatgaattatttttgaaaaggaaaaagggatttattgcgtcagcgggctagggtttgcggtggaccgggcgcacgggcgacggttcacgcgaacggacggccgagatcgatcggtccacgaccggctcacaacggacggggacgatgacgtcagcgatgacgtcaccaccggcggcggcggctcggcggctcggacggcgcacgctcgccggcgaacggcggcgctttggcacgaacggagagcaccaacgggtagcggacggcacggcgaactcaccggcgaccaaagcgacggcggaagaggaacggacggcgacggcgacgaagaagaaacggcggcggtcttcgggttgacggcgacggcgatgctccggcgttcttcggcgactacgaagaggcggacgaggacggtgacgacttggcgatcccgacggtggccttcccgagcgacggcgacgaccggaacggcggcggcgcacggctggagcgacggcggcgacggcggcgctaggttgcacggcgctagagctcttccggcgacgagaggcgaaggcgagggtggcggcgggtagaggagacaccgaggagccttttaaaggggctaggaggcggcggcgaaggcccacggcggccggcgacgagaaggaaagatcggggtttgaaggaaaaagaccgatccgattcgaactcgaatcaaacacattccaaaccgatttagccgatgtttccaaaagagaaaaggtagaggagatcccgaggatcatttcccctctatcaatacggccggagaaggaaagggacggccggatttggaaaggaacggcggcggcgcgaaactagggtttcgggcggcggtggcgtgacgaagatgacgaccctgacaggtgggccccacctgtcagcgggcggacgtgtgcgcgcgcggcggcggactgggccggactgggccgaggagagagagagcggttttgggccgactttcggcccaaagccaaaagagatttttttaaaacctttttcaatttaaattatttcttaaatgcaattccatttattaaaaatacttccttagctcaaataaatcccagaaaaatctaggaattatagaattaagcaaagtatttaatgaaattttatctggcccctttttatattggaatttattaattaaaattagatcttctcttctaggcttttaaaattatttctaaaaaattccatttaaacaacaatttatatattttgaattttcagggtgtgacaagtcagcggccggctatatctcgtggctgaacggggcatgcgctcagctcgaaggcatcggcaagcatatcgacgaggccctgaagcaggagtgccgtcgatcgagctggtttgccgaagggcacgtgctggcatgtatacgagatcatcgtccgcagttgcacctcgagttcttccacgagggattttctcgttctcggaggactcccgcggaggtagacaacctggcgaagtcgatggcgccgctggcggagaaagtcttccagtcgatggattggcgttggccttcctggtagtctttgtatatctgtgacaagcatcttagattaagtgtaatatattttggaattttttgcagcctgtaaggaatacttgtgaaatagaaaggaagtctatctaactaagctttcttactctggatgtggtgtgtacgagtgtcttctcacttcgcgacttcgatcattcacttgagttatacactcttcctagcccccagccttgtcgtcggagaattcttctcggaagataaggctcttagacctttgacttgccttagttgaataaacactgatcctagcccccagccgtgaagttggaaaatccatttccgattacacggcttggttaatacgcacggcgagaactcttacacgaccagatcttatatggtctttcgtctctgaagaatccgacaaggccttatcagctctgggcatccccagccgaagttcccttagattcctcggaggccttgtcaagacggcgtaaagggacatgtgaataggtttcaacactaggtatcatctgggtaagggatcatcgggaagggacactttgattgaaatttgcatcttaaaacaggctttattgaagttgtaaggtgtcttacaagtatggatactattgacttatacataaaatttacgcaattggtcaatcttccacgaatttgctaactcgcaaccgtcgccgtctgcaatcttgaatacgcctggccgcaagacttgtgtgatcgtatacggtccttcccatttgggtgagagtttgtttcgccctgcttggctttgaactcgccggaggacgtagtcgccgatcgaaagtatgcgtgctcggatgcgcttctcgtgatagcggtggagggcctgttggtagctagctgccctaacggcacccgttctcaatgttcctcgagttggttcacgtcatcgtttcgctattcctcctgatcctcgtcagagtacttctgtactcgtgtactctgatgtcgtaactcggtagggagcatggcttctgaaccgtacatgaggaagaagggtgtctccttgttggacattgtcggtgtggtgcgcacggcccatagtaccgaggggagttcttcgacccacttcttgtcatgtgacatgagcctgtcgtagatatgggtcttgatcccttgtagtactatgccgtttgccctctcgacctgtccgttactctgagggtgagaaaccgaggcgaagcagatattgactgtcacaccctgaaaatttaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcg

SEQ ID NO: 17563 - DNA, 8871 bp, Oryza sativa
gggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacttagacaagttcgtggtggtctttattgatgatattcttatctactctcgaaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttccaagattgctaagcccatgacacgactgcttcagaaagatgtgaagtacaagtggtcggaagaatgtgaacagagttttcaagaattgaaaagtcgcttaatatcagctcctattttgattttgcctgatccaaagaagggttttcaagtgtattgtgatgcatccaaacttgggttaggttgtgttctgatgcaagatggaaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcacggaactgtatggttgggtgagagaatctgtgtccccgacaacaaagatctaaaagatgcaattctgaaataagctcatgatactttatactccattcaccctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcggaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcagaacggatatcctaagggaagcagaagaaaaggtaaagatcattcaagaaagattgcgtgtggctcagtctcgtcataagagttatgccgacaatcgccgcagagatttaagttttgaagagggagattatgtgtatcttcgtgtcacgcctctacgaggagttcatcgttttcataccaagggaaaattggcaccgcgttttgtgggaccttataagattgtcagtagaagaggagaggttgcttatcagttggagttacctcaatctttggcaggagttcataatgtgttccatgtttcgcaattgaaaaagtgtttaagggtacctaccgaacaagctaatcttgaccagatagaagtccaagaggatttgacttatgttgagaaaccaatccgtatcctggaaacaagtgagagaagaaccaggaatcgagttatccgtttttgcaaagtccagtggagtaatcactcggaagaagaatcaacttgggaacgagaagatgaattgaagtcagctcatccgcacctgttcgccagttcttccgaatctcgaggacgagattctgtttaaggggggtaggtttgtcacaccctgaaaattcaaaatatatataaattgttgtttaaatggaatttctagaatttattttaaaagtcttgaagagaagatctaagtttaattaataaattccaatataaaattgggccagataaaatttcattaaatactttgcttaattctataattcctggatttttctgggatttatttgagctaagaaagtatttttaataaatggaattgcatttaaggaataatttaaattgaaaaaggttttaaaaagtctcttttggctttgggccgaaagtcggcccaaaaccgttctctctctcctcggcccagtccggcccagtccgcagccgcccgcgcgagcgcgctgtcgctgacaggtggggcccacccgtcagtcgtcgtctaccttcggccgccgccgcccgaaaccctagtttcgcgccgccgccgtttcccttccaaatccggccgttcctttccttctccggctgatttgttagaggggaaacaatctccgggatctcctctaccttttctcctttggaatctttggttaaatcgctttggaaagcgtcggagacgagttcgattcggatcggttttccctctctccaagccgaaggtttccttcgccgttgccgtcgccgtgggccttcgccgccgcctccgagcccctttaaaaggacccccggtgtctcctctacccgtcgcccccctcgccttcgcttctcgtcgccggaagagccctagcgccgtgtgccctagcttcgccgtcgccgccgccgcttcagccgtgctccgccgtcgctccagctgtcgccgtcgctcgggaagaccgccgtcgtgctcgccaagtcgccgccgtcctcgtccgccccttcgcagccgtcggaacccgccggagcttcgtcgccgtcgacaacccgaaggtagccgtcgcttccttctcgtcgccgtcgccgtccgttgcttctccgccgtcgttttggtcaccggtgtgttcgccgcgttgtcctctacgtgctggtgccctctgttcgtgccgtagcgccgccgttcgccggtgagtgtccgccgcccgagccgtcttcttcgccgagccgccgccgtcgtcggtgatgtcattgttgacgtcatcgggatcctctcccgtgagccggtcgtggaccgatcgatctcggccatccgatttggatcggatcaatctcggccgtccgttcgcgtgaaccgccgcccgtgcgcccggtccacccaaaccctagcccgctgacgcaataatccttcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattaacctattgattgttataacccttttgtacttgattaccttattccttgataccttggggttatattaatttgactagttgagctttatttatattggttcaactagatattagatataattgcttagccctgcttagaaacattattacacttatgggataactaatgactcactattatttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgttttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactgataataatttgattagctcctggtttggaatggtacattcctggtttggagatagaactgtgcagccggggtggttgttcagaatggttgggcctatacaacagggtatgttgtatagcgttggattaatattgtttaatattacttaactgttttgttaaaattctcaaatgtttgctaaatgctgcttttgcaaatggaaccctattatgccatcctttgtatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgcactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcatttcataatctcttttaatggttctcattcaaaatttattccagtgttattagtactgtacatctattactgtactaatggctcatttaccagcaaaagttttacaatactgttttatttaatcttgctgcaataaaataaatttagcatgttgattttataatttcttttcatttcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacaatgtcctttgtcattggatttgggactgcccctttttatgcccagattcctcatgatagtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaacccagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgatgaagacgagccttcaatcgacctccgatgcttagaagaactagagtgacttgttaagtcgttgtcttagatcgttgtgttagtttgcttgcttaaagtttgcttgtgtgtgtctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctgtcctaagtagttccccgttttcccttcttgtgccctgtccatgccagatggtgaatactcgcagcaacgggaatggtcccaacaaccccaataataacaacaatggagagaatcccactctggcccaagttcttgctcaacagacacagcttatgaacatgatgatgcagcaatttcagaatcagcaaaaccaaggaaataaccatgcacctcctcagaataagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcgggagtagtgtctctcaagaagaaggagttcaggtcgctttcccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattaccctgatttccagaaattagtggataaggctattcgtcaggaggacaagtacaattgcatggagcagaggaaacgtcggattgctcacttcaaggcacaacaggggagtaatcagaagccgcgtcttactttaggaccccagtctatgccacagggaggttcttcgtctgttgttcgtccgcaacgtcagttcttcaacaacaatgttggcaacaacatccgtaatcaagctccacgtcctgttgcagctccagcacagcaacaacctgccaagagggagcaaggcaacaagcccgtggtgtgtttcaactgtggagacccaggacattatgctgacaagtgtccgaagccccgacgcgtgaaggttgtccctgcccagaataactctgctgtatcagcatccaaggctcgtgtaaatcatgttgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggtcagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacagaaaagtaactctcaacagctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtaccaggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaa

SEQ ID NO: 17564 - DNA, 2330 bp, Oryza sativa
gtcagtcttataaaagaagcgtcgaatgggtaggataccgtcaagtgattaatcctaatatggattattagtcagaattatacggaatttcaacgttcataaaacaaataaatatatttgcttggccgtccaccttgggtgatatttaagcacattagtacccttaagtactttaaaatatttaatttaaagtttctaaaacaacatgtacagatttattttacaaagtgtaaaaatgtatttatttattatatattataataaaaataattaaatatatatttttgagatcgttcgtaacttcaataattatgtaaccgggagggagtacgtaaaccggtcatattgccagagttaaatcgtcgattgatctagaattgaatgccattgccatatatgctcagtgtaacgagctttagttcggctgctgctggagtcaattagtagatcggacgattagtcgcgaatcagcctgattaattgggccagcccggccattttggcgtccacgtcgccacaactcgtcacgaatggcagagtcgtatcggtttgtcttccgtgtaccactgtaccagtacagttggccttataatcgattggaacggccgtcattttccacactttttcgtaagcagaaatgcagcgtttcgatatgtcttctttagctattctgtgagcttccttgtttagccaaaccagtgttaaccacccttgcctctgaggaggagtttagtatcttttagctgctgctccttaaatacacatatctcgttgctagtagggattaatttattaatgttccactgcaaaatttccaaaatttccgaaattccaggtctactggtccctgatagaatattatgttggcaaaagaaatagttttttaattacacatatcttatttaagttaatcaaaatttgttcaaatttcaacttatttcggtctgaaattttgacaatttccctgaaattgtttctatcggttccccggtagaaatatatgcaaaccggtatgtagaaccgtggttacaggatgcacgcttttatcttggagtccaaaacagcacaagcgaaaggaagggcctattcagattgatggcattttcaactataccgttatttggtaaaatgtataattatgtggctacgtttagtttgtaaccaaatattggcaatgtgtatagaattttggcaatactattaagccaatcctaccaaaattttggcaacgttgccaatttatcaaaattttagcattgccaaattttgataaggtttattttggcatcaatctgaatggacccgaagttatcattgagtagtcatggttcctgatcttaattcgttcatggccatcttgtttatgtgcaaacatttcagagcgagtatgagaagttggtccaccggatcgaggacgccgatgagccttcccttctgcggcacggcggtggtgagttcgcagagtttctggatgttgagagggggaaccaccctactatcataaaggtatcgatccccacctgactatataaaaactttcaaatatggattctggtccctccaactccaaagtgtgtcccttgcacagagtttctcaactcatttctcaccatgaccctgaacttctgtgcttaacttggtttggttctctgctggatgatttaggttctgtgggataacaacaggagcaggacaggagatggcttccctcgtctgatatacgtctcaagggagaagagccccaacctacaccatcactacaaggctggcgccatgaatgccctggtcagtgctacatagctctttttgttactagagaaattttacggttattgagagagtatatgtagataccgaaattttgcaacacaaattttaatacatcgaggtactaagttttacaccagaaaatatggtacctctcggtacactatttgttactaaacaacatggaaagttcagacaatgtttgttactcaccaacacggcaagttcagacactgtttgtgttactcatgattggggaagttcagatatttgattgttcttaccatgattttttgtcagacaagggtgtcagcactgatgaccaacgccccattcatgctaaacctagactgcgacatgtttgtaaacaacccccgggtcgtcctccatgccatgtgccttctgttaggttttgacgatgagatcagctgcgcgtttgttcagacgccgcagaaattctacggtgccttgaaggatgatcctttcgggaaccagctggaagttagtttgatggtacacaactagctcttgcttgtacgataatttatttaatttagttgatg

SEQ ID NO: 17565 - DNA, 8131 bp, Oryza sativa
tggaatggtacattcctggtttggagatagaactgtgcagccgggatggttgttcagaatggttgggcctgtacaacagggtatgttgtatagcgttggattaatattgtttaatacttaactgttttattaaattctcaaatgtttgctaaatgctgcttttgcaaatgaaactctactatgccatcctttgttatcctgtgcacttgcatatttgctgcgtggcttgctgagtatgtcatatactcaccttgcaatcattcatcagaggaagagttctacaatgatgctgaaggtgtggaggattaggtgtagccttggtcaagctgcctgtgaagtggagccgtctgcgccgtttatctttctttccgctgcttagatctttattgattgagaggaactatctacctctataatgacattttattcgcttattaattagagtaataattgtactctattatcaatttgttattgtgtgcctcggctgattcctggacgagggttcacacacatgtaagcgtttggaattttggatagaaatttcgggcgtgacatgactcctcgggattcccgcgaggtactcgcagttcccggcagacgacgaccatgctgtgcaacaactcctgaggtacgagttgaaccacacctcgcgacctcggagtgcctccacggcccggtccttcttcacttccaacatagccctctcaagtttggcgacctcgaacttcgtcctctagtattggatgcgacggtcgtgatcaacgagcgaactctcgaggtctgctcggcaagcaaacaaccaagttaagctgctctccttttccgagagcacggcaatttaagccaatccagatagaagagcaaaggagatggagacaaaaagaaccaacctaaaggaatcgtcgccatatcctggttcacaccgtcctgcggcgcgtacggctcaagtgcgagtaccggagcgattacaggcaactcaggctgcccacgctgctggatatcctcgacatcaacgtctctacaagcaacacaaagtactcgaaatcaagacgctaagggaaactgaggcgataactgcatatagaaaggcagttggaaccaatgaaagttttacaaagcgcgattggttaaggggtacaggcaagtggcgtccctacttttcgaaaagtgggagaacggactcccccagatcgccaacttcttccatcacatccttgcgcgcgtcgctagccgccccctgatccaagatcttttggagatcgagttcagggtgcgccaacctcacgcatgcgaggacgtggcacgccccggtgttgatcccattggacgtctcttccccgatcctggccgcgtgcttggaggggatcgcctccatcgccgtcgccagttctgcgagcgaagacgtcaatgagaactcgtcagggttcgccgggatggtagttttggcaccacattccctggcgagctggtgtaggccggtgtaggtgacccgcaacgaacctcggatctccgacaggttgttctcgagttccgacatgcggttctcgagcccctgtcgttgccgctcgttgccggccaccagttccctcattttctggaggtcctcgcagacctccgccaagtcacgcgcaagtttgtcgtcgcgctcgttcgtcgacgacgccgccgccgccctcgcctccgcgatctcgcgacttatgccgcgagcaccagcctcgaggaggcgcctcgtctcgacttggagcacctcccaggtgaggacagcagtaggcaggcctcgaccgggcgcaagatcgctggcagggccgctgggcatcacctcgcggctcctgggcacgaccacgacatcggacgaggccactgcaggagacgcgctggagttccctccagaccccttttgcgccaccttcgcccgcgccgccctacgaaagacggccatgttagtcatcataacaaaacgccagaacccgatcaagtcaagggcctcaaatctcgtccacttacttctcgccgagtgtcaccagcctctaccgtcatggaggcgggggagacgcgtccgaggcctaagtaaaccaagtacgatatgagggcgacatttttcgactatgtaatcgataacccaaaaggcttaccgagggggtgggcgccttccggcggttgccgagcacagaggaaaacttcctccctttccttggaactttgccgccgctgctcgtagcagcagcgacggcaatggccgcgtcggacgcttcctgggcaacgccctccttcaacgaatccgccacctggtggtccgcgagcggcccgatgatgtcagtcaaggggagagcctgcacaacatgaagtcacgatgcgatctaaaagttaaaatgtaaagggtcatcgattacactcacgttgattgtggcttcgcgttcagccgcttctttctcgcaaagaggggtgggggcgttgctcaccatcgtgggatcactgatcatcacctaggcaacacggcgctccacgattgcgctgttcaaacctgtagatcgagaaccaaatttcgataagtcaggaggaatgcgcatcaaaggagagaaacccagaatacaagaaaaataccccgaggagaaacccgggtcgcgtcctccggcccagagtagtcaaaggctggataggctcaagcctggagcggctggatccgtctaccaatgaagtcggcagcgacttcataccccgacaaccctcgtactcggaggtcatcgatgatatcgatgaaagactgtagggatggggtcaaggcgggtttggtggtccaagacggaatcatgtctggttgctcctcaggaacaatgaagactggatccgaatcttctatctgaagatagaaccacctcgcccgccatttgctacgagaagaggggcactggaaagggatgtatcgcgacttcaagccatcccgaagtcaaaaaccaacacacccggatacctttttaggttccatccagcgcaactcgtagtaaaaacggaagaggtcaagaaacggctctaccccaatgtaggcctcacagagatgagaaaaaatgctaaggaaggctatggagttggggttcagatgaagcagagaaagaccgtagaagttcaagacgagaaggaaaaactcagaaggcggaggaagaaaaccacagagaatgtagtcctcaaccgcaaccatgcggcccaggacgggttcaggttcagtacctcccggttccctctccatagtcctgcgaccgaggagagcgccctcctcctgcaatttcttcaaggacgcactgctggaggtggacttgtcgaggtccatcgccgttggagatcgccggagaagaagccgaggcgagcgaattagggtttgcgtggaagcggagaagacgaagagcgtttagaggctagaaagttttcgcaccagccggactcaaaaatggattcccaaaactcccttaaataggcgcactaccgacggtgcgaattccaaggaaaggagagagatggccgtcggaaatttctgggtccgttgcgcgaggcggtttctcggacttcaatttaaattcactcataaccgttgaacttcgcctggtgttgtcgatcactccttgtctctacgatccccacaccgagatcgaccagtcgagaacgacaacaactccgacatcagaagtcgtgatcggttataggagtttatttaagcagaagtcgggggctactgtcagggttacgaataaggtataccctctacccttggatgtacgctatacggcaatacggtacatcggcgcgtgtacggacgttctctgtatacgttaaggaaattcatctcaaagtccaccaatggaaaggttcctacccatataggactgggtcgtcactatatcgtgcagggtccgatacctccgagtcctacttggagaccacctgacctgcgatataaaagggaccccccgggaggacctaagggatcgaatctcatagccaacacagcgaccacagcctacgaagccggagtttgcaggagccaagtcgctgggtgatctagtcaaatcaactcaactacgatctcgccagtatcatcgagttctgttatttcctttgtaatttgtggttctctctatataatcccatatcaactggattagggctattacctattaaagggcctgaagtataatctttgtctcttgtttccttgatgtcgtactacgtagatcctcgtaccagcgtaccccaataccctctatatccggtctacgagtaccaaccgtcaacaggatgacgtaccaaagtgtcggtaaaaatatctttaatttttataatagcagagatatgaactatcaaacagcttatcaaaagtcagtcaagaacgttatctatacttctttaaaaaaaatagtagtgatgatgttggttttattgctgcgtgcaccacatacttctattttcttgtgagaaaaaaaattacaggtggggctagcaggcccatatccatatgttaaacatctcctaccaactatctattatttttaaaggaaaaagaataacgagggattaaaaggtctatatatcagtaacaaatatatgtaattgttaacacattggtatatacaaaaataatggttaatgatattttttaattgtatgttatatatgctcatctgaagcggactcttgaagtgattagactcgtaagctacggatgagctgccgtaaaaatgaaataaggacgtatggacagataggcttaatcatcccacaagatatataaccgagacaaaaataattagtactaccttgaccttgactatggccttgcgaacatgtcgttcaagtcatccctaaccattagttagatgaggatttctgatatgatgacgcgtatgatccctaaaaaatagggaaaaaaacgaaacgcgtgaatagaatcacgtagcgttgaatatctgctgaaatatggaaataaaacatgttgtttagtactccctccatcctaaaatatttgacgccgttgactttttaaaaaatgtttgaccgttcaaattattcaaaaaatttaagtaattattaattctttctctatcatttgatttattgttaaatatacttttatttatacatataattttacacatttcacaaaagtttttgaataagacgaatggttaaacatgtttaaaaaagccaacggcgttaaacatttagagaaggagggagtaacacacagtaggaaaaaacatagaaactttcgccagtcaaacctaactttaacactcaaacaacacttcttttcaaacgccagtcaaacctcagctcacccagagatcttaaggtaataatctcgcaatatgttttgcgcaccaacagtgtatgcggttgattactcgctgaaatgttgcttcattcttattgaagatctttgcgcttcattctttcctaattttccaggctatgagcatgaacatttatttcgggccttttcttgtggttgcatccgggcttgttgttcgttgtgtccacaagtccaataaggattggctcatgctccaattgaggataattaatatgaccatgccgcagccttattagaactcctgtctagatttgcttcgagattgggcattagaacatcaggttgttcattgtttccaaattcatgaaacaaagttggcagagtagtagtcgttttgccattccctaagctgcaggcaatctctagtccataccatgttttgtagcagcaaccaaccgaaaatcttgcactttgtcggggctcaactctcccaaattggccttaccgatgctgattcaattattcccctaaattgtatttggtaagcagaagactaacgaccatgatgtcttcctccaaaattcgtagaaaactacccactactctctcgggctgacaatattagtcgttttgaataaatgtaaagtcaaactttaaaatatttgactataaataatttctaaaatatttattttaaaaatatgcaaaccatatgtgcagattagtcttgaaagatttttctatatattttataatagaaaatagttatcaaagctactttttggagaccgtacccttgtccaaaacgataagtattaacaatccggtgggagtacataggaatttcaaatgaatttgcgagctccatttctttgttccaaaggatcaaatttctttgttccaaaggatcacatgagaattcaatcatccagaaatcccttttcaagattcacctctagatcttggttgtccaccagttgaaaacttgtgcagatttatgcatattctagcactatgctggatcaggtcatatgtgatgggctcgtacccttacctatgacaggttaagccatcgtcacagataaatggtcaccgatgacgttgagttatatgtgataggtaaagttacctttgacggaccgcaactaaaatccatcacaggtaacctttatctgtgacggggaattattttaacttgtcattggtgatctttgtctatgacaggtcataactgggacctatcacaaacgtgaaaaatagggcaaaaaaataaaaatgccgtccgcctagccgtccgcctagctaatcactaaccttcattaagcattcatgaaacacaaaaagcatcacattcatattcatctaggcataagatagaatcacaaaaatcatcactatcagattcatctgggcacaaaacaaaatcacataatcccaaatagaagaactcccctgccattagaggcagaggcggtggctggcccatggcggaggcagagtcgatagctggtgcctgaggttgaggagttggcagtcggcactcacggcggagaaagcagccttcggcatgcggacggagtcatcggccagcacgaactagcggtggcggtgaaagggttgtggttgcgggcgcgagcgcgagcgcgagcggtgaatcgagagagagattgagagagagaaagaggatggggggatcgagagagggggggcgggttgaagagataaggttcagttggatggggcgaatagataaggttacactagttaccagtgacaggtaaaataaagagtcattttaggttatttcgtccttttttctgatgtactaaatttataaatatgtcataagtgttaggtttgtgacgggctgacaggtgagcccgtcagacgtttcgggtgcatatatggacccgccatggataactccttatctgtgatgggcctgcgcctgtagcctcatctgtaacgacatctagtctaatccatcacagatgagggcatctatgatgaagtattttggctcgtcacagataagctatctgagatgatccgatctagcgtagcgtagcatgctagaattatgagtgtctgttccaacagtattcaagcgtgtatagagaatgcatccgtgtgtatgccggtgagtgtacagagagaacttggttggtaactggttagtggccacaaattttttgcacttcttgtatctactctataaaagcacagttgtctttcttccattccaacaccatcaaaactgcttcccacccatcctacgtattagaaattaaaaacaaaaatacatgaaaaaaaaattaaacgatgttcctcgtgtcccgttacaagggtatgtgactactccctccatcctattttaagtgcagccataattttccatgaacaactttaatcatccatcttatttaaaaatattttgaaaaaaaattaaaaacataagtcacgtataaagtactattcatgttttatcatctcatgacaataaaaatactaattataaaacaattttaaataagacggacgatcaaaattagacgcggaaacttatggttgcggacagaggctccgtcccagaatatagcaacctaagacccttctgtccagattcgtagtagtaggatatgtcccatccggttataggttgctatattctaggacggagggagtactttgtaccatatgcgaagtctagttcatcaatggattcctattctatactccctccgtccctgatataagagcatgtacaatagcagactataagtcaactacaaacatattttaaagagataaaagaggagagagaagatc

SEQ ID NO: 17566 - DNA, 6113 bp, Oryza sativa
ccaaagttcaccatattccctttttagcacttccgtcaatttttccgtccgtcttgatggttattgatccagccacacacatgatatgacatttctacccctcattaacatgcattatacttgtacttgtgaggggtagaaacgtcatatcgtgtgtgtggctggatcaaaacggacggaaaacgatcgagaattgacggaagtgttaaaaatgggaacatggtgaactttgggtgctattaaagttaaccggtaactttcggtgctataaaaccaaaaacgtgatctttcgatgctataaaccaattttgccaatttaatttgtttgtcgggaagcatatctgcttcagatatccgccatgtctgctccagatatccgcacgatcaaaggctagtcggccaactctgccatgaaagatgcacatcagaaatatttgaaggttggagcaaagagcccaatgggccactaaccaaggtgatcttgaacttttttatatacttcatttctttgtggaatttgcgatgaatttgcaagctccgcttcttttttttatatatttttattgaatgggcaaggttagatatattatattatagataattaaagttttgacagagcagaactgcagaagtcaatagaagtactctcattttttataaaaaagaatagagtaaataaaataacagaaggtatatatagcacaaactcctcaacacaacaacacgagagaattgaaggcacctcaacgatgcacctaaacatttttttttatttatctcatacgtgccatttcacaatgttattgtgagttcaatgttgcattttttttataagtttatattcccctaccttatgagttatgaccataatcataattgagagacctccacatccatataaaaattccaccagtaaaagttattaattatacaaaaaaaatttaagggacgtgcagaattgccaaaatcaacgaaatttttttatacaatgagggacaaaaaattacccttctctttctgataaaccaaaacgaataaaaaaactttcattctaccagtcgagcactattcttgatttctttccaatttagttgaaactcattcagaaatctcaatagtctaattccttcaacttttgccaaaattttctaaagactctaccaatttctagcatttgctttaggacattattatgatagtttgtacctttgcgtaggacactctagttgcgtggtttttattcaaagaaacttcaaacattatgttaatatataatgttccaatggagaaataaaactcgtcaaaaaaacaattttaccattgggccaccttccaaactttaaattggtacatatttttgccaaattttaatatatgttgtaaatttaaaatttgtcctaaattatggaattcaaatacattaaatcttttcaaaaaaggaatattaatattgcctggatttaaaaaatatttattgaaatattttgtttttgtatttttggataacttaattttttgacaagtttaaaatcagctaaaatttgttcaaatttgaattatgcaaggtgacaaaaagctaaaaatatcttttgtaaagtttaatctctctactagaaaaggacatatcacatatatataattaaataaccgttggaactatattatcatatgacagtcagaaactaaattgtcgtattacacagtcagaaactagagtgtcctaaaacaagtgttataaatctatgcagtcctatagcaaaaatttgtcttaatcttttttgcaagacaatagtcttttgttagtaaagttcctgtgattaggtattttcaacccttttggccgccatagtttcgtttccttttttctgtcatgtataagactctgttctgttctgctcttttggctttgtttaaaagccaggcaatataattgcctgccgtaaaaaaaaaatatcggcgtggcggccagctcggggatatgatcattaaaaaaaaaaagaaatcaactcacagtatatcattttcccgggattaacaagttcaaaaatcatgaaatttttaatccggaggttaatatttcccgggaaaaactcaggttaaaaagttgaaaactcgagacacgcactgaatttctcttctcctcttcttgtttttccttttgaataggaaacaaatgaatctctgttggatttactgcaaagccagtaagcttctacaccggccgcaccaccacagtgacaacgacatccgtgctggttagagccaaagaaatttatcaacgcgaaccacatgtatggaatcagataatggatgtcgacgcattatactgctggaatatatttaaggaaaaagtacgaattaccccttgatctatcatggtcgtccgaattaccccctaaccacaaaaccggatattcttcacctcgaacttttaataccggacgaattaactctttgacccaaatcagagcggatttatcctatgtggcatacacgtgacagtccaatcagcatttttttaaaaaaaaaaattggtggggtccacctgtcaagcctccacttcacctcttcctaatttctctctccgttctctctcactggtgcatgcgggcgcaacaaccgcgcaagtatggagcggtgggcggacgacggcggcgctcaggggcgggcggcggacggtggcgagtgcgggcagcgccggagccgcggacgacggcggcgcgtgggggcgcgcggcggacggcagcaagtgggggcgtcgcaagtgcgcacggcgacgcgggccgcggacgatggtggcaagtgggggcgacgcaagtgcgcacggcggcgtggagccgcggatgacagcggcgcgtggggcgtgcggcggacggcggcccgcgggggccgtctgggtcccgcatcatctttccagatgcgcgcgggctccacccctgtccgccgcctgtcccgcgcgaacatgctcgctggcccagccttctccctcgtgcgctgtcgccgccgccggtgccccctcgtgcgagcgcgggaagaaagcgacgccgccgtgtgcctcctcgtgcgcacgcggcaccgtcggccccaactagtctgcccccggccatcgccgtcctcggtccccctacgctgcccctggtgctcaagcactgaagcagctcctcgccgaggcccataccgcgctccaccgctgcgacgcgacctgcctcgcctcctcattgcgtgacctctcctcttccgccgcagcgacgtccgactccggcgaggccgcgctaccgccgccgcctccgcgtcaccctcatcccccaccgccgccgcctcagcgtcacccgccggctgccgccgccgcagctccgtgtccaccgcctcccgcccgtgagagagaggaagagtatgacatgtaggtcccattatttttttaatgaatagaatgctaactcagctccacgtaaaccaaaaccaccgcggattgggtcgaggggggtaattcgtccagtttgtatagttgggtgtgaagaatgtccggttttgtggttcagggggtaattcagacgactgtaatagtttggggggggagaattcatactttttcctatatttatctttggccttaatcttgcttctcttctttttcacgatctgcatatgacgcgtggtgcgccatatataaattcatattgacaacttgcgtgagatggttgtcctgcactcgtggtggattttttcacaagtcacgaattcacaactcagccttcgatatactcaattttgtttttaattaaaatgttcgtacagtacacgacgattcccaccttgagctccgccgctcgagaagcatttctgtacggctaccgctttgatatatcatataacacgttactataaattcagacatattccgagggagaatgttcgtacccgatgaaattttttataagagtgcccccatgaattaatcatttactgtacaataccttgttttgcatgatatattaataatatcctaggtttatatcttggactagcgatctctaataccgattttcgggtccaaaccctggtctttgattggtccacgtggcgcagcgagaattcaggttgcctctcctgaaatcgtgccacgtgacgtcccttccttcggcggctttgcccgcttgctccccctttcgcggccccgcctctccccaatccccacctaataaaagagaggaaagaaaaaaaaaaagaaaatagttcgcactctgccctctctccacgggcctcgccgccgccgccgcttcgcatcctctcgtcgtcacaggctcgcagccgccacctcctccgcttagtggccgcctctccccctacccccacctctcctctcgtcctcgttgccgcctctcccatgacgtccccagtgagagcagggcgaggccctctcctcgcacgcgccggcgaccctccatctcctcctcatcgtcgcttgatgggggcgaggagctcggtgacggcgcgcagggacttggggagcagcacgccggcagcgacgagatccgacgaagacaatgcctctcccctctcaagctcggggcagcatggcgacggggctcctcgagcggctgcggctcaaatccggcccgccgccgtcccctcctcctggttgctggattgggggaggagctcgatggtggcaagccgaggggattcgtgtccgccgcacagccccaccacgccgtctcggcctccacatcgcacggagccgccgcacggcctcgtcctcgccgtcgcccggccgcgacgcccacggccggccgcagcgtcgtttattgctgtaccactttgaatgacaccaccggatttggactgcaaatccacctcgccatcacaggcatactacctctacctgccatgtggattttgatgcaggggcaagataccatggatcttggggagatttaagctctttaattgctacgtattgcatttgttcagtaggatcttccttaccgtggatcttgcatgaaatttgctggtaggaatgcacatcttaattaacagattgtgttgtttattagtttgggtaatggtcaaagattaagggaaaaaattgagcatagaagagagagttttacaagttttcgtatattacattttagggagtcacaatatagttaattttaggtaggaggaatcaagaaagtgtcatgtggtttaaaatagaaaattgcatccttgtagagaagtgtctgtggaattagttaaaaacatacacttagtctagctgagtggtttttgttactggttcttgcttctggggtatgcagattagtgttggttagatgatatgtgaaacaaatacttcattttccgtgttctcaggagttcatttgctggcttggacagactatctgaatatttgctaagtttcacttttggaagccaataatttttttcttcattgtatgaacaactaaaactgaataagcagttggaagtaatcagattgttgttggctggtgaatgtgatttgtagttcatgaaaatatatagcatatccatccaaatatatctgacagcaggactatgaattgtgctaacaagtagaaaaagagagtttttatttgttgttgcatacttatcatgtcaaatatcaggtttttatttgttgtaattgcttactgatcatgtcaaacttcttgttttttttccatgtaataatgagaatggaaggagatgagtatttcactagcttgatgaatgatgacagcactgcactgagtcgggaacttggggttctctgaatagccagacaaaattgcagcctttgctgatcgtcgaaagtactctgtcaatggttgtcatggctgggtagcagcaatcttgtattatcttaatactaactggttgcacttgcaaatatcttcagagatgagctaggaagcactatcatgtagatggtatatatgtatattttctgcttttatttgtttacagaacacctgtttatttcgctattagttcagagaactgttaacacatttccgtgcgcatttgtaatgatccagggtgataggaggaccggaggaggcttgcattcatattatcaactattgggatgaatctgagatatgttt

SEQ ID NO: 17567 - DNA, 1343 bp, Oryza sativa
attcctgcagcccattcaaattcaatttcaaactgttgggaaaaatgttatatagaaaaatgaccaaaataaaacttgtagatcttgaaaggctctacaactttgttgttgaccatatttccatttgaaatcatttactatccaaaaatatattatgactaataaaatgaattattacacaacagctatatattttgcactcatagatacaaatacttcaaatggaaaaatagtcatcggtgacgggccttagttatagcccgatagagattaatctatctcaatcgagcattactgatggcccgtcacagatgagtgatccctaacgggcctgattttcatctcaatcgggcattagtatgaaatttcatatcccacctttgatagatcaactaaagtgaaaccttccttgtcggctttgacaccagcgtgtagattcacccaatagcaacggaacaaaggaaccttgaacttgacgaagtttagctcctagatctcctcaatgcggccgtagtatgtgtttgacccaacttgatcctggaatgcatctatacggacgccgctgttttgcactgtgtttttgtcatcttgtttgacggtgtaaaatgtgtatccatttatatcatatccttgccatgtgtctacggtccaagacggtcccatccccaacaactgtactgtctcatttgggacatccatggacattgtcacacgattcttcaaccattcgttgaaccgagaattatgttatcagttaatccattcatcagattgccccaagttctcatctcggattttcgctaagtgctcctcaaagtatgggcctacttccgccatatgttggagcacagcgtaatgagcctacgcataggacgtgtcacgaccggaaatcacccaacaggcgttcccgacgtgcgtgtattattccttgtcccaggaggcaaggtacaccaaaagttgatacaatacagagtttaacaagcggaagcgtaaatagttaatttattacatgggcggcgaaggcccagcacacacaaagacaaacgggaaacaacggaagactagggcgacgaccacaggcacttgacggcaggcacgagctagacaccaaagccttcatcttccaggaactcctcttctgggtttgggaaaaaattgaacaagactgagtacaaccaccgtactcaacaagacacacccacaagtgcagaataaatgcaagggagtacaagggggttataatataaagggttagggtttgcagtaaacagcattaaaagacacttagttgctcaaagctattttgtaaatacggtcctagagctataccatattattaaaca

SEQ ID NO: 17568 - DNA, 4001 bp, Oryza sativa
taattgttggaggctttcacatgaattttaattattctttgcacaatttcgaggatagattttagagtcgatttgggacgcgacaaacctaccccccttaaacggaatctcgaccccgagattcggaagaactggcgaagagatcgggatgggctgccttcagctcgtcttcgcgctcccaagtagcttcttcttcggcgtggttgctccactggaccttgcaaaaacggattacccggttcctggtcctgcgctccatggtgtccaggattttcactggcttctccacatacgtcaggtcttcgcgaacttcaatttgctctgagttggcctgctcggatggcactcggagacatttcttgagttgcgacacatggaacacatcatgcacgttacccaaggaggcgggcaactccagctggtaggcgacttctccgcgtcgagcagtgatacgaaagggacccacataccgaggtgcgagcttcccttttgtccgaaacctgtgcacccctcgcaatggcgtgacctgaaggtacacaaaatcatccactgcgaattccagatcacggcgtcggttatcggcataacttttctgccgggactgtgccacctttaagttatcccgaatgattctgactttagcttcagcttctctcaggatatcagtcccgaacacttggctttctccaacttggtcccacaatagcggtgttcggcatttgcgcccgtacaacgcttcataaggtgccatttgtatgctggcttgatagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaatttagtcgggtaccaagctcttcttggagcttcttccaaaagtgagaggtgaattggcttcccctatcagatacgattttcttgggaacgccatggagactcacgaccctagcgaagtagagctccgctagtttattccctccataggtggtcttcacaggaatgaatcgagctaccttggttaatcgatccactattacccatatagaatcatatccaccttgggtttttggaaggccggtgatgaaatccatcccaatttcatcccatttccattccggcacttggagaggctggagaagtccagccggtcgctggtgctctgccttgacacgctggcacacatcacatagagccacaaactctgcaatttcccgcttcatgctgacccaccagtatttctccttcaagtctaagtacatcttggtactgcccgggtgaatggaataaggactttcgtgagcttcctgaagtatcagctgtttaagttctctgctatctggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttccaacgcggccaaaaatccacgaccaactatgcttaggttcagggcttccatctgttgattaagctcgggtggaatgcctcggacgttgagagtgttgcagtggctctttcgacttagagcgtcggcaaccacgttggccttaccaggatgatagtgtattcccacatcataatccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgcgtagggtagttgccctcatgaggtcgtagctgacgtgaagcataggctaccacatgaccgtcctgcatgagcacgcaccccaatccttggcgcgaagcatcacaatacaccatgaaatccttgcgagtatccggcaagattaacactggcgaggaaaccagcttttctttgagagtttggaacgccttctcgcattgcgggctccacacaaacttctcttctttcttcaacaactgtgtcatgggtcgagcgattttggagaagttctcgatgaacctccggtagtatcctgccaaacccaagaaactgcgaatctgagtgactgtcttgggttgcttccaatcggtgacggcggtcactgtttcggggtccacagcaactcctttagcagatatcacgtgccccaagaatttgacttcggacaaccagaactcacacttgctaagcttggcatacaattgatgttcccgcaactttcccaacaccagacggagatggtgctgatggtcttcctctgattgtgagtatatcagaatgtcatcgatgaaaaccacaacgaacttatccaagtattccatgaacactttgttcatcaagttcatgaagaaggcaggagcattggttaagccgaacgacatcaccgtgaattcatacagtccatatcgcgtagtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgttttgtctttcttctccacaaaaatcacaggagcaccccaaggggaagtactcggacgtatataccccttttctttcaactcttccaactgtttcttaacttcggccagttcatttgctgccatacggtagggtcgcttgtgcagaggagtggttcctggagcaagatctattcggaactcaatctctcgcttgggcggcataccaggtagttcttccggaaacacgtctccgaactctctgactatggggatttctgatagttctatctgatgaagttctgaacttctgacagaggttgggggtgcaaagaaaacaaccggttgttctggccctcggtacagagtaacagtgcgtctcgcgcaatccactaccccttggaattgggccaaccaattcatcccaaggatcacatccaagttcttggtgtctagcagaatcagatccgagggaaaaggaatcccctgaatttctatagggacggcagggctatagtactttgctgtcataacccctccaggggtggtgataagcagagggtttctaagcctttctacccccaactgatttctccccacgaatggcacagatataaacgagtgggaagctccagagtcgaacaaaattgtagcagggatggaatgaacgaggaacgtaccaacgatgacgtcgggagttgtcagcacgtcctcggccgtcacgtgattcacacgaccacggatgacgtcctggccaccgttgttggggcggggaggcgcttggccttgctgacgccttggcttcgggcatttgtccgcaaagtgcccgggttcgaagcagttgaagcacagccgctgcggacctgaagcgtccctgcggccttgaacgggctgcccagctggcgtaggaggatggggcgcacgagtcccttgctgattctgctgctgttgctgctgtgggacgcgcaccacgaattgaggtcgaggcgcggagcgaggtggctgctgctgttgttgctgctgcgaggaggatccccctgggtagggattggtgtagcggaccctctggttagcaccctgctgattgcggaagttcgccaagcggcgcttgtgcgactccagctccttgtgcttggcctccaagcggatgctcttgtccaccagacgttggaagtccgggtagtctccagagactagacgaacagacagctcggggtccattcctgccaagaacttctcttgcttctcctcatcttcc

SEQ ID NO: 17569 - DNA, 1702 bp, Oryza sativa
ttaaattggttcattaaagttcaagttgcttaggcaaataaaataagacaggctccgacatagttacaccacacaccggcgtaaccatgccccacacgactcaacaagaagataaacgagaaagaacacacgcgcaggcctactaactgctcgtctaccgctgcgacgggccagggcggaaggtgagcaacagcgcatcctccgtgctacctacgccggaggcttccccctcctggggaaccacgggcgcaggtgcggcacgaggggtctcgacgaagcaggtccacgccagggactgacgaacaagctcgggcctggaggtgctcttgcgggcggtgatcttctggctgcggcagacgcggcgacgcttgggacggctgtcctctccctgggcgatcttgagctgatgcagctgcgcctccaacgcgtcgaggtccttcttgagctgcaggttctcctgacgcagctccaggatcttcaggttgttctccaccatgccacgacgcaccatctggtggaagtcgatacgagccgcgtcgtacgcctccaccatgcgtgccagatgcacgacggtagcgtcatcctccgagctggcgtctcggaaggtggcgtggtcgcgggctcctccgcgacgagggtggtagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgtggataccccaagaccacgcacatgcctcgcagctccaagacgaagccagtcatgtccaaaccacgacgggtaacgctgccggccatctacaaacaaaaacaaaagaaaagcaacatttaaaagatcagattttgacgataaatgaagcagcaagacaaagagagagtagcgggttttcacaaataataaaggatttttatttttttgaaaatatagctaaggcttgggatctacggctcgtcctagggtcaagggaggctctgataccaacttgtcacgaccggaaatcacccaacaggcgttcccgacgtgcgtgtattattccttgtcccaggaggcaaggtacaccaaaagttgatacaatacagagtttaacaagcggaagcgtatataaaattactacatgggcaacgaaggcccagcacactcaaagacaacgaaaaacagcggaagactagggcaacgatgtcacgtcctgataaattcatcccgaaataaaaatcatcttctaaaaggaataatagaattaattaaaattcgaaaagaaattggcaaaccctaaaatacgtacaagaaaaattcaaatgtggcccggaggattttgttaaattctccttggtctaaaaggagccctcaaattttagtggaattttcagagcacaaataataattgaaaagaaataaacaaagttgaaaaggtttatgaaaagaaaaaccctaaaagaagtcctcttttcccccccccccttccttcttgggccggctcggcccagtccctccctttatattttcccccgcggaccatcggtttcccccgcgcgcgc

SEQ ID NO: 17570 - DNA, 19017 bp, Oryza sativa
ttcgtgagggttcacggccgtgattaataatactgtatagctctaggatcgtctttataaaatggctttgggcaactaagtgacttttaaatgctgtttactgcaaaacttaatccctattattattctcttgtacctcccttgcattaattatgcatccgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacatggattaatacactagcgttcgggaaaaggcaattttcccggtcgcgacaagctggtatcagagccatctcgactgtaggataagccaagtggataaaacctaaggacatattttataaatgaaactatttgcgaaagctcctctttttctccttcccctaatgctatttgcaaaaggtttactcccttcttccttcttcggatttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacctgcagaataagtgaaacaaacaacacatcagcaagaagagttagttcctttaaggtcctatccttagtttctaatctgtctctcccctttgttttccctctctccctctccaaacctttgcaacagatggctgacaatgagaaaggcaataaggttagaagtcaggacattggtacctcaagctcccgagtgaatgaagcaccagacaccagttgtgcggcagtggtccaacacctgattaaccagaacaaattgcttatagagatactacagcagcatcggatgccaattttgaacccgagtcagatgcaatctcaagtgcagttggaggcagtccaagcactcacaccacaagtcagagcaccgccaacatcccagaaggcccctcatgccatgccacatgttgacccaaaagaagcaagggcactacgcaaggaactgtcctcagcagaaaagaaaagcaccaatgcgaaccgaagatgaagtccgtaagatgatcattaccagcacagaatggcctccaccaggaatgacaaaatgtcagagaagaaattcctcccgaggtgcacaacagttgacagagcatcttttagctaatggaggtagagtgtctggtagtgaagattcagatcaagtctcctcagatgatgaagatgcgaagtctccccaaggttttaaccagaataaaatagaacttaaggcatgctctcgttgtggagaaatcggtcatgttgccagctcgtgtgcctttacatgcgttcgttgtgaggaagaccatccacccgataggtgccctatgagcaggatcacttgtttcttgtgtgaaggaactgatcatgtaccaaaagattgtcaactcagttttctgctgacgaagaagatggccgaccaacacgcccattctaacggagagaagcatcaaggaaacacaaatcctcgccaacattacagtttcagcctaactccagtgccaggacagaggaatcaaaatgagaaaagaaaatgccgagttcgggaagatatctgttgcttcaattgtcaaggaatgggtcatttcgccgacaagtgcccaaaaccgagaaacatagctgccggcacgtcagtccacgcaactccctgcaatcagaagcttgctcctcaacgaattgtcatccatgcatcccgaagcagtcctatagcccgcgttgcaacagctccaattccaatgagtgcactaccacaaggtgtcaatgctcaatttcagccccagccaccagctggcaagacagaggccagtatctgcgttgtacctttggaagttccaatacaccagctgagaaatcaagtacaagatgaagaacccgagtgtaagaaagttaatgtttgttacaactgcagtgaagaagggcattactccaaaaactgtccccaaccaaggcaaaatcggcctccacattaccgccaatttacacgaagcggacattcccatcgtattgtggtcactggagcaaacgccgtgcccgtaaggcctcgtgttaatcagaacccatagcagaaacaatgcaccaatgctcctcctgctgcacctgactcggcaataaatcttagcaaccattctctgcatcgacagcctcagcaaagaattgtcgtagatggaagaagttgtgtctctccccgacctactccaggccgagccaagagcaatcaacctccggagggcgataccaagcagaagaccgtcatccgcttcaaccagcaatcagaaggaagcttctcctgtgaatgatagcattatgcagtcctagcacatcatcacagaaccaatcaaggatgcagtcactggaacaatgccagctatatctctccagaatcaaaatgagcagccatgtttgtggttttcagttcgctacttatcgtggtgtaatcgaaagtttgcagcaaccatgtaatacataaatatattcatgtctataaacagtgagcttgctatgcttatggatgattcatgttgagaatacaatgtaccgatgttaagcaccgtccctttttgtttaaggcagtgcctcgtattcatgtaataagggagaaatgtgtaatacagacaagttccatgaggattcgtttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaaccccgaagggtacccgccatgcctctacattgataagatcggatacacctgccgacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgaaccacatcaaggtttcactgaaaggcagcaagccaaaggacctcatcgtccccagaagcgtccgcaatccacattaaagaataccacctgttagagataagccgaaagatgattgaaaaaagagattggcaaagatgttctctagcataaaagaagtaggccgaaaggtgattgataaacagaaacatgctctgcatcgctcacggaagacccctgattgtaattgccccgcaacagtcaccttgtcattaagtaagcaagatgacctaggtaaaaatgtttctatgaaggcaaggagtgaaatcttcaactcggtatcagatgctacacggagtgaaaagtgcaagcaccggttaccaggtaatgccatgtcttgggagatgatccaatgggaaagaacacatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagatagtctacagaggtcagattaaaatcacctctaacaacgaagcttcagatctggcaggatcacgatcagacaataagaagtccagcagtaaaactatttgggaagacgtcaaagcatgccaagtgggataagttggctctgttgagaaacataattcaaaggcaaaattatcgaccctcgcatcgaatagcagaagtagctagcacccggagaccaggaaagctaatatgaggcagtttgtggcaagttagaagtaaatgacaagcctgatatccttatgatgacaagcatggtatcctagtaatgacaagcaggttacgacgcatgacatgaagtggtaacttgtatgaggttgactccaaagatatgaactatgcgaagttctggaacggaagcatcactgaactaccgcaacctagtctgagtcagccaaaaggtgcaccctggtccaagtcaggtgaagagaagattccatccgcaacaggaggtcgagccaagcagtccagagtggagaagttttgctaggcaagtttgttataaaagacgcaacggaagaagtcagacaagaagagaagaccgcccaacctatcttcttgctagcctcctcgaatctcggggacgagattcttgtaaggggggtggatttgtcacgtcctgataaattcatcccgaaataaaaatcatcttctaaaaggaataatagaattaattaaaattcgaaaagaaattggcaaaccctaaaatacgtacaagaaaaattcaaatgtggcccggaggattttgttaaattctccttggtctaaaaggagccctcaaattttagtggaattttcagagcacaaataataattgaaaagaaataaacaaagttgaaaaggtttataaaaagaaaaaccctaaaagaagtcctcttttccctccccttccttcttgggccggctcggcccagtccctccctctctctcttcccccgcggcccgtcggtctcccccgcgcgcgcgcgccgctgacaggcgggcccgcccgccgccctcgctgacgggtgggtcccacctgtcatctccctccccgcgccgcgcccgccgccgcccgtgccctagcgccgccgccgccgtcgaatccgccgcatcccgccttccccgcgcgccataaagaggggcgaattactccccgcgtttccctctcccgtttcccccgttttcccctctctctctccctcggattcgtccggattcatcccgcaatcgtcgccggcgtcttcaatggcggccgagatctccgcgcgcggtttcctctctccccggccgcgctctccccctcccgttgctatatattcgatccccgtgcttcgctcttccgtttccgccgctcgccgctcgctctcgccgtcggattcgtgctcgcgccgtgctcctctctctccgccgtcgccgtcgaccttcggttcgccgccgacgtcgctccggacgtccttccgactcggcgacccctccaccggcttcgccgcgttgtcgccgaccccgtccgccgctccgcttcgcccgtcgactgccggagcgccgtcgccctcggcatcccgacccgcgccgccgtcttcctccgctccggccgccgttctcgtcgtcgtcgttgtcccggggtgagccgaggaccgccgttcgccttcccccttccctcctctctctcgggcgccgctccgccgcgccggtggtcgccggcggtgaccatcggggcgcgggcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaacatgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttgtatggagtttattagagtaaaaagccttttcttttccgtcggtcgtgtagacgctgcagcttcggaagatccgcccttcttggaagttgaagccggcgtttgggaaagtgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccttattattgctattgttattattattaccttgatcaccctagattaaacaaaacctcaactagtggacactctactcatggttccactagtatgaacttaggtagatgcttcgctggttaattaggcaacattaggtggttttataactttagactttgggaattctcatatcatttggacactatggaattgttggattatggtggaattggacatacacctctcttcctctttcaaaacccctaaaacctgttttcggtggagtttgggtgcatgccagttttgggaagtagcaccccggccactataaggattaagctcgggcctctgttgcaaagcactaccgtactaaccacatgtctaatgggtaaggcttaactcggtgctcagtctagtcctgaacaaaaggacacggatagagatggatgaagtcattgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgtgtgtggcgcacccggtctagatcttgttgctaggggctcaaccctggcctgcctgtcccgggataccggccgtaggcagggttgggtcggtacttttgttcacggctaggatgggtgaagggttatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcatgagggttcacggccgtgattaataatactgtatagctctaggatcgtctttataaaatggctttgggcaactaagtaacttttaaatgctgtttactgcaaaacttaatccctattattattctcttgtacctcccttgcattaattatgcatccgccggtgtggcttgctgagtactgtggttgtactcattcttgctcaatccttcccctcttcagtaagagaagcttcggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaaacgaccacaggcgcttgacggcaagcacgagctagacaccaaagccttcatcttccaggaactcctcatctgggcttgggaaaattaagcaagactgagtacaaccaccgtactcaacaagacacacccacaaatgcagaataaatgcaagggagtacaagggaattataatataaagggttagggttgcagtaaacagcatttaaagacatttagttgctcaaagctactttgtaaacgcgatcctagaacgctacaaagttattaatcaaggccgtgaacccacacgaacctgccttaacccaaggcctatgatgattcagaccgaactggcaacccgaccctgggtcccagctcgtcctaagccaacccaggccaaccattccatattttagttgttaagcaaattttaagaattaaaacactaacttgggtacattgctcggcttgcccataaccgagggcgcggctattcgaatagattatactctgatcagaggtgtacatctttacccacaagacacatctttctcacgtgcaaccacgtgccacataccaccacggtatacaggcgaaagacgtgacatagtttccaacccatcctagccatagacaagagtaccgacccaatcccgcctacggccggaactcccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttaagactagactgagccacaaactaagccttacccactagacatgtggaagtacggtagtgctttgcaacagaggcccgaagaccggtccttatacggccgaggtgctaccatcaaaaccatgcaccccgagcccagcctaaaaccattttaggagattttgaatacagggggcggtgtgaagccaattccacaataatccaacaattccatagtgtccaggtgatatgaatatttcccaagtctaaagttataaaaccacctaatgttacctaattaaattgcgaagcatctacctaaaatcatactagtgataccacgagtagagtgtccactagttggggttttgtttattctagggtgaacaaggtaataataacaataacaacaataataaggtcataacaaaggtaaataggcaaggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcggggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgacgagaacggcggccggagcggaggaagacggcggcgcgggtcgggatgccgagggcgacggcgctccggcagtcgacaggcgaagcggagcggcggacggggtcggcggcaacacggcgaagcggacggaggtgtcgccgagtaaggaggaagtccggagcggcggcggcggcggaacggagctcggcggcgatggcggagagagcggagcacggcgcgagcacgaatccgacggcgagagcgagcggcgagcggcggaaacggaagagcggagctcgggcaacgtttaaatagcgccgggggaaggaaagagcggccggagagggaggaatcggtcgcggagatttcggccgccatagatgcgccggcgatgaatgcgggaaggaaatcggacgaatccgagggagagagagaggggaaaacgggggaaacgggagagggaatcacgggagtgattcccctctctttaatgcgcgcggggacggcgggatgcggcgcaatccgcggcggcggcggcgctagggcacgggcgcggcggcgggcgcggcgggaggaaggcgatgacaggtgggccccacccgtcagcgagagcggcgggcgggcccgcctgtcagcggcgcgcgcgcgcggggaggccgatgggccgcgggggaggagagagagagagggagggagaagtgggccgagccggcccaagaggggaggggggggagaaaaagaacttcttttaggattttcttttttttataaaccttttccactttgtttatttcttttcaattattatttgtgctctgaaaattccactaaaatttgtttaagcattttaggcttttaggaaatatacaaaaatcctccaagcctcgtttgacttttacatttgcacattttaattgttggaggctttcacatgaattttaattattctttgcacaatttcgaggatagattttagagtcgatttgggacgcgacaggacgcatgatcgggcctaattcttttccttccgattgtgccaacacctgacaaccttccctcgtgatgagacgcaggaactccgataggatcggcatcggacaggtaattgacgcagaactcaatagcctcctcggtcgtgtaaccttcaatgatgctccccttgggtttagctctgttacgaacgtacgacttcagaactcccatgtaccttccaagcggccacatttcccttagaaaagccgggccacatagttttgtttgcttcaccagatgaacagggagatgaaccattatatcaaagaaagacagtggtaaaaacatctccaggtgacagagggtattcacaatatcggtctgcaacccatctagattttttggatctataaccttctgtccaattgcattgaagaaggcgcacagacattggatcgtgtgacgcactttcggtggtagaatgcctctgataggaactggcaagatttgtgtgattagcacgtggcaatcgtgagacttcattccaacaagttttagatcgtccaatttaacatacttacttatcctcgcttaatagcccgatggaactttaatatccttcaagcatgataacattgcgattttctcatctttcgacaatgtgtggcaggctggagggaggtacactctacctgtctttgcatctcatatgggctggagttcactgcgaatattcatgtcctgtagatcaaggcgcgtgttcaacccatcctttgtcttcccgagaatattcaacatcaggccaaccaaactctcacacacattcttttctatatgcatgagatcaatgcaatgatggacatcaggatctttccagtaaggtagccgccaaaatatggattttttcttccacatacccttctcctttgtgttgttacgttttcttttcttcccacactcattgcttatgtccttgaccatattgtggacctcatctccgaacaaatctttgggagtaggctgaagttctctcttaccgttaaaatatttcttctttcttctaaatgcgtgacgtggcgggacccacctccgatgacccatgtataccatctttcgtgatttcttcagccactggctttgtgtatgttacttgcaatcggagcatgccttctttccttttatagtttgtctggaaagatcaccgagtgcagggtagtcattaatggtgcagaacaatagaactcttagcttgaacaatatgcatcccaagtttccatactttctttccaaagaatctcaagatcgtcgataacaggctccaggaatacatcgatatcattgtcgagttgcctcggaccttggattaataagcacaacataatatatttccgtttaaagcataaccatggcgggaggttatagttcgcaataagaactagccaagtgctgtgagtactactcatgtcaccaaaaggattcatgccatccgtacacagacatatcctcatgtttctagggtcggcagcaaagtctttgtgttttcgatcgatattcctccattcaatcgaatcagctgggtgtctaagcataccgtcattccttctctccgtggcgtgccaacgtactaagttcgcttcgttcaagttggcaaagttctcttgaaacgatcaatgataggtagataccacacaacctttgccggaccacccctctttgacttctttccttcgtcagcacttttctttcgcttgtatcgagaagccttgcagacaggacaagcatccaagtccgcatattgcttgtggtacaatatgcagtcgtttggacaagcgtgaattctacggacctctaagcccagtggacacagaacctgctttgcttcgtatgtcgtctcgggcaatgtgttctcagcaggaagcatagccttcaaaattcctaaaagatcagtgaaactcttgtctgtccatccactacttgccttcagcttcattaggtccaacgtaactgacaacttagtgtgttttgctttgcatccagtgtacagaggcgtctcggaatcactaaccaatgtgctgaacttcatggaatctctctcattctgggctaggtcctcaacgtcacgtaacatgtcttgcagcagatcgtgatccacatcaaccatttcaccgcccaatggacaaggtataaacatgtcatgctcatcttcatcttcttgattatgcgcaccacttctgtctgctgctgctccacttcctgattcttgctctccatccttaacccaacatgtatagcccttcatgaatccacgttgtatcagatgaccgtgtacatcctctccgctatcaaacatattctcattcttgcaatctgcacatgaacacatgtaatcattgtttcttcttttccgatcctcctccgcggcgttcataaaaattattacgccctttctgtactccgtagaatgatgttttaaatttttcgcatacatccaacttcgatcaattgcaaaagtaagacgtgatcaattacaaaataaaaaaaataaattagaggcacatcttataagatcagtattgcaaaagcaagacatgatgaaattgctcaattaatgattaatattactaacttgattgctccattttgatcacttttggaaattttctgttttccttggaaaaaagacaaaaaatcgccccctacatcctcccaccaaaatagtgaacagtgggatacagttacactaggtggtggggggtatttataccgtgcaacaaatatctgtaacagccctaaaacaatcaaccgtgacgggcatacaagtaatatctatcgggccttaataaaagcctatcaaagaagagtgtcatctgtgatgggcattaaacatatctcaatcgggcctctagtttgtcacgccccgaaatttagcccaaatttccagactattttgtgtattaaatccctgtccaggaatcagccagggtacacaaaatgacaagtaataaacagttccaaatgtaaataaagcgtaaatacttacagaagaggctcttagtcctcacaccgaaaagaaagcagcaatagcggaaaaaagcgatcctagcggggctttagctccactccataggcaaaactcaactggggttggagccttggtcttctaacttcatctccagctcagaagcactacacttctgaaaaaggggggaataaaagcaaggctgagtacaaccaccgtactcagcaagccacaccaatgatgcagacgtgcaaggggattttattgagcaaactgatgcagacgtgcaaggggattttattcaagaatggcttgtggctatttgcataaaggtagttgtaaaacattttattgagcaaactggtaaaacagttgagtaattatagtaatattgaatctccaatgatcaacgctacaccatgttgaacaggcccaaccaacccacctgaactacagtgcattgggtcgatttattaagtgtgggactaatcacggtgaatctggtcgatcgcccataaccgtgggcacggctattcgaatagttttactctagccaaaggtgcacaactatacccacaagacacaatccactggcatgtcaccgtgccatcatgtgcccaagatgaacacgtcaccacgtcgagtgattgtgacaagacccttcatataactctcccataaccatccacaccacgctaaggtttcacccccactcctcgcaagtcagcgggcagtcccctcatgcgccacggtgaatccggcagctggacaaccggacaccccggccgacccaactccattatgcccaccctcgccactggtgcctaggaaagggtcgagctatacttcagatcaagcaattatccactcctgcttgtggtagcactgtaagtcttccagggtttccgtgaaccggtccttaattgacatgggtgcgactcacaaaaccatgcatccacagcccaccattcagtcgcattttagttggataattatgaccaattaaacatgtccgggtgtctcgagcacgcagctcgttctgatactaacaaggtccaatactgtaattatcccatcaactaggctagtggtaattaagcatggttaagcatatagttctagctaggtcacaaaagtaacatgagctagtcaatttattacccaatgttgacaaaggatagatatcaagtaaacatggcacaagcgagaagataggtaaaccctgatcccatgtattagcaagacatgcaattttatttccaaacggtaaaacatttgtaaagtaggatcaaaatgctcaaggggaatgtgtgacttgccttacttcttcactttgatcttctaaactcctttcctcgcaacagcggacttccaaaacggcagaaactacactctagcacgcaaaacgaggaaaaactctaataaaaaccaagaaaacagtacataaaaagtaaacagacatgtacagctcaattttagatgaattttgcaagttgaatcgccctatttggagttcgaatgaattagatatgaattttagaagttgttgagccattaaatgaatttctataattattatcggtttatgacgcattaattaaatattttcacaaaggaaaagggctgccgctgatgtcagcaggggaagccggcgccgacacgcgggccccgcacgtcagcggctccaaggggagggcacacggtggaccaagtccaccgcggcctaggcggcgccgtggaccaagagcacgggcggtccacaggcagcgcccaaaatcggcaacggagggagctggcttgccaggcgtcggtggcacaaggccggacggccaccggcggcggtggcgcgacgcagcggcggaaagaggggaatgggagaggagacggagggggtcctcaccgaggggcgccagtgacggtacgacagagctcgggcggagagggggcggcggcgctccggcgacgggcggcgccaacagaggggcggccaaggggcaccgtgacctgaggaaggtgatggatgggttaggcgagcgcggggtgggcagccggaggcaacaaagcacggcgacggagctcacctcgcgcggggcagatggcgttccggcgggggatggcgatgttgaggaggcagccaagggactcctcgtcattgcaaagccgaaggaggcgacggcgcatcgcgaggtggtctgggacggcaacaggaggcggcaaatgcggcggcggcctcaggttggtggtgggggtggtttttcggtggtggttgaaggaagaggagcggctgccggggtggagctcggcatggcgatgctgacggcggcggcggcacagcgcagcggccattagggcagtagtggtggccggctggacgcgacgggaggcggtggtggctcggatgcacggtggaatggcgtttggcggtggttttgtgggttcgaagtggaggtcggggtggagcttgatgcggcgaagccatcggtggaaacggcacagcacggcggcgacgagaatggcggtggtgggcggctgaacgatgccggcgagcggcggaggttggtggcgcggtggggcggctttccggtggctattggggaatatggagtggctgctgaggtgtggcaaagagcggcgaacgcgatggcgcaagcggcgcggcgcggggacggcggcagcggccggctggagggtcgccggtgagcggcggcacttgggctcgcatggggagcacgggaaagggcacgaggagctcagggaggaaggggaaacggaagaggagagcacggggaggctttttatagcgcgagggagcaacggggaggccggggagtggagaatttggagcggcaacggccggcgacgtgggcgacatcgtgggtgaagtggagctcgatcccagtgcgattttcgggggaaacgtggggagagtgtagaggaggtggacgggaaccgatttcatgcagtttgggcgcgagggtgcgagcgggaggagccagaattggtagcgacgtgggcggcaaatgggcggcatggcggctacggcagtgggtcccgcggtcccacttgtcggcctaagggagagagggagcctggggttatttagacttcaaggacgagcgggccgagggagagaggcctgcccgagaggaaggagggagggggaaacaggccaaggagagaggagtgcttgggctattaaaattacttcttgagctccgaaaattcacgggaaatttcagaaagtattttagggcacaaagaatattacaaaatattcccagccaacgatttttaaaggaaatttttaattccctctgtaatttacttgattaaatttctctaacttttatttaatatctaggaaatggattattaaatgatttttaatcccgaacgaaaatcggggcgttacagttggtgcccgtcacagatgactgtcatctgtgacgggcttcttttagggcccgattgagatatggaaccctcatctcaatcgggcctcaactatggcccatcacagataagtgtcatccgtgacgggctttagttttatgccgatctaccatggctatgcgaccatatctcaatcgggcgaaacttcggctcgattgagattacttacttgtgacggcccgcaaattccagtcttgttaggggccgtcacagatggaaggatctgtactagtgggatttgaatttgagcctcctgacagcatcaacttcaaacggacctagctgccgttcaagaaggaatttcggggtctatgatgacttgatggaaagctaatggagtctacttttatatgattttggtcacacgtcaatattcctaatttgttatctggaatcgacaaaacaagccatgtaactcatccagtccgaatctgatttgggcctttggccttgtaattgtgtcgtaggctaaacctaggggggtgtgcggcaaccctaggacatccctaatcatatttattatgtagccataatagtctagagttgggttttgcttggattatttctgccattgaaatttcatcgctagttcggtttgtggaacccctaattcgagtgtttaatcatttttatgcaattgagttgttatctaccttgttattgcttgtgttatttgattagcatgcaggtttgataaggaaagggatgtggtgctgcaattgcagggtttggatcttgttgatcggaagccggatcgtgtgcgttatgtttctgccaaatcgagtgtccgttaggtaaatttatctacccataaccataaaaataccacacaaaaaagtcatttacctagataatttgagccattgcattgttccgctatattttgtttccttgaattttaagttgcatcgtcgtgtcgagtgcttgttcagttttagatttaattttagttttgagtattgcatctgttaatcactttaggtctagtcacgtgagttttgggtctagttctgcatctcgttggttgttgccggggaccttgaaaaatgaatctaatgatcgtcgagtttccgtttttatggtttgtacaagttttcatcgagcggatttagatttgcttggttgctagggcttatgccatatgcttttgcagttttgtattgcacgtaaggaagcaggaagaggacgagagttgtgtcgattggatcggttgcacttttggttcagccgtgcacgacaagtaaagaccgaggttgactccatgataagtctgactttggcaacccatcaagacctatttgaggttttctccgtccggtgcctatactttgtgttttagaaggtggtgactaatatttgttacggaattgaaggtgttgactatccgaccggccgtctcatctgtcgccgactggtatctccgcctacacggctggcctattatgctgccgttgttgggcgtcaacgacttcactgtcggcttgcctccatcgccgccgactggtgacctcgcctatacggttggttggtcacaccaccgttgttgggcatctacaccttcactaccagctgccgtcatcaccgccgactggtgttttcattgaccattaatggacgactttgt

SEQ ID NO: 17571 - DNA, 838 bp, Oryza sativa
ggaccgccgcttcgtttccccctttccctcccctttctcgggcgccgctccgccgtgcctatggccaccgccggcgaccataggggcgcgggcgtgccgcctcccgccggccgcaccggcgtggccgcctccgggagcgcctagcggctgccgcgtggggcccggccgtcagccgcccgcgccctcgggtgcggctgacgcgtggggcccacggcgccgcccggtgtgagccgggtgcacccggtccaccgtggaccgtgagactgccgcgtgggtcccactcccgtggacccggtccgcgcgccctctccccggctgacgcaataaatccatttttttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagcccttttgttttccgttggtcgtgtagacgctgcagcttcagaagatccgctcttcgtggaggttgaagccgacgtttgggaaagcgagcaaggtaagtcacatcatccttgaacatattgaatcctagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatgg

SEQ ID NO: 17572 - DNA, 700 bp, Oryza sativa
gttgctaccttcgggttggttgccatcaccggtattagcactcctcctggttgtcaccatctgaaataccccaaaacaaaccaaccaacagagggagcagactattaaaactaaccacccacgactaccaaaattcttgaatttattactgctattaaattggttcattgaggttcaagttgcttaagcaaataaaataaagacaggctccgacacagtcataccacataccggtacaaccatgccccacgcgactccaacaggaagacaaacgagaaagaacacacgcgcgagcctactaactgcccgtctacttctgcgacgggccagggcggaaggtgagcagcagcgcatcctccgtgctaccaacgccggaggcttcccctcctgaggaaccacgggcgcgggctcggcacgaggggtctccacgaagcaggtccatgccagggactgacgaacaagctcaggcctggaggtgctcttacgggcggtgatcttctggctgcagcagacgcggcgacacttgggacggcagacctctccctgggcgaccttgagttgacacagctgcgcctccagcgcgtctaggtccttcttcagctgcagattctcctgacgcagctccaggatcttcatgttgttcttgaccaacccgcgacgcaccatctgatggaagtcgatacgggccgcgtcgtacgcc

SEQ ID NO: 17573 - DNA, 685 bp, Oryza sativa
gcagctcgtgtagccctcatttgcgttcgagaatgtccatcgacccccgaatttatccatctcccatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggggtgaagccaattccacaatactccaacaattccatagtgtccaggtgatatgagaatttcccaagtctaagttataaaaccatctaatgttacctaattaaatagcgaagcatctacctaaatttaaactagggataccacgagtagagtgtccactagttggggttttgtttaatctagggtgaacaaggtaataataacaacaataacaataataatatggtcataacaaaggtaaataggcatggctaaataaaacagtgataacgcgggaatttaaataaagcgataatgcaataatttaaatcaacataattttacaaactgggattcaatatgctcaaagatgatgtgacttgccttgctcgctttcccaaacgtcggcttcaacctccacgaagagcagatcttctgaagctgcagcgt

SEQ ID NO: 17574 - DNA, 480 bp, Oryza sativa
cctttttgccccctctctcccccttgggccggctcggccgatctctctccctctctctcctctcccccgcggcccatccggcctcctccccgcgcgcgtgccgctgacgggcgggcccgcccgcctccctagctgacgggtggggcccacccgtcatccccttcctcccgccgctcccgccgcctcgcccgtgccctagcgccgccgccgccgcgaatcccgccgctcccgtccgtcccgcgtgcaattaagaggggggaaatattccccgtgattccctccctctttccccccattttcccctccctctctccctcggattcgttcggaaactttccccctaacctcgccggcgcatcaatggcggccggatcttccgcgcccgtttccccctcatccggccgctctctccccctcccaactctatataaacactccccgtgcctccctccgccggttccgccactcgccgctctctct

SEQ ID NO: 17575 - DNA, 10005 bp, Oryza sativa
  unsure (1)..(10005): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttgttagatgtgattttgatctgacctctatagattatcttcaaacatatcacttgttccataactgggaatagctctcacggacaagcaactcggattcactttctttacatttggttcacttcccactattctcttcatgttgtcctcagttagcattcaacgtattcctttacacctttgaccttgatgtgttctttcccgatttctcttatcaatcacctttcgacctacttctttgcctggtaataaacatctttttcgatatcttctatcaatcaccttttgacctttgtcaactaagtactcttcactccgagagttgtggatgcttctggtgacgatgtggtacttgagcctgctgcctttcagagaaaccttcaagtggttcgtcaaaagctagactggcggttgttgcctttgatccaaagaggacacatctgaaactctcagtccaaacaaaagtctctttgactttttaatccaacacagtttaattggttttcttttccatcaacaggttggttattaactcgagattagtatatgattcctctgaaatgagaccctaggtctcctttatcagtgagcaattatacacataatcacatatccgcatcttccaaaagaatcctagtagaacttgtctgtattacacatttctcccttattacatgaatactaagcactgcctaaaaggaaaggtgcttgacattggtacattgtttctgctatgggttctgattaacacgaggcctcacgggtacggcgcttgctccagtgaccacaatatgattgggaggtctgcttcgtgtaaattggcagtaatgtggaggtcgactttgccttggttgcaggcagtccctcgagtaatgccctggttctttgcaattgtagcaaatcaacgtcttctttgctgagctatccgtctggggacgatcattctgacttggagttggaattggtggctggaaatccttgctaacattggcatcagtggtaccatagttgctatcaccatcggagtctttctcagagtcacaattgctagggttgtcattttgggtgccatcattgatactatcgtcgacatcttagtgaatgatgttgacattgcacgcttgattcgagtggtcactaatggggcaagaagcatggttgttggtggtatcatcatcatcattagtattgctaatgttgttgtctgcattgtgtccatcttcttggggcggaaactcttgatgcgcaacagaagatccggtgatctgaagtggctcagtgcgctgtctttggttaccacatggaaatactgggattctgacaatccttctcttacagttcttcatccgattatgctcactttcgagttgtatggctttgtccacaagtttctcaaaatcttcataatcctctaggagtagttgcactgcaagctcatcttttaacccctggagaaacttctcttgtgtgtcttcatccgtctccacatcttctggtgcatagtgagccaaacgatagaactcgtgcaggtactctgtgacggtcaaatctccttgcttcaggtagcgaaactctcgttttctcagtgtgatcattcctgcgggaacatgtgatctcttgaatacagatgaaaactcgtcccaggtgatggtatgtccttctggccgtgatgcttcatagctatcccaccactctgaagccggtccaaccagctgaggagttgcgaagccaacccgctcctggtctgtgcactgaatcaaccccagcttcttctcgactatgcgcaaccaatcactggcttccataggatcgacggcaatggcaaaggttggaggctcagttttgagaaattctgataacttgcactgttgctggactgtaggtactcgaacgttggttgcccctgctgggttgttccaattctgtaatagttgaaaggctgttgccaacatgttggtttggttaaccacaatttggattagctctggtgaggtttcgttgatgcttttctcattcccattggtttgggttctttatcttgtacttgatttcttggctgctgtgctggaacatccaaaggtacaatgccgatactagcctcggtcttgtcaactgatggctggggctgaaattgggcattgacaccttgtggtgatgcactcgctggagttggagctgttgcaacgcgggctataggactgcttcgggatgcatggatgacaattcgctgaggagcaagcttctgattgcagggagttgcgtggactgacgtgctggcagctatgtttctcggtttttggcacttgtcggcaaaatgacccattccttgacaattgaagcaacagatatcttcccggactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaactgaattgacaatcttttggtacatgatcagttccttcacaaaagaaacaagtgatcctgctcgttggacacctatcgggtggatggtcttcctcgcaatgaacgcatgtagtggcacacgagctggcaacatgaccgatttctccacaacgagagcatgccttacgttccattttattctggttgaaaccttggggagacttctcatcttcatcatctgaggagacttgatctgaatcttcactatcagacactctacctccattagctaaaagatgctctgtcaactgtggtgcacctcggaaggtatttcttctctgacgtttggtcattcctggtggaggccattctgtgctggtaatgatcatcttacggacttcatcttcggttcgcattggtgtttttcttttctgctagggacagttccttgcatagtgcccttgctcatcacacataaaacaaatgatacttgcttcttttgagtcaacatgtggcacgccaccatgggtcttttgggatgctggcggcatgctgacttgtggtgtgagtgattggactgcctccaactgcacttgaggttgtatctgactcaggttcagaattggcgtctgatgctgctgtagtatctctataagcaatcggttctggttaattaggtgttggaccagtgtcacacaactgttgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttcggtgacgggttctcaagatcttcactcctgcttcacagctggcttcactgcttccttcgcttcgctagcggatcctgcagtcttccggagcttcggcaaacaactgacgacatcttcttcttcgcaaaactgaccatctagtactagttgaaattcgaagaaggaagaagggagtaaaccttttgcaaatagcattaggggaaggagaaaaaaggaactttcgcaaatagttttatttataaaacatgtccttaggtttatccacttggcttatcctacagtcgagatggctctgataccagcttgtcgcgaccgagaaaattgcattttcccgaacgctagtgtattaatccccgtcccaggaaaagccgggatacaccatacaaacatgatataaaagacacatctttattatatcgataatatttacattattacaaaggcacttaaggcctgacaatcaaaaataaacagcagcggactagtgggcctacggctccatcttcacaggcgctcagctggggtataagccaggactccacctaagacttcttctccaaagcttctcttactgaaggggggagaaaggtagagcaagaatgagtacaaccacagtactcagcaagtcacaccggcagatgcatgattaatgcaagggggtacaaggggataataatataggggttaagttttgcagtaaacagcatttaaaagtcacttagttgcccaaagccatttataaagacgatcctagagctacacagtattattaaacaaggccgtgaaccctcacgaacctaccttaacccaaggcctacgatgattcagaccgaactggcaacccgaccctgggtcccagctcgtcccaagccaacccaggccaaccattccacattttagttgttaagcaaattttaagaattaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcttagccataaacaagagtaccgacccaaccccacctacggccggaacctccgggacaggtaggcaggaatgagcccccagcagcaggacaccagccctgtgccatgacatctcgactaccgggccgcagctcgtgtagccttcatttgtcctagagatgtccatcgacccccgacttcgtccatctccatccgtgtacttctgtttataaccagactgagccacaaactaagccttatccactagacatgtggaagtacggtagtgctttgcaacagaggcccgagcttaatccttatattggccggggtgctacttcccacaactggcatgcacccaaaccccaccggaaaacaggttttaggggttttgagagaggaagagaggggtatgtccaattccaccataatccaacaattccataatgtccaaatgatatgagaattcccaaagtctaaagttataaaaccacctaatgttgtcctattaatcagcgaagcatctaccctaattcatactagtggaaccataaatagagtacccactagttggggttttattttcctagggtgaacaaggtaataataacaatagcaataataatgtcttaacaaaggtaaataggcatggctaaataaaacagtgataacgcgggaaattaaataaagcgataatgcaataatttaaatcaaaataattttataaactgggattcaatatgttcaaggatgatgtgacttgccttgctcgctttcccaaacgtcggcttcaacctccacgaagagcggatcttccgaagctgcagcgtctacacgaccaacggaaaagaaaaggcttttactctaataaactccatataacaagcaggaacaaagcacaaaaatgggttcttgacttcttaaggaaaaattagagacttgaacggtccaattccgagttcaaatggccaagatatggccatttgcaagtttatatgctctttaaatggatatttgcgaatttcttcatttaaattttaattaaaaacccatttattgcgtcagccgagggagagggcgcgcggaccgggtccacgggagtggggcccacgcgtcagcctctcggtccacggtggaccgggtgcacgcggctggcggcggccggcgccgtgggtcccacgcgtcagccgcacccgcgggcgcgggcggctgacggccgggccccacctggcagccgcgggaggcggccgaaggcggcctcgccggctcgaccgacgggagacgcgcgcccgcgccccgatggtcaccgccggcgaccaccggcgcggcggagcggcgcccgagagagcggagaggagagggaagcgagagggacggtccacggctcaccccgggacaacgaggacggcggaaacgacggccggagcggaggaacgcggcggcgcggttcgggacgacgaaggagacggagctccggcggtcggcgggcgaagcgaaggggcggacggggtcggcgacaacgcggcgaagccgatggaggtggcgccgagtcgggaggaagaccggagcgacgacggcggctaaccgaaggtcggcggcgacggcggagagagaggagaacgtcgcgagcacgaatccgaaggcgagagcgagcggcgagcggcggaaacggaagagcggagctcggggaacgattatatagcgccgagagggggagagcgcggccggagagggaggaaacgggcgcggagatctcggccgccattgattgcgccggcgaggattgcgggcgcgattcgaacgaatccgagggagagagagagggaaaagagggggaaacgggagagggaatcacgggggtgattttccccgtctttaatgcgcgcggggacggcgggatgcggcgaaatccgcggcggcggcggcgctagggcacgggcgagcggcggcgcggcgcgaggaggaagacgacaggtgggacccacccgtcagcgagggcggcgggcgggcccgcctgtcagcggcgcgcgcgcgcgggaggccgatgggccgcgggggaagagagagagagggagggactgggccgagccggcccaagaagggagggggggggaaaggacttcttttagggatttttctttttataaaaccttttcaactttgtttatttcttaataattattatttgtgctctgaaaattccactaaaatttgagggctccttttagaccaaggagaatttaacaaaaattctccgggccacatttgaatttttcttgtacgtattttaatgtttgccaatttcttttcgaattttaattaattctattattccttttagaaaatgatttttatttcgggatgaatttatcaggacgtgacaattaccagggcaagcagctcccggagcaggagggtgacgatgcagagccccacgctgcttgggaggttactgcagtgatcctcactggctcacccgagaggacgtcgttggcggtcaccgcgggtggagattccttctccgccgcttgccagaacgccgcactcctcgccatcggcactcttcaccagcgctacccggacgagttgcagcactcgccctactgctaccaccctcgtcgtggaggagcccgcgactacgccaccttccgggatgctagctcgaaggatgacgctaccatcatgcacctggcgcgcatggtggaggcgtacgacgcggcccgtatcgacttccatcagatggtgcgtcgcgggttggtcgagaacagcatgaagatcctggagctgcgtcaggagaatctgcagctgaagaaggacctagacgcagtggaggcgcagctgcgacagcttaagatcgcccagggagaggtctgtcgccccaagcgtcaccgcgtctgccgcagcctgaagatcaccgcccgcaagagtacctccgggcccgagcttgttcgtcagtccctggtgtcgaaactagatttcggcaataataaaagggggtggctatcaagctggaaaagtgtatgggtttggagacgaaggatttatacaggttcaggccttcttattcaagaagtaataccctactcctgtccggggatgaatccgccgagtgtcttattgattgtataatttggagaaaatcaacaactgcccctagaggcacccggatcccccttatatatgggaaggagtccgtgttacaaaagataatctatatccctaacggaatatgcagatacagataaaatacagtcgtaaccgactaagtctcaaggtaattccttgacgtacaagttgagaaacaaacccgaaatacaaataagatattctatccatattcggtatcctatattcagcccaaatatcatcaccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaagacaaaataatagcacaatcgtgcatcatatgacaaaagcatacgcggcacctaaagaggtattatagccgactgctttttagccataataaaaggaatccgagtggttaacactctaaaaggttcacgaatgaacatacttgacaggcatccgaataaaaaactccaaagattacccaccaaatattataaaaattatagtaatgaataagtctaatagcctaggctatgactatttaccataatgaaaacaggcatataacataccaaagaaatgactatggtaaaaacaagtcatttcaagttaacccagacagcttttgtagcctaaaaaagcttacaaaaacagcataacacctttctgtcgggcaccttttaatttgcattgcaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaagcccatttgcacctccgatacccttaacaataaattccgagatccaagcgtcacttcgtcttccccgccggaactctcgccattttccccaatccctgctacagtacagagctgcgccaacaaactagggttcatcattccactcgaatccaccttcgaaaagttcagcaaaatccttcccgtgatccaccgccgcaatccctcacctctccctagccatccctcgaatcaaatcagcgcattcgggtaaaatcgatggcggaagagaaagaaagctttgaaggccaatgggcaccatccgacgtaacggaggagaacctgaaggagatggtggcgcacggcgttctccctgccaaggagatcatcgggtggcggccagcatgcggtgaggcttttccgtcccccgatacacacgaggttgtagtcttttcccatttcttctatggcggcttcgctcttccgacctcaaaatttttccgcgggatattaagcttctatggaatcagcttgcatcacctaaatccaaattccatagtccacatcgccaatttcatccatgtttgtgaagccttcttgggaattaaaccccacttcgctctatttcgccgaatcttctttctcaaaccccaaccgaacaagagtaagccatgtgtagtcggaggggccggatttcagctgaggggaactctgagccagaagtacttctcgatgcccttcaagacttcaaacaaaggatggcatgcgaactggttttatgttcagaaccctgagcctgctcttcccgagtactcttgtcttcctccggtgtaccaagatacttggaactctcttccgatcggggatgaagctgctgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggagaaagataaaagcgagctaagcctgaagacttgactcctgcagcgggcgactccattccacaggcaatccttgacgggcagcgacgaaaccaacctcttcgagacatcttcaactggg

SEQ ID NO: 17576 - DNA, 42671 bp, Oryza sativa
gcggaaacggtggagtgaggcacggggagcgtttatatagtgttgggagtgaaagagggcgaccggaggggaaggaaaccggcgcggcgatctcgggctgcatcaatggcgccggcgaggtttgcgggagtatttccaaacgaatccgaggaagagagagagggaaaagtggggggaaagggagagggaatcacggggagtgatttccccctctttattgcgcgcgggggcggcgggatgcggcggaatccgcggcggcggcggcgctggggcacgggcgaggcggcgggtgcggcgcgaggtaggggatgacgggtgggccccacccgtcagcgagggtggcgggcgggcccgcccgtcagcggcgcgcgcgcgggggaaggccggatgggccgcgggggagaggagagagagggagggagctgggccgagccggcccaagaggagaaggggggggaaaaggacttgtagggtttttctttttataaaacctttttaactttgtttatttcttaacaattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagagaatgaattttaattttgggatgaatttatcaggacgtgacagctgcactgcacagtgtctagctttttccccacggcatgcaaccaatccaaagcatccacggggttattggagctagagaaggtaggtgggcggatgcggaggaactcggcgagtttagagtgttgtgggggtggtggtggagcattctgttgtggcgggttttggaggtggtggaggaaagcggtcatcatgttggcttgctgggcgaggatttgggtgagaatggcgttggtgtctggtggtggtggtggaggcggaggaggaggtggaggtgggttgccctggtggtggtggttgctgccttcaggttggtcgccatcaccggtagcagcatttctcctggtcgtcaccatctgaaaaccccacacagaaccagcaaacagagaaagagctaacaattaaaactaaccacccacgactaccattattcttaattttattactgctattaaattggttcattaatgttcaagttgcttaggcaaataaaataagacaggctccgacatagttatgccacacaccggcataaccatgccccacacaactcaaaaagacaaacgagaaagaacacacgcgcaagcctactaactgctcgtctactgctgcgacgggccaggacggaaggtgagcaacagcgcaccctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagatctctccctgggcgatcttgagctgatgcagctgtgcctccaccgcgtcgaggtccttcttgagctgcaggttctcctgacgcagctccaggatcttcatgttgttctcgaccatcccgcggcgcaccatctgatggaagtcgatacgagccgcgtcgtacgcctccaccatgcgcgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggagtctccacccgcggtgactgtcaacgaagtccgctcgggagagccagagaggatcactgcggtgacctcccaaccagcgtggggctccgcgtcgtctccctcctgatccggaagcggcctggcctggtagtccactccgtgtggataccccagggccacgcacatgcctcgcagctccaagacgaagccagtcatatccaaaccacgacgggtgacgctgccggccatctacaaacaaaaacaaaaagagaaacaacattttaaaggtcagattttgatgataagtgaagcagcaagacagagagagactagacagttttcacaagtaacaaaggatttttatttttgaaaatattgctaaggcttgggatctacggctcgtcctagggtcaaggggggctctgataccaacttgtcacgaccggaaataacccaacgggcattcctgacgtgcgtgcattaatccttgtcccaggaggcaaggtacaccaaaagttgatacaattcagagtttaacaagcggaagcgtaaatagttaacttattacatgggcaacggaggcccagcacacacaaagacaaacgggaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaatggaattataacataaagggttagggttgcagtaaacagcatttaaagacatttagttactcaaagctattctgtaaacacgatcttagaactatacaatattattaatcaaggccgtgaacccacacgaacctgccttaacccaaggcctatgatggttcagaccgaactggcaacccgaccctgggtcccagctcgtccgaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaaccccacctacggccggaacctccgggacaggtaggcaggattgagcccctagcagcaggacaccggccctgtgccatgacatctcgactaccgggccgcagctcgtgtagccttcatttgccctagagatgtccatcgacccccgacttcgtccatctccatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggggtgaagccaattccacaatactccaacaattccatagtgtccaggtgatatgagaatttcccaagtctaagttataaaaccatctaatgttacctaattaaatagcgaagcatctacctaaatttaaactagggataccacgagtagagtgtccactagttggggttttgtttaatctagggtgaacaaggtaataataacaacaataacaataataatatggtcataacaaaggtaaataggcatggctaaataaaacagtgataacgcgggaatttaaataaagcgataatgcaataatttaaatcaacataattttataaattgggattcaatatgctcaaagatgatgtgacttgccttgctcgctttcccaaccgacggcttcgacttccacgaagagcggatcttccgaagctgcagcgtctacacgaccaacggaaaaggaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaattaaaaaccgggtttattgcgtcagccgagggagagggcgcgcggaccgggtccacgggagtggggcccacgcgtcagcctctcggtccacggtggaccgggggcacgcggctggcggcggccggcgccgtgggtcccacgcgtcagccgcacccgcgggcgcgggcggctgacggccgggccccacctggcagccgcggggcgcgcccgaaggcggcctcgccggcacggccgacgggagacgcgcgctcgcgccccgatggtcaccgccggcgaccaccggcgcggcggagtggcacccgagagagaggagggaagggggaagcgagagggacggtccacggctcaccccgggacaacgaggacggcggaaacgacgaccgaagcggaggaaagcggcggcgcggttcgggacggcgagggcgacggagctccggcggtcggcgagcgaagcggaggggcggacgaggtcgacgacgacgcggcgaagccgatggacgtgacgccgagacgggaggaagtccggagcgacgacggcggtgaaccggagctcggcggcgacggcggagagaagatgcgacggcgcgagcacgattccgacggggagagcgagcggcggacggtggaaacgtaggacagaggcacggggaacgtttatatagcgccgggagagagagagagcggccggagagagaggaatcggccgcggagatcgcggctccatcaatagcgccggcgaactttacgggaataaaatcggtcgtatccgagggagagagagaggggaaagtgggggaaacgggagagggaatcgcggggaataattccccccactttaatgcgcgcggggacggcgggatgcggcggattcggcggcggcggcggcgctagggcacggacgggcggcgggcgcggcgcgaggaaggcgatgacaggtgggccccacccgtcagcgagggtggcgggcgggcccgcctgtcagcggcgcgcgcgcggggaggggccggtgggccgcgggggagaggagagagagggagggagagttgggccgagccggcccaagaagggaaggggggaaaagaagacttttagggatttttctttttataaaccttttcaactttgtttatttcttttcaattattatttgtgctctgaaaattccactaaaatttatttacgcattttaggcttttaggaaatatacaaaaatcctccaagccttatttgacttttaaatttgcacattttaattgttggaggctttcacatgaattttaattattctttgcacaatttcgaggatgaattttagagtcgatttgggacgtgacaggtatactcacaatcagaggaagaccatcagcagcatctccgtctggtgttgggaaagttgcgggaacaccaattgtatgccaagctcagcaagtgtgagttctggttgtccgaagtcaagttcttagggcacgtgatatctgctaaaggagttgctgtggatcctgaaacggtgaccaccgttactgattggaagcaacccaagacagtcactcaggttcgtagctttttgggtttggcaggatactatcgaagattcatcgagaacttctccaaaatcgctcgacccatgacacagttgctgaagaaagaagaaaaatttgtgtggagcccgcaatgcgagaaggcgttccaaactctcaaggaaaagctagtttcctcgccagtgttaatcttaccggatactcgcaaggacttcctggtgtactgtgacgcttcgcgccaaggattggggtgcgtgctcatgcaggaaggccacgtggtagcctatgcctcccggcagcttcggccccatgaaggcaactaccctacccatgatttggagttggccgctgtggttcatgctctaaaaatctggcggcattatctcattgggaatcgctgcgaaatatatactgatcataagagtttgaaatacatcttcacctagtcagatctgaatcttcggcagagaagatggttagagctcatcaaggattatgatgtgggaatccactatcaccctggtaaggccaatgtggtcgcagacgcgctgagtcgaaaaagccgttgcaacactcttggcgtccgtggcattccaccggaacttcatcaacagatggaagccctgaacctaagcatagttggtcgtggattcttggctacgctggaagccaagcctaccttgctcgatcaaatccgcgaggctcagaagaatgatccagatatgcatgggatcctcaagaatatgaaaaaaggtaaagccgctggtttcacagaagatgaacatggaaccctatggaacagaaatcgtgtatgcgttccggacgacaaggaacttaaacagttgatacttcaggaagctcacgaaagtccctattccatgcatcctggcagcacgaagatgtacttggacttgaaagaaaaatattggtgggttagtatgaagcgggaaattgcagagttcgtggccctttgtgatgtgtgccagcgtgtcaaggcagagcatcaacggccggtcggatttctccaacctctacaagtaacagaatggaaatgggatgaaattgggatggatttcatcaccggacttccaaaaacccaaggcgggtatgactctatatgggtagtcgtggaccgactaaccaaggtagctcggttcattccggtgaagaccacctatggagggaacaaactagctgaactctacttcgctaggatcgtgagtctccatggcgttcctaagaaaattgtatctgatcggggaagccagttcacctctcatttctggaagaagctccaagaagagttgggtacctgcttaaatttcagcaccgcgtatcacccacagacagatggacagaccgagcgtctaaatcagatcctagaagatatgcttcgcgcatgtgtcctagattttgggaagacatgggataagagtctcccctacgccgagttctcctacaataacagctaccaacccagcatacagatggcaccgtacgaagcgttgtatggccgcaaatgccggacaccgctattgtgggaccaagttggggaaagcgaagtgttcgggactgatatcctgagagaagctgaagcgaaggtcaaaaccattcgggataatctaaaggtggcacagtcccagcagaagagctatgcagataaccgacgccgtaacctggaatttgcagtggatgactttgtgtatctccgggtcacgctgttgcgaggcatacactggtttcagaagaaagggaagctcgcacctcggtttatgggtcctttccgtatcattgcttgacgcggagaagtcgcttaccagttggagctgcccgcctccttgggcaacgtgcatgatgtgttccatgtgtcgcaactcaagaaatgtcttcgagtgccatccgagcaggccgactcagagcagattgaagttcgcgaagacttcacctacgtggagaggccagtgaaaatcctggacaccatggagcgcaggaccaggaaccgggtaatccgtttttgcaaggtccaatggagcaaccacgccgaggaagaagctacatgggagcgtgaagacgagctgaaggcagcccatcccgatctcttcgccagttcttccgaatctcggggtcgagattccgtttaaggggggtaggtttgtcacgttccaaaacgactctaaaatatatcccttaaatgatgcctagaataattaaaatccgtgtgaaagcctccaacaattaaaatgtgcaaagttaaaagccaaataaggcttagaggatttttgtaaatttcctaaaagactaaaatgcgtaaataaattttagtggaattttcagagcacaaataataattattaagaaataaacaaagttaaaatgattttataaaaagaaaaaccctaaaagtcccccttccctcccttgggccggcccggcccatctctcctcccccctctctctctctcctctccccgcggcccattcggcctctctccccgcacgcgcaccgctgacgggcgggctcgccagccaccctcgctgacgggtggggcccacccgtcatccccttcctcccgccgctcccgtcacctcccccgcgccctagcgccaccgccgccgcgaatcctgccgccacccgccgtccccgcatgcaataaagtgggggaaatcactccccgtgatcccctctccctttccccccatttttcctctctctctctcgcgttcaaacgggcggatttgcccccgcaaatctcgccggcgccattgatggtggccggacctcccgtgccggtttccttccccaccggccgctctctcccccttccaacctatttaaaccctgcccgcgcctccctcgcccgtttccgccccttgccgcaccgtctccccgccggaatcgagctcgcgccgttgccctctctctcctccatcgccgacgacctccggccggccttctccgctcgccgggaccgtctcccgcctcggcgtcgcctcctccggctttgccgcaccgccgtcgaccccgtccaccccctcgccgagtccgccgaccgccggaacaccgtcgaccccgtcgacccgagacgcgccaccgccttcctccgctccggccgcctttttcgtcgtcgccgtcaacctagggtgagccgtggaccgccgcctcttttcccccttcccttcccctctcttggccgccgctccgccgtgcctatggccgccgccggcgaccataggggcgcgggcggcgccacctgccaaccgcgccgagtggccgccttcgggcgcgcagagtggccgccgcgtgggggccggctgtcagccgcccgcgccctcgggtgcggctgatgcgtgggacccacggcaccggccggtgcgagcccgggtgcgcccggtccaccatggaccgtgaggctgccgcgtggaccccactcccgtggacccggtccgcgcgcccctccccctcggctgacgcaataaaccctttttaaattaaaatttaaatgaagaaattcgcaaatattcatttaaagagcatataaacttcaaatggccgtaacttggccatttgaactcggaattggaccgttcaagtctctaatttttccttaagaagtcaagaacccatttttgtgctttgttcctgcttattatatggagtttattagagtaaaagcccttttttttccgttggtcgtgtagacgttgcagcttcggagatccgctcttcgtggaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggaatactcttatcacctggacactatggaatggttgaattattgtggaattggattcacacctccccctctattcaaaaccctcaaaatggttttagggtgggctcggggtgcatggttttgatagtagcacctcggccatataaggaccggtcttcgggcctctattgcaaagcactaccgtacttccacatgtctagtgggtaaggcttagtttgtggctcagtctggttataaataaaagtacacggatggagatggacgaagtcgggggtcaatggacatctctatggcaaatgaaggctacacgagctgcggcccggtagtcgagatgtcatggcacaggcccggtgtcctgctgctaggggctcagtcctgcctacctgtcccgggggttccggtcgtaggtggggttgggtcggtactcttgtctatggctaggatgggttggaaactatgtcatgtcttctgtccgtatgccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcctaacagctaaaatgtggaatggttggcctgggttggcttgggatgagctgggacccagggtctggttgccagttcggtctgaatcatcgtatgccttgggttaaggcaggtccgtgtgggttcacggccatggttaataatattgtatagctctaggactgtgtttacaaagtagctttgagcaactaagtgacttttaatgctgtttactgcaaaccctaaccccctatattatagctcccttgtactcccttgcatttattctgcacatgtgggtgtgtcttgttgagtacggtggttgtactctgtcttgctcaatttttcccaaacccagaagaggagcccctggatgatgaaggctttggtgtctagctcgtgcctgccgtcaagcgcctgtggtcgtcgccctagtcttgcgctgtttcccgtttgtctttgtgtgtgctgggccttcgccgcccatgtaataaagtaactattcacgcttccgcttgataaactctgaaatgtatcaacttttggtgtaccttgcctcctgggacaaggaataatgcacgcacgtaaggaacgcccgttgggttatttccagtcgtgacatgcattgtggacgaaacttttaccattatgtggtcgacggcgctatcgaccgatgttggattttccgccaactcagttgatgcgcaactgctgcgtttttaggtgggacttcctaactcttcatacgcagcagcagcggcggcctgggggttctgttgctcttcttggatctcttgcctaatcttggccctcattgactcgagcttttcgtcgaattcagatgtcagctcagctcttattgacgcccggatcttggcttcaaggcgtgcatctttctccgccttgttggaagtccgcttcttgtactgccacgcgtagtctggaaatccatacttctagggaacggaagacccaacgccccgtgtccgtccacgatgttccttgttgcccaacgctttcgtgagaaggtcgtcctcgcgtctttgagagcaggcctcttgcgaggcttattgctcggcaaccaactccttctgcattataatttagtggggttaaataaactgcacgatgggaaacaatgtgaatatctagtttgactagacacttagtatagcttcgtacactcgttgatcttctggattgtcacgtcccaaaacgactctaaaatacatcctctaagatatgcctagaataattaaaaaccgtgtgaaagcctccaacaattaaaatgtgcaaagttaaaagtcaattaaggcttagaggatttttatatatttcctaaaagcctaaaatgcgtaaataaattttcgtggaatttttagagcacaaataataattattaaggaataaacaaagttaaaatgattttataaaaagaaaaactctaaaaagtcccctttcccttcctctccttcttgggccggctcggcccatctccctccccctccctctcctctccccacggcccatccggcctatccccgcgcgcgcgccgctgacgggcgggcccgcccgccaccctcgccgacgggtggggcccacccgtcatccccttcctcccgccgctcccgccgcctcgcccgcgcctagcgccgccgcctccgcgaatcttgccgcctcccgccgtccccgcgcgcaataaagtggggggaattattccccgtgattccctctccctttccccccatttttccctccctctctccctcggattcgtttggaaaccgttcccctaacctcgccggcgccattaatggcggccgggtctcccgcgcccatttccccctcctccggccgccctctctcactcccaaccctatataaaccctccccgagctcccaccaccgtttccgccactcgccgccctctcttcccgccggaatcgagctcgcgccgtcgctctctctctccgccgtcaccgccgagctccggtccgccgccatggacgccccggaccacctcccacctcggcgccgcctccttcggcttcgccgcatcctcgccgacctcgtccacctctccgtttcggtcgccgaccgctggagcatcgtcgaccccgtccaccctagccgcgccgccgccttcctccgctccggtcgccgtttccgtcgtcgccgtcgacccggggtgagccgtggaccgccgcttcgtttccccctttccctcccctctctcgggcgccgctccgccgtgcctatggccgccgccggcgaccataggggcgcgggcgcgccgcctcccgccggccgcaccggtgtggccacctccgggcgcgcctagcggctgccgcgtggggcccggccgtcagccgcctgcgccctcgggtgcggctgacgcgtggggcccacggcgccggccggtgtgagccgggtgcacccggtccaccgtggaccgtgagactgccgcgtgggtcccactcccgtggacccggtccgcgcgccctctccccggctgacgcaataaatccattttttttttaaattaaaatttaaatgaagaaattcgtaaatattcatttaaagagcatataaacttcaaatggccataacttggccatttgaactcggaattggaccgttcaagtctctaatttttccttaagaagtcaagaacccatttttgtgctttgttcctgcttgttatacggagtttattagagtaaaagccttttcttttccgttggtcgtgtagacgctgcagcttcagaagatccgctcttcgtggaggttgaagccgacgtttgggaaagcgagcaaggcaagtcacatcatccttgagcatattgaatcccagtttataaaattattttgatttaaattattgcattatcgctttacttaaattcccgcgttatcactgttttatctagccatgcctatttacctttgttatgaccttattattgttattgttattatttccttgttcaccctagaataaacaaaaccccaactagtggacactctactcatggtaccactagtatgatttttggtagatgtttcgctggttaattaggcaacattaggtggttttacaactctagactttgggatattctcatcacctggacactatggaatggatggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacatgagctgcggcccggtagtcgagatgtcatggcacagggccgatatcctgctgccaggggctcagtcctgcctacctgtcccggaggttccggccgtaggtggggttgggtcggtactcttgtctatggctacgatgggttggaaactatgtcacgtcttccgtccgtataccgtggtggtatgcggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacatgcttaacaactaaaatgtggaatggttggcctgggttggcttgggacgagctgggacccagggtcgggttgccagttcggtttgaatcatcgtaggccttgggttaaggcaggttcgtgtgggttcacggccttgtttaataatattgtatagctctggaatcgtgtttataaaatagctttgagcaactaagtgtcttttaatgctgtttactgcaaaccctaaccctttatgttataacccccttgtactcccttgcatttatcctgcacttgtgggtgtgtcttgttgagtacggtggttgtactcagtcttgctcaattttttcccaaacccagaagaggagcccctagaagatgaaggctttggtgtctagctcgtgcctgccgtcaagcgcctgtggtcgtcgccctagtcttccgctgtttcccgtttgcctttgtgtgtgctgggccttcgccgcccatgtaataattaactatttacgcttccgcttgttaaactctgaattgtatcaacttttggtgtaccttgcctcctgggacaaggaataatacacgcacgtaaggaacgcccgttgggttaattccggtcgtgacatggatttggcatgaagattgtgccatcagcattcttctggtacctagccctggccctgttcctagcccgagggtgtgggatatcgccaaagacgagcggcgtgttcgattcctccgcttcttcatcctcatgctgtcattcctctttcttaccagcatatccggcggtgccaagccggtgcggatgctggttcttggtctggagcaatcgatatgcctcgcttctagctttggactcgggggtcgacttcttcgcatggaattcctcctagacttgttccgtgatccaaggaaatttctctcttagatctggattcgccgggttgtagacgaactcgccgactagcttagtcttgaagttcttccaagcattgcccataaccttgaaagcagtctgcctgatacagtcctcttgctcgataggataatcgaagctctccttgaacattagcccaacaatgtccttctctgcggccagcatgtgcttgatgtcatcttgcagaatactgaatttctgccgacctatgaccccgcagatagacctaaatcggctcaatattttccttggagttgttggcaaccctacttggtccaccgctgttatgcggaaccgttccttagggattttgttccctgtcctaggagtacgtgcccttgaggacccactagttgtcgtcgacattggttcgccttgctgagacatcgtctactttttttcaaaataacgaaaatacacaattcagtgctaaaatctattacaatgaattgaatgtcacttataaataaatgaaacatatcaataaactaaattgcacatctcatccttataaaatgaattgaatgtcacatataaataaactaaactgtcacgaccggaaataacccaacgggcgtttcttacgtgcgtgcattattcctcttcccaggaggcaaggtacaccaaaagttgatacagctcatagtttaacaagcggaagcataaatagttaatttattacatgggcggcgaaggcccagcacacacaaagacaaacgggaaacagcggaagactagggcgacgaccacaggcacttgacggcaggcacgagctagacaccaaagccttcatcttccaggaactccttttctgggtttgggaaaaaattgaacaagactgagtacaaccaccgtacttaacaagacacacccacaagtgcagaataaatgcaagggagtacaagcgggttataatataaagggttagggtttgcagtaaacagcattaaaagacacttagttgctcaaagctattttgtaaatacggtcctagagctataccatattattaaacaaggccgtgaacccacacgaacctgccttaacccaaggcctacgatgattcaaaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctggccatagacaagagtaccgacccaaccccacctacggccggaacctccgggacaggtaggcaggactgagcccccagcagcaggacaccggccctgtgccatgacatctcgactaccgggccgcagctcgtatagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatacggccgagatgctactatcaaaaccatgcaccacgagcccagcctaaaaccattttgatgattttgaatagagggggaggtgtgaatccaattccacaataatccatccattccatagtgtccaggtgatgagaatatcccaaagtctagagttgtaaaaccacctaattttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataatttaaatcaacatacttttataaactgggattcaatatgttcaaggatgatgcgacttgccttgctcgctttcccaaacgtcggcttcaacttccatgaaaagcggatcttccgaagctgcaacgtctacacgaccaacggaaaagaaaaggcttttactctaataaactccatataacatgcaggaacaaagcacaaaaatgggttcttgacttcttaaggaaaaattagagacttgaatggtccaattccgagttcaaatggccaagttatggccatttgaagtttatatgctctttaaatgaatatttgcgaatttcctcatttaaatgttaattttaaaaaaagtttattgcgtcagccgaggggagggggcgcgcggaccgggtccacgggggtgggacccacgcggcagcctcacggtccacggtggaccgggtgcacctgggctcacaccggccggcgctgtgggccccacgcgtcagccgcacccgagggcgcgggtggctgacagccgggccccacgcggcagccgctcggtgcgcccgaaggcggccactgctgcgcggccggcgggaggcggcgcgcccgcgcccctatggtcgccggcagcggccataggcacggcggagcggcggccgagagaagggagggaaagggggaaacgaggcggcggtccacggctcaccctaggtcgacagcgacgacgaaaaggtggccggagcggaggaaggcggcggcgcggctcgggtcgacggggacggcggcgctccggcggtcgacgagcaaaacggaggggtggacaaggtcggcgaggatgcggcgaagccgaaggaggcggcgccgaggtgggaggtggtccggggcgacgacggcggcggaccggagctcggcggcgacggcggagagagagagcgacggcgcgagctcgattccagtcgggaggaagggcggcaagaggcggaaacgaacggatgaggtgcggggagggtttatatagggttggaagggggagagggtggccggaggggaaggaaactggcgcggcgctctcgggctccatcaatggcgctggcgggattaggggagggtttccaaacgaatccaagggagagagggagggaaaattgggggaaagggggagggaatcacggggaataattcccccctattgattgcacgcggggaggacgggggcggcgggattcgcggcggcggcggcgctagggcgcgggcaaggcggcaggagcggtgggaggaaggggatgacgggtgggctccacccgtcagcgaggctggcgggcgggcccgcccgtcagcggcgcgcgtgcggggagaggccggatgggccgaggggagaggagatggagggggagggagatgggccgagccggcccaagagggagagggaggggaaggggactttttagagtttttctttttataaaatcattttaactttgtttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcgttttgggacgcgacaaacctaccccccttaaacggaatctcgaccccgagattcggaagaactggcgaagagatcgggatgggttgctttcatctcgtcttcacgctcccaagtagcttcttcctcagcgtggttgctccattggaccttgcaaaaacggattacccggttcctggtcctgcgctccatggtgtccaggattttcactggcctttccacgtaggtcaagtcttcgtgaacttcaatttgctctgaatcggcctgctcggatggcactcgaagacatttcttgagttacgacacatggaacacatcatgcacgttgcccaaggaggcgggcagctccaactggtaagcgacttccccgcgtcgagcaatgatacggaaaggacccacaaaccgaggtgcgagcttccctttcgtctgaaacctgtgtacacctcgcaatggcgtgacccgaaggtacacaaaatcgtccactgcgaattccagattacggcgtcggttatctgcataactcttctgccgggactgtgccacctttagattatcccgaatggttctgactttagcttcagcttctctcaggatatcagtcccgaacacttggctttccccaaattggtcccacaatagcggtgtccggcatttgcgtccatacaacgcttcatagtgtgccatttgtatgctggcttggtagctgttattgtaggagaactcggcataggggaggctcttatcccaggtcttcccgaaatctaggacacatgcgcgaagcatatcttctaggacctaatttagacgctcggtctgtccatctgtctatgggtgatacgcggtgctgaaatttaatcgggtacccagctcttcttggagcttcttccaaaagtgagaggtgaattggcttcccctatcagatacaattttcttaggaacgccatggagactcacgatcctagcgaagtagagctcggctagtttgttccctccataggtggtcttcacaggaataaaccgagctaccttggttagtcggtccacaactacccatatagaatcatatccgccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttccctttcaagtctaagtacatcttcgtactgccagggtgaatggaataaggactttcgtgagcttcctgaagtatcagctgtttaagttctctgtcgtctggaacgcacatccgatttccgttccatagggttctgtgttcatcctctgtgaaaccagcggctttaccctgtttcatattcttgaggagttcacgcatatccggatcattcttctgagcctcgcggatttgatcgagcaaggtaggcttggcttccagcgtagccaagaatccacgaccaactatgcttaggttcagggcttgcatctgttgattaagttcgggtggaatgccacggacttcaagagtgttgcaatggctttttcgacttagagcgtcggcgaccacgttggccttaccaggatgatagtgaattcccacatcataatccttgatgagctctaaccatcttctctgccgaagattcagatctgactgagtgaagatgtatttcaaactcttatgatcagtatatatttcgcagcgattcccgatgagataatgccgccagatttttagagcatgaaccacagcggccaactccaaatcatgggtagggtagttgccttcatggggccgtagctggcgtgaggcataggctaccacatgaccttcctgcatgagcacgcaccccagtccttggcgcgaagcgtcacagtacaccatgaagtccttgcgagtatccggtaagattaacaccgacgaggaaaccagcttttccttgagagtttggaacgccatctcgcactgcgggctccacacaaatttctcttctttcttcaacaactgggtcatgggtcgagcgatattggagaagttctcgatgaacctccggtagtatcctgccaaacccaagaaactgcgaatttgagtgactgtcttgggttgcttccaatcagtgacggcggtcactgtttcggggtccacagcaactcctttagcagatatcacgtgccctaagaatttgacttcggacaaccagaactcaaccagagctgacaactaaaactaaccactcacgactaccataattcttgaatttatttctgctattaaattggttcattaaagttcaagttgcttaagcaaataaaataaagacaggctccgacacagttataccacacaccggcataaccatgccccatacgactctagcagaaaaacaaacgagaagaacacacacgtaagcctactaactgctcgtctactgctgcgacgggccagggcggaaggtgagcagcagcgcatcctccatgctgccaacgccggaggctccatcctcctgaggaaccacgggcgcgggcttggcacgaggggtctcgacgaagcaggtccacgccaggtgtggagattatggatatcccatatctacacggtgatgatatttgggctgaatataggataccgaatatggatagaatatcttatttgtatttcgggtttgtttctcaacttgtacgtcaaggaattaccttgagacttagtcggttacgactgtattttatctgtatctgcatattccgttagggatatagattatcttttgtaacacggactccttcccatatataagggggatccgggtgcctctaggggcagttgttgattttctccaaattatacaatcaataagacactcggcggattcatccccggacaggagtagggtattacttcttgaataagaaggcctgaacctgtataaatcctttgtctccaaacccatacacttttccagcttgatagccacccccttttattattgccgaaatctagtttcgacagttggcgcgccaggtaggggtagcgtcaagcttctcgccgatcagtgcaatgggttccgtctccggcatcgacgacctcgtcttcccacccgggcagacgtttcggttcggcagcctcgacttcgtcaccaacaacttcggcaagatctctctccttgactcggtgtcagaccagtcgggagagaaccggatttcagtcccgtttggactcccaaacgcggctgaaagttacttcaagaccatctcaatcgagtcggcttcaaaccactcgggtgagatcgcatcttctccaacgacaccagatcaagatgatggggcttacccaccgatcctgatgaagttccccgacgatttggcggccatctccatcatgacagcgtctccatcccgtaggcctaggcggaagtcggcttcaacaccgatttcgcctagcttcagggaagtcggcgtcatcctccaaccactcggcacggtttcgacggatcagctggatgactactacagctcccccaccgtcgactcgcgccccaccgacatcgtggagtacgacgagtattgctctcgctacaacgacccggatctcgacgacttcgacgaaagcctagatgacaactacacccctctctacttcggcgtcttcatggccgataacgagacggaggagcaacgccaagcccgggagaccgaagcacgtcgcgagactgagcgtcgccgactggaggaggagcgtcaagcacaagaacaagaacggctacggcgtgagcagcaggagcgtgagcggatgtcacgaccggaattaacccaacgggcgttccttacgtgcgtgcattaatccttgtcccaggaggcaaggtacaccataagttgatacaattcagagtttaacaagcggaagcgtaaatagttaacttattacatgggcagcgaaggcccagcacacacagagacaaacgaaaaacagcggaagactagggcgacgaccacaggcgcttgacggcaggcacgagctagacaccgaagccttcatcttcaaggagctcctcttctgggcttgggaaaaattgagcaagactgagtacaaccaccgtactcaacaagacacacccacaaatgcagaataaatgcaagggagtacaagggaattataatgtaaaggggtagggttgcagtaaacagcatttaaagacatttagttgctcagggctattttgtaaacacgatcttagaactatacaatgttattaatcaaggccgtgaacccacacgaacctgccttaacccaaggcctatgatgattcagaccgaactggcaacccgaccctgggtcccagctcgtcctaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcctgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttacgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggcggggtgaagccaattccacaatactccaataattccacaatgtccaggtgatatgagaatttcccaagtctaaagttgtaaaaccacctaatgttacctaattaaattgcgaagcatctacctaaatttaaactagggataccacgagtagagtgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgctcaaagatgatgtgacttgccttgctcgctttcccaaccgacggcttcgacttccacgaagagcggatcttccggagctgcagcgtctacacgaccaacggaaaaggaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttgaatggatatttgcgaatttcttcatttaaattttaattaaaaatcccatttattgcgtcagccgggggagagggcgcgcggaccgggtccacaggagtggggcccacgcgtcagcccctcggtccacggtggaccgggagcacgcggctggcggcggtcggcgccgtgggtcccacgcgtcagccgcacccgcgggcgcgggcggctgacggccgggcccacttggcagccgcgagggcgcgcccgaaggcggcctcgccggcacggccgacgggagggggacgcgcccgcgccccgatggtcaccggcggcgacctccggcgcggcggagcggcacccgagagagaggagggaagggggaagcgaatggagcagtcttcggctcaccccggtcgacggcgacgacgggaacggcggccgaagcggaggaaggcggcggcgcggttcgggacggcgagggcgacggtgctccggcggtcggcgagcgaaacggaggagcggacggggtcgacgacgacgcggcgaagccgacggaggtgacgccgagtggggaggaagtccggagcgacggcggcggtgaaccggagctcgtcggcgacggcggagagaagatgcgacggcgcgatcccgattccgacggtgagagcgagcggcgaacggcggaaacggaggaggagagcacggggaacgtttaaatagcaccgggagggggagagagcggccggagagagaggaaacgggcgcggagatctcgggtccattgaaagcgccggcgaggtttgcgggatgaatccggacgaatccgagggagagagagaggggaaaacgggggaaacgggagagggaatcgcggggaatgattcccccctcattatggcgcgcggggacggcgggatgcggcggaatccgcggcggcggcggcgctagggcacgggcgagcggcgggagcggcgggaggaaggcgatgacaggtgggccccacccgtcagcgagggcggcgggcgggcccgcctgtcagcggcgcgcgcgcgggggaggccgatgggccgcgggggagaggagagagagggagggagagaagattgggccgagccggcccaagagggaaggggggggaaaagaagacttcttttagggtttttctttttataaacctttttaactttgtttatttcttttcaattattatttgtactctgaaaattccactaaaatttatttacgcattttaggcttttaggaaatatacaaaaatcctccaagccttatttgacttttagatttgcacattttaattgttggaggctttcacatgaattttaatttttctcggcacaatttcgaggatatattttagagtcgatttgggacgtgacagcggactgcgaaggaggctgaggatcgacggcagcgaactttgcaagcagggcgccgagcgcgtgatctcatcggccaacaagatgttgaagggacaccggttttccgcacccctcaacagaatgcggttgccgcgatcaccctcctcgacaccctcctcaaggaaaacgagctcaatcaatctgatcacgtcgtcaacatcttgaaccagacgaagaccatgattgcagcttcggtcccagttaactccgaaagcgtccacacgccgactggcagccgagtcccccacttccgatctcatgactaccgtcatccaagcctcagcatcaccggcgcaggatccaatcgcaggagcaggggtcacgacgagcggtccgttcactcacctcccgaccatcatagggagcgccgagtggaacggcctcgctcaccacctcgtcgccgccccgtcgatcttcgcgacacaatcatacagcgccgagcagctcgaggccatcatcattcgccggaccgccacgacgacgaccttgacggagtagcagccttcaccgacgacctgcgtcgagtggattggccagccggcttcaagccgactggaatagagaagtacgacggtaccactaacctagaatcgtggcttaccgtctacggtctcgcaatccgcgcagcaggaggagacagcaaggccatggcgaactatttaccagtggctttagcggattccgcccgatcttggctccatggattgccccgtggtacaattggatcttgggctgaattacgcgaccacttcatcgccaacttccaaggcaccttcgagcgtcccggcacacaatacgacctctacaatgttattcagaagtccggagaatcccttcgagattacatccggtgattttctgaacaacgtaacaagatctccgacatcaccgacgacgttatcatcgccgcattcaccaaagggattcgccacgaagaattggtcggcaagttcgggcgtaagcctcccaggacagtcaagcttatgtttgaaaaagccaacgagtacgccaaagccgaagacgccgtcaccgcatcaaagcagtcgggtcccagttggaagccaaacaagggtacgctggctacgggaggaggtggaagtaacaaccataaggaccgcaagcgtaagcctgaggaacttgttgcaaccgccactcactcttcccgacagcgttcgcgcgtcaacacgttcgacaagatcatgaactcccaatgcccgcaccatcctaactccaaccacgtggccaaagattgtttcgtctacaagcagtttgcggagcaatacaccaagactacacggaagaactctgacgaagaacaaagcacgtcgaggaagaaggacgacggtgacaccccggcaggatttcaagaccaccgcaaggagctcaaccatatcttcggcggccccctggcttatgagtctaaaagaaaacaaaagttgactgaacgggagatcaatgctgttcagcccgacacgccccaatatcttcgatggtcagaaattgcaatcaagtttgaccgctcggatcatcctgaccgagtggtccacccggggcggtaccccctagtactagacccagtggtccgtaatgtcaagcttcgcagaaccctcatcgacggcggcagtgcactcaatatcctcttcgccaagaccctggatgatatgcagattcctcgctccgagctaaaaccaagcaatgcgccttttcacggagtaattccaggattatccgcaactccactcggccagatcaccctcccggtcacttttggcactcgggaaaacttccgcacagagaatatcagctttgaagtcgccgatttcgagacagcataccatgccatactcggacgcccggcgttagccaagtttatggccgtcccgcactacacttacatgatgatgaagatgcctggtccccgaggagtcctatgcctacggagcgacatcaaacaagccgtcacatgcgacaaggagagttgcgacatggcccaaacccgcgagatggcgtctgcccgagaggatatccgactggctgcagccacggcgagcgaaggagaagtgcccgctaccaagatttcaaaaagtggagaaagcgaagccaagactaaaaagattcccctagacccttctgattctactaaaactgctgtaataggcgcctagttagattgtaaataggaaagcgcgctcatcacctttcttcagaacaataaagatatctttgcatggaaaccatatgatatgcccggtattcctagagaggtgattgagcactccttacatgtcaaagaagatgccaagcctatcaaacaacgactccgccgattcgcacaagacaggaaagacgcgatcaaggaggaattaaccaagctgttagcggcaggcttcattaaagaagtccttcatcccgactggctggcaaacccggttctagtacggaagaaaacggggcaatggcgcatgtgtgttgattatactgacctcaacaaatcttgccctaaagatccttttgggttgcctcgcattgaccaggtagtcgactcgacagccggctgtgagcttctcagttttttggactgctactcggggtatcatcagatccgactgaaggaatccgactgcttgaagacttcattcatcacgccctttggagcatattgctacgtcaccatgccgttcggactaaaaaacgcaggagcaacttatcaacgtatgatccagagatgcttctcaacgcagatcggccgcaacgttgaagcctatgtggatgatgtagttgtcaagaccaagcaaaaggatgatttgatctcggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactgaagaaaacagatgatttccagtggggacccgaagcacagaaggccttcgaagatttcaagaaactcctcaccgagccaccagtcttagcttcaccacatccgcaggagccgttgttgctgtatgtatcagccacctcccaggttgtgagcacagtcttggtcgttgagcgcgaggaagaaggccatgtccagaaagtccagcgaccgatttactttgtcagcgaagtcctagccgactccaaaacgaggtaccctcaggttcagaagctgttatatggtattctaattactaccaggaagttatctcactacttccaaagtcactcggtaacggtggtcacatcatttccactcggtgatatactgcacaaccgcgaagcaaacggacggattgctaagtgggctttggagttgatgtctttagacatatcattcaagccccgaatttcaatcaagtcccaagcgttagctgattttgtcgctgaatggaccgagtgccaggaggatacccccgcggagaagatggagcactggaccatgcattttgacggatcaaaacgactttcgggcactggagcaggagtagttttaatttccccaactggagagagattaagctatgtgctttggatacatttttcggcgtcccacaatgtcgccgagtatgaggcgctccttcatggactgcggattgcaatttccctagggataaagcgtctgatagttcgaggcgattcacagctggtcgtcaaccaagttatgaaagagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggcggcaccctctgatgttttcgtcgaacacctttatacgccgacagtacctcacaaagatactactcaagttgcgggcactcatgatgtagctatggttgaagccgattggcgagagcccctcatacgatttttgacttctcaagaactcccccaagacaaagatgaagccgagcggatttcaaggcggagcaaactttacgttatgcatgaagctgagttgtacaagaaaagcccttcagggattctgcaacgctgcgtatctttagaggaagggagacaattgctgaaagacatacattctgggatatgcgggaaccatgctgccgcacgcaccattgtcggcaaagcttaccggcagggtttcttttggcctactgcagtgtccgacgccgacaaaattgtgcgcacgtgcgaaggttgccaatttttcactagacaaattcatctactagctcaagagttgcagaccatcccattgtcttggccgtttgcggtttgggggctcgacatggttggcccgtttaaaaaggcagtcggcggttacacgcacctctttgtggccattgacaaattctccaagtggattgaagctaaaccagttgtcacaatcacagcagataacgctcgcgacttcttcatcaacattgtgcatagatttggagtgcccaatcggatcattactgataatggcagacaattcactggcggagtttttaaagacttttgtgaagactttggaattaagatttgctatgcttcagtggcgcatcccatgagcaatggacaggtggagcgagccaatggcatgatacttcaggggattaaagcgcgtgtttttgaccggctaaaaccctatgccggcaaatgggtgaaccagctgccatcagtactttggtctttgcgaactacacccagtcgggccacaggccagtcaccttttttccttgtctatggggcagaagcaatgttgccaagtgaagttgaattcgagtctttacgctttcgaaatttccgtgaagaacgctatgaagaggaccgagtggatgatttgcaccgattggaagaagtccgcgaagcagctttgattcagtcggctcgatacttacaagggttgcgacgatatcataatcgcaatgttcgatcccgtgcctttctagtcggcgacctggttttgaggaaaattcaaactacacgagatcggcacaagttatctcctctatgggaagggccatttattatctctgaagtcacccgaccaggttcctatcgactcaagcgcgaagacggtactctcgtcgacaactcttggaacattgaacatcttcgtcgtttctacgcttaggcttatcattgtacttccctatcttgactgtcaacatcaagttttcttcttgaagttgtcagtcgggggctatcatcataataatggagtggattttttatcaattcaatttgcttgctcggtttatcattgccttgtttggttttttctacttagtctgcgaggactgaaagtttttaatagcttctttgggttttaggctcaacaaagcttgataaaagcttttaagaaatcaacgacttggccagaattatcaagcacagcataaatacaccagtattgtacaagttgagcctccatttgttacatttatactcagtcagaatcagtcttttcatcatcagaattgttactactcggctgaaggtcggtattgcggaattgttctacaacgtcatttgcaatcttgtcagccgcgttttgagcattgctgataagatcaagagcagcttcttcgcttgtcccgtctgcaaagccatcaatggcgtcaatttcaatccttgggtacaaggatttggtcatcgccaatgccatgctagctcccatacttccagctttcttgatattcttgaaatatacatccggagcaactctcagcttgtcgaagatttcggttgcgtcgagtgcactcggaccactgttattgaggaacatagcttggacaagtggtgtagcgacattagcaacttcatctcttgctccttcaagcctcttgatcttaccaaccaggacgtcaaattgagcttgagatttgattttgcggtctacaaaacacatttatggtaaaaatctactgcattaaaaagagagaagtttagattgtcagctggcggtaccttcaacctccttcaaggccgagtccctttgcgcagccagttctactttgtctcttttcaaggcttcaatttgtttctccatttgagccatcctggtggcttgcgctgtttgcaatccgaacggttgaggatatagttctgacagcgtaacttaatgggacagatctagagattaccttttgatgaaccactcagctcgaagtttgaatcctggagctgagcaattcggtcccttaattccttctctgtctttttggcaagctccttggcctcatgtagctggtccctaactgcttcaagagttcccaaatgaggaaccagcttttctaaagttgcggtcttggcctcattgcgaagatggattctctgcatgatggttcatggtttagttctgctaaagagaaaacaaagtcatcaaaggcagtcgcctggaagatttacattcacaatacgagtggcttctccaagcgccttcttcagctggcacacttcctcatcttctttttgacgatttatgacgatgccggcagcttgtgagttctcgtcccaccatttgagtaagataggagggcgagagtcgtcagccgcctttatgcggggaatttcttcttcgtcatcgcctggtggtcctgatgtatttccaagacgttaggcgaataagtaagagttgttcaaactggcatcacttgagaagatgagttacctgagggtgttcctagctgagcgtgaggtgatccttgttctttatttggagacccaatcatcgagtcgttaccagcctcaggtccttgagaagtcgtcgtctgcgcttcaacttcgggaatttcttgatctggacctacatccgactggtttccagtcgggggctcttgagttgtcgtagtttcagttgctgccgactggtttccagttggaggctggtcactcggattggctttatcacctgaagtatgggcgccagtcggctggctctcggcagtcggctcagaatccttggatgaacttggctctgtcacagccggatcaagatcttttccagttggatctatgtcggatggtttcctgcaaagtgtcctttcaatattcagtattatttctatgagagaagcatgtcaaagggaaatggtaccgagaggtttatacctggaagatgttctaatctttggcattgggcggccagccagttttttcctgggagtggtatgctttgggagttttttgggcaagtctttgttcccagatttgttgccgtcgtcgccttcgtcgtcgttaagcaccagctttctcttgcgagaacctgtctgtccagtcggattggaggtttgaggttgcggatctgatctgattgttggccctccacctccctgaacggtgtgttggcgaggagaccggcgctgagtgattggggggtcagacttcatcaatacatattcctgaataagatacctctacggttagttaactcaacatgaagacaagattatgttttggtcatgggttgaagatttcggatacatacctgcggaggcggattgaatgcgttatatggcacaactggcagctgatgtgagtagctgacgacaatagcgtttgagaagattttatacattctctccttcaagattttaaaatccagagagtctggttcttcacgattaggatcatgcttgccgtcaaactcgaatgccgtacgggatctttctttaattggtgccaatcggcatttgataaaatgccgagtaatctgctctccttgtaagccttgttctttgagttttagcatgcgatccatcaactccaaggcttgggcagctgtcacaccccgaagttttcctcccaagccaaaattgtaattttcaaatgaccccaagaaaatgcaggtgaaatcaggagaaaaccctaagaaagtaatgcaaataataatcggacttgacatgtggaatttttcttgagttctacatgtcaaaattcattaacaggatttttagtggaattttcagagctctagaaataatttcaaccaattaaaattgagcaagcaatattttattccagggaaaatcctttttcctttttctttttctttttcctctctttttcctcctttttgtcaaatgggccgtcggcccatttctccttttcctccccctcctctctgttgggccggccgcaggccgaggcccagccggcagccggccgcccgcctccctccctcccggggtcgccgacaggtgggacccacctgtcggacccgtctcccacctcccgcctctcccgctcgcgccgccgcgcccgcaaccgtcgccgcgcccacgtctccgccttcctcgggccacgtcgaccacgcccgcgcgtgcgccgcgtctcccgcgcccattcccctctctctcccgctcgcgcccgcgcccgagatggccgggattcgaaaaccgaatcccgcctctctctcctccccactcccccgcgtcggccggcgattcccgccgctcccggccacgtccggttccctctccccctatttaagcatcgccggcaccccctctcgctttttccccatttcgccgacctctcccgagctccccatcgctcccgcgccgtgcaaccccttgccgccgcctttttccgctctccgggcgccgctagccgccgctaggctcgccgccgtcttgcgccgtcgccgccgttagattcgcggggtcgagatctacctcgtccgccccttccccgttgaggttcgccgccggagacccatccccgtcgtgcgccggtgagtgacgccatggccgccgccttcggccggcgctctcgctctctcgcgctcttccctctccctctaatccctctccttttgttcgttaggaggttccggagctcgtcccgccgtcgccatcgtcctccgtcgcccgccgtcgtcgaccgttgtcggtgaggccctcctcctcgttttctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccgtgcccgcgcgccccggccgcgagctcccaccgccgtccgatctacccttgggtagatcggggccgtcggttcggccgccacgtggagccgccgccccttccatctcccgtgtcgctgaccggtgggccccgcatgtcggcgccgagccgcctgtgctgacgtcagccctggaatatattgcgcaataattaattaaggactttttctttattagtaaaaacacagtgaatcttctaaaattcataactaattcatccgagctccgattaagtccattcaagtctcagtaaattcataaaaatgtgtagaatccattaaaaatggctttgttatctgtttcagtagtcttatagcatgttttgcttgtgtgctttgtttgtcgcgtagatttcggccgtttcgtcgatccgtggtttctcgaagacgttgctgtggttccatcattgcgagagcaaggcaagtcatgcaatacaattgatcatattgtacctaatttacaaatgtcccgcatttctattaaatattgcattgttttacaatatcatgtgggatgggtcctattactcagctatatgttgttttccttatgccattgataacttgggtattaaaatgactagatgttggtttaggagatgcttagccatgcttagttcaactagtgcataaaaggggaccacattaaagcatagacttgattattggcaatagctctggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatacgaagggtcctgtcacggcctctttccggtatgtcgtggtggcatgccggcgcacggaaacgtgtcgtggggctgtgtcttgtgggtacagttgtacacctctgatcagagtaaaactattcgaatagccgcgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttcccagttgaagatgtctcgaagaggttggtttcgtcgctgccgtcaaggattgcctgtggaatggagtcgcccgctgcaggagtcaagtcttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtggggtttttcaaaacaagtcagtctagggttttagtaaaattattgggatttattcgtcagacagttggggtttgatgggtgaaatgcattaggtcctagctctataacatgggttgcaaggtgtttatgcttcgtttgttattattaatatgtatctaatttctcattattttgtcattatgtgagtctgtcttatttattcgctctcatgcaaaatgatctatgcataaaatttcgcttttattcgtttcccttatttgagtcttttattgctttatttaaatttggatttgagcatgcattgattcctatccctctgtactctttagatgtcagacctattctccgatcgcaagcgccgctccaagcttcagagtcgccacccttagctttatcgtcttcttagtctgtttgcgtgctagtttttgtgtttaggtttgttgcttgtgggttagtcggcagtcgatatcatgtgtgagtggtatgacagcctttattaggagttgtgtgcctctttttcagtgttttaatcaagattaagatgattgcacttaatcttataagaaagattagtttccgagccgtctgttttcttcctttctcttatttctacctatcctcctccagatggtgaagacaagggacgatccccgtgactccaacgacgccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggcttcgtgctattgagaagaagctgatccttctgcaatgtaacgaccgagagaaggttgcttttgctacacatcagttgcaaggtcctgcttctgcttggtgggatcactacgtggtgacccgtccagatgcaacggaggttacttgggcagagttttgtcaaagcttcaggaaggcacagattcccgaagggattatggcacaacagaagagagagttccgtgcattgcaacaaggaaccagaacggttacagagtacctgcacgagttcaaccgcctcgcgcgctacgctcccgaggacgtgcgcaccgatgctgagaagcaggagaagtttttgtttgggctcgatgatgaattgaccaaccaactaatctccggagtctatgaggactttgagaagcttgtggacaaggctatccgccaggaagagcaacgcaacaaaatagaccgaaaaagaaagacagctcagatcagctttcctcaggggaacaatcagaagcctcgtttcatgacgggacagctaggtgggccttccaccctgatcgtctgtcagcaccgtccctatcgcccgagtaacttcaacaacgattacaatggtggcagtcacaacaacagtaagcagcacaaccacaactcgactccacccccactaatggcaccagctcagtcagatccgccagctgtgtcagttcagttagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggagaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcacgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcagcatctccgcctggtactcgagattttgaaggagcaccagctatatgccaagtttagcaagtgtgacttctggttatcggaggtcaaatttctgggtcacatcatttctgctcaaggcgtggcagtggatccatcaaatgtggagtcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggttgcatatgcttcgcgacagttgcgtccacatgaggccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacggatacgtagctgccctagaggcccggcctacgctcgtggatcaagtcagagcagctcaggtaaatgatcctgaaatagctgagctaaaaaaaaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccagaacatcgtcggggcacgattcaatctgggtggtcgtggatcgactcaccaaagttgctcattttattccagtacacactacctatactgggaaaaggttggcagagctttatctttcaagaatcatgtgtttgcatggggtacctaagaagattgtatctgatcgaggaagtcaattcacttcaaagttttggcagaaactgcaagaagaattggggactcgtttgaatttcagcacggcttatcatccacaaacagatggtcagaccgagcgagtaaatcaaatcttggaagatatgttgagagcttgtgcacttgactttggtggagcctgggataaaagtctaccgtatgcggaattctcttacaacaacagctaacagtccagtttgcaaatggcaccgtttgaagcattgtacggacgaaagtgccgcacaccacttttctgggatcaaacaggtgagcgccaactgtttgggacagaagtgttaaccgaagcagaggagaaagtcaggaccgtcaggaaaagactgcgaatcgcccagtctcggcaaaagagttatgctgataaccgccgaagagagcttactttcgaagcaggggattatgtgtatcttcgtgtcactccgctccggggagtacatcgttttcagacgaaaggcaagttggcaccacgcttcgtgggaccatacaaaatcttggaacgaaggggagaagttgcttatcagctagaacttccatccaacatgatcggcatccatgacgtgttccacgtgtcccaattaaagaagtgtttaagggtacctgaagaacaggctgattcggaacacattaatatccaggaggacctaacttatgtggagaagccggttcgcatacttgataccagcgaaaggagaaccagaaacaaggttacccggttttgccgagttcagtggagtcatcattcggaagaggaagcaacctgggaaagggaagatgagttgaaagccgcccatccgcatctcttcaccagctcctccgaatctcggggccgagattccgtttaaggggggtaggtttgtcacaccccgaagttttcctcccaagccaaaattgtaattttcaaatgaccccaagaaaatgcaggtgaaatcaggagaaaaccttaagaaagtaatgcaaataacaatcggacttgacatgtggaatttttcttgagttctacatgtcaaaattcattaacaggatttttagtggaattttcagagctctagaaataatttcaaccaattaaaattgagcaagcaatattttattccagggaaaatcctttttcctttttctttttctttttcctctctttttcctcctttttgtcaaatgggccgtcggcccatttctccttttcctccccctcctctctgttgggccggccgcaggccgaggcccagccggcagccggccgcccgcctccctccctcccggggtcgccgacaggtgggacccacctgtcggacccgtctcccacctcccgcctttcccgct

SEQ ID NO: 17577 - DNA, 659 bp, Oryza sativa
ctggagttgattaaagattatgacatggggatacactatcatccaggcaaagcaaatgggggttaaggcccccaaaagaaaaattggcctttttcccttggaaagcccaagaaaaaaagaagcttatttgcaatggcagtatgtaccgaaggcatgtgtgacaaattgcagcaagatcttgagcacctaaatttgggcatcgtagaacacggatacgtagctgccctagaggcccggcctacgctcgtggatcaagtcagagcagctcaggtaaatgatcctgaaatagctgagctaaaaaaaaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggtcagcatgagaagagagatagccgaattcgtcgcactctgcgatgtttgtcagcgagtcaaagcagaacatcagaggcccgcaggactgctacaaccccttcagatccggaatggaaatgggaagaaatcggaatggatttcataacaggtttgcccagaaca

SEQ ID NO: 17578 - DNA, 1465 bp, Oryza sativa
tgaccaaaataaaagttgtagatcttgatgagaggatcaactttgttgttgttgactttttcatttgaaatcatttactatttacaaatgctgtttaaattagtcatattgtgaaaatcaatttcaagctgttgggaacaaagttatctagacaaatgaccaaaataaaagttgtagatcttgataacctctacaattttgttgttgaccatatttcgatttgaaatcatttactatccgaaaatgtattatgactaataaaataaattattatatagctgctatatattttgtactaacaaatataaagacttgattggaaaaatgcaaaaaaagtcatcggtgacgggccttagttaaagcccgatagagattaatctatctctatcgggcattatcttagagcccgtcacagatgagtcatctgtgacgggcctgaatgtcatctcaatcgagcattagtatggagcccgtcaccaatgagtcatctgtgacgggccctacggcaatgcccgattgagatgacttatcactctactataacaagggtttctcatatcggatcgaaaaattttctaagtcctgctacagtttcacacctccttagaaccctagcgccgccgccttcgtcctccctcgccaccaccgccaccgagcccgccgcttccaccgagcctctacaccgaccagcgtcggccttcctcgtcgtggtcgcctgcctcttcaccgacgcgaatagctgacccccaccgagcccggcgatgtccttcctcatcgtcgtcgcctactcctcaccgacgcccgacgccgacctgcctgaccggcgccgccctccaccgagcccagcgctaccgccgcgaactccttcgccgagcccggcaccaccgccaccgagcccagcgccgcctccaccaaccagcgacgccctccaccgaacccggcgccaccaccaccgagcccctccccccccggctgtcctcaggtgagtcctccatcgcgccgccctctgctacctgtggtgaatgatgaaatgtggatgttgggatgaatttagtgatagatgattttagtgattgatgacatgttgatgaatagatgaaatgtggtgcattaatgaatttagtgattgatgatttgtggtgaacgaatgattttttttatttatgacatgttgatgaatagatgaaatgtggtgcattaataaatttagtgatagatgcatgatatgtggatgaatagatgatatgaggtgaatttatgattttaggatttgatgatatgtttatgtcgcgtcccaaaacgactctaaaatacatcctctaaattatgcctagaataattaaaatccgagtgaaagcctccaacaattaaaatgtgcaaagttaaaagtcaaataaggcttggaggatttttgtatatttcctaaaagcctaaaatgcgtaaataaattttagtggaattttca

SEQ ID NO: 17579 - DNA, 2046 bp, Oryza sativa
cactcccgtggacccggtccgcgcgcccccttccctcatctgacgcaataaacttttttttaaattaaaatttaaatgaggaaattcgcaaatattcatttaaagagcatagaaacttcaaatggccataacttggccatttgaactcggaattggaccagtcaagtctctaagttttccttaagaagtcaagaacccatttttgtgctttgttcctgcttgttatatggagtttattagagtaaaagccttttcttttccgttggtcgtgtagacgctgcagcttcggaagatccgcttttcgtggaagttgaagccgacgtttgggaaagcgagcaaggcaagtcgcatcatccttgaacatattgaatcgcagtttataaaactatgttgatttaaattattgcattatcgctttatttaaattcccgcgttatcactgttttatctagccatgcctatttacctttgttatgaccttattattgttattgttattatttccttgttcaccctagagtaaacaaaaccccaactagtggatactctactcatggtaccactagtatgattttaggtagacgcttcgccgcttaattaggcaacattaggtggttttacaactctagactttgggatactcttatcacctggacactatggaatggatggactattgtggaattggattcacacctccccctctattcaaaatcctcaaaatggttttaggctgggctcggggtgcatggtttagatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaagctacacgagctgtggctcggtagtcgagatgtcatggcacagggccggtgtcctgctgctgggggctcagtcctgcctacctgtcccggaggttccggccgtaggtggggttgggtctgtactcttgtctatggccaggatgggttggaaactatgtcacgtcttccgtccgtataccatggtggtatgtggcacgtggttacacgtgaggaagatatgtcttgtgggtaaagatgtacacctctgatcagagtataatctattcaaatagccgcgccctcggttatgggcaagccgagcaatgtatccaagtttgtgttttaattcttaaaacctgcttaacaacaaaaatgtggaatggttggcctgggttggcttgggacgagctgggacccagggtcgggtggccagttcggtctgaatcatcgtaggccttgggttaaggcaggttcgtgtgggttcacggccttgattaataacattgtagcgttctaggatcgcgtttacaaagtagctttgagcaactaaatgtctttaaatgctgtttactacaaccctaaccctttatattataattcccttgtactcccttgcatttattctgcatttgtgggtgtgtcttgttgagtacggtggttgtactcagtcttgcttaattttcccaagcccagatgaggagttcctggaagatgaaggctttggtgtctagctcgtgcttgccgtcaagcgcctgtggtcgtttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccgaagcttctcttactgaagaggggaaggattgagcaagaatgagtacaaccacagtactcagcaagccacaccggcggatgcataattaatgcaagggaggtagggctgcagga

SEQ ID NO: 17580 - DNA, 9022 bp, Oryza sativa
gtgcgccgcctcccgtcggccgtgccggcgaggccgccttcgggcgcgccccgtggctgccatgtggggcccggccgtcagccgcccgcgccctcgggtgcggctgacgcgtgggacccacggcgccggccggcgcaagccgcgtgcacccggtccaccgtggatcgtgaggctgccgcgtgggccccactcccgtggacccggtccgcgcgcccctcccctcggctgacgcaataaatccgattttaaattaaaatttaaatgaagaaattcgcaaatatccatttaaagagcatataaacttcaaatggccatatcttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgagcatattgaatcccagtttataaaattatgttgctttaaattgttgcattatcgctttatttaaattcccgcgttatcactgttttatctagccatgcctatttacttttgttatgaccttattattgttattgttattattaccttgttcaccctagattaaacaaaaccccaactagtggacactcttctcatggtaccactagtatgattttaggtagatgcttcgctatttaattaggtaacattaggtggtttttcaactctagactttgggaatattcatatcacctggacactatggaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcaatctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaataactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagttctagaatcgtgttcacaaaatagctctgagcaactaaatgtcttttaaatgctgtttactgcaaccctaaccctttatagtataactcccttgtactcccttgcatttattattcacttgtgggtgtgtcttgttgagtacggtggttgtactcagtcttgctcaatttttcccaaacccagaagaggagcccctagaagatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttaaactctgaattgtatcaacttttggtgtaccttgcctcctgggataaggaataatacacgtacgtaaggaacgcccgttgggttatttccggtcgtgacataaggagcgcccgttgggttaattccggtcgtgacaagttggtatcagagccccccttgaccctaggacgagccgtagatcccaagccttagcaatattttcaaaataaaaatcctttcttatttgtgaaaatcctttagtctctctctgtcctgctgcttcatttatcgtcaaaatctgacctttaaaatgttgcttttctcttttgtttttgtttgtagatggccggcagcatcaaccgtcgtggtctggacctgactggcttcgttttggatctgcggggcatgtgcgttgtcctggggtatccgcatggagtggactaccagggcaagcagctcccggagcaggagggtgacgatgcagagccccacgctgcttgggaggttaccgcagtgatcctcactagctcacccgagaggacttcgttggcagtcaccgcgggtggagattctttctccgccgcttgccagaacgacgctctcctcaccatcgacactcttcaccagcgctacccggacgagttgcagcactcgccctaccgctacaaccctcgccgcggaggagcccgcgactacgccaccttccgggatgctagctcggaggatgacactaccatcatgcacctggcgcgcatggtggaggcgtacgacgcggcccgtatcgacttccatcagatggtgcgtcgcgggttggtcaagaacaacatgaagatcctggagctgcgtcaggagaatctgcagctgaagaaggacctagacgcgctggaggcgcagctgtgtcaactcaaggtcgcccagggagaggtctgccgtcccaagtgtcgccgcgtctgctgcagccagaagatcaccgcccgcaagagcacctccaggcctgagcttgttcgtcagtccctggcatggacctgcttcgtcgagacccctcgtgccgcacctgcgcccgtggttccccaggagggggaagcctccggcgtaggtagcacggaggatgcctgttgctcaccttccgccctggcccgtcgcagcggtagacgagcagttagtaggcctgcgcgtgtgttctttctcgtttatcttcttgttgagtcgtgtggggcatggttacgccggtgtgtggtgtaactatgtcggagcctgtcttattttatttgcctaagcaacttgaactttaatgaaccaatttaatagcagtgataaatttaagaataatggtagtcgtgggtggttagttttaattgttagctctctctctgtttgctggttccgtgtggggttttcagatggtgacgaccaggagaaatgttaacaccggtgaaggcaaccaacccgagggcagcaaccccaacccccaaggcaacccacccccaccaccaccaccagacaccaacgccattctcacccagatcctcgcccaacaagccaacatgatgactgctttcctccaccacctccaaaatccgccacaacagaatgctccaccaccccctccccaacactccaaactcgccgaattcctccgcatccgcccacccaccttctctagctccaacaatcccgtagatgcgttggattggttgcatgccgtggggaaaaagctagacacggtgcagtgcagcgatgaggagaaagtcatcttcgccgcccaccaactgcaggggcccgcatctctatggtgggaccatttccaggctacgcagccagaggggcagcctattacttgggcccgcttcaccgccgctttccggagaacccatgtgcctgccggagtcatggcccttaagaaaagggaattccgagagttgaagcaaggcaaccgctccgtgatggaatatttgcttgagtttaacaacctggcccggtacgccccggaggaggtacgggaagatgaggagaagcaagagaagttcttggcaggaatggaccctgagctgtccgtgcgtctggtctccggggactatccggatttccaacgtctggtggacaagagcatccgcttggaagccaagcacaaggaactggagtcgcacaagcgtcgcttggcgaatttccgcaaccaacagggggctaaccaaagggtccgctacaccaatccctatccagggggatcctcctcgcaacagcaacagcagcagcaacctcgctccgcgccccgacctcaattcgtggtgcgcgtcccacagccgcagcaacagcagagttagcaagggactcgtgcgccccgtccccctacgccagccgtgcagcctggccaaggccgtagggacgttcaatgtcagcagcgtctgtgcttcaactgcttcgagcctgggcactttgcggataaatgcccaaagccgaggcgccagcaaggccaagcgcctccccgctccagcaacggtggtaaggatgtcattcggggtcgtgtgaaccacgtgacggccgaggacatgctgacaactccagacgtcattgttggtatgttcctcattcattccatccctgctaccattttgttcgactctggagcttcccactcatttatatctgtgccattcgtggggagaaatcagttgggggtagaaaggcttaggaaccctctgctcatcaccacccctggaggggttatgacagcgaagtattatagccctgtcgttcctatagaaattcagggaattccttttccctcggatctgatccttctagacaccaggaacttggatgtgatccttgggatgaattggttggctcaattccaaggagtagtggattgtgcaagacgcactgtcactctgtaccgagggccggaacaaccggttgttttctttgcacccccaacctctgtcggtagttcagaacttcatcagataggactgtcggaaatccccatcgtcagagagttcggagacgtgtttccggaagaactacccggtatgccgcccaagcgagagattgagttccggatagatcttgctccaggaaccactccccagtacaagcgaccctaccgtatggcatcaaatgaactggccgaagtcaagaaacagttggaagagttgaaagaaaaggggtatatacggccgagtacttccccctggggtgctcctgtgatttttgtggagaagaaagacaagacgaagaggatgtgcgttgactacagagctctcaatgaagttaccatcaaaaacaagtaccctcttccccggatcgatgatctgttcgatcagcttaaaggtgccactgtattctccaagattgatcttcgctccggatatcaccaattgcgtattcgtgaagaagatatcccgaagaccgcgttcaccacgcgttatggactgtatgaattcacggtgatgtcgttcggtctgaccaatgctcctgccttcttcatgaacttaatgaacaaagtgttcatggaatacttggataagttcgttgtggtcttcattgacgacatcctggtgtactcacaatcagaggaagaccatcagaagcatctccgtctagcgttgggaaaactgcgggaacatcaattgtatgccaagcttagcaagtgtgagttctggttgtccgaagtcaagttcttagggcacgtgatatctgccaaaggagtcgctgtggaccccgaaacagtgaccgccgtcactgattggaagcaacccaagacagtcactcaaattcgcagtttcttgggtttggcaggatactaccggaggttcatcgagaacttctccaaaatcgcttgacccatgacacagttgttgaagaaagaagagaaatttgtgtggagcccgcaatgcgagaaagcgttccaaactctcaaacaaaagctggtttcctcgccggtgttaatcttaccgaatactcgcaaggatttcatggtgtattgtgacgcttcgcgccaaggattggggtgcgtgctcatgcaggaaggtcatgtggtagcctatgcctcacgccagctacggccccatgaaggcaattaccctacccatgatttggagttagccgctgtggttcatgctctaaaaatctggcggcactatctcattgggaatcgcagtgaaatatatactgatcataagagtttgaaatacatcttcactcagtcggatctgaatcttcggcagagaagatggttagaactcatcaaggattacgatgtgggaattcactatcatcctagtaaggccaacgtggtcgccgatgctctaagtcaaaaaagtcattgcaacactcttggcgtccgtggcattccaccggaacttaatcaacagatggaagccctgaatctaagcatagttggtcgtggattcttggctacgttggaagccaagcctaccttgctcgatcaaatccgcgaggctcagaagaatgatccggatatgcatgggctcctcaagaacatgaaacagggtaaagccgctagtttcacagaggatgaacacggaaccctatggaacggaaatcgggtctgcgttccggatgacagggaactaaaacagttgatacttcaggaagctcacgaaagtccctattccatccaccctggcagcatgaagatgtacttggacttgaaagagaaatattggtgggttagtatgaaacgggaaattgcagagttcgtggccctttgtgatgtgtgccagcgcgtcaaagccgagcaccaacgaccggccggactcctccaacctatacaagtgccagaatggaaatgggatgaaattgggatggattttatcaccagacttccaaaaacccaaggtggatatgattctatatgggtagtcgtggatcgactaaccaaggtagcccggttcattccagtaaagaccacctacggggggaacaaactagctgaactctacttcgctaggatcgtaagtctgcatggcgtccccaaaaaaattgtatctgatcggggaagccagttcacctctcatttctggaagaaactccaagaagagttgggaacccgattaaatttcagcaccgcatatcacccgcagacagatgggcagacctagcgtctaaatcagatcctagaagatatgcttcgcgcatgtgtcctagatttcgggaagacctgggataagagtctcccttacgccgagttctcctacaataacagctaccaagccagcatacaaatggcaccctatgaagcgttgtatggacacaaatgccggacaccgctattgtgggaccaagttggggaaagccaagtgttcaggaccgatatcttgagagaagctgaagcgaaggtcagaaccattcaggataatctaaaggtggcacagtcccagcagaagagttatgcagataaccgacgccgtaatctggaattcgcagtggacgattttgtgtaccttcgggtcacgccattgcgaggtgtacacaggtttcagacgaatgggaagctcgcacctcggtttgtgggtcctttccgtatcattgctcgatgcggagaagttgcttaccagttggagctgcccgcctccttgggcaacgtgcatgatgtgtttcatgtgtcgcaactcaagaaatgtcttcgagtgccgtccgagcaggccgacccagagcaaattgaagttcgcgaagacttgacctacatggagaggccagtgaaaatcctggacaccatggagcgcaggaccaggaaccgggtaatccgtttttgcaaggtccaatggagcaaccacgctgaggaagaagctacttgggagcgtgaagacgagctgaaggcagcccatcccgatcttttcgccagttcttccgaatctcggggtcgagattccgtttatggggggtaggtttgtcacgtcccaaaacgactctaaaatacatcctcaaagagatgcctagaataattaaaaaccgtgtgaaagcctccaacaattaaaatgtgcaaagttaaaagtcaattaaggcttagaggatttttgtatatttcctaaaagcctaaaatgcgtaaataaattttagtggaattttcacagcacaaataataattattaagaaataaacaaagttaaaatgattttataaaaagaaaaactctaaaaagtcccctttccctccctctccttcttgggccggctcggcccatctccctccccctccctctcctctccccacggcccatccggcctctccccgcgcgcgcgccgctgacgggcgggcccgcccgccaccctcgctgacgggtggggcccacccgtcatccccttcctcccgccgcctcccgccgtccccgtgcgcaataaagtagggggaattattccccgtgattccctctccctttccccccatttttccctccctctctccctcagattcgtttggaaaccgttcccctaacctcgccggcgccattaatggcggccgggtctcccgcgcccatttccccctcctccggccgccctctctcactcccaaccctatataaaccctccccgagctccccaccaccgtttccgccactagccgcctctctccccgccggaatcgagctcgcgccgtcactatctctctccaccgtcgccgccgagctccggtccgccgccgttgtcgccccggaccacctcccacctcggcgccgcctccttcggcttcgccgcatcctcgccgacctcgtccacctctccgtttcggtcgccgaccgccggagcaccgtcgaccccatccaccctagcttcgccgccgccttcctctgctccggtcgccgttttcgtcatcgccgtcgacccggggtgagccgtggaccgccgcttcgtttccccctttccctcccctttctcgggcgccgctccgccgtgcctatggccaccgccggcgaccataggggcgcgggcgtgccgcctcccgccggccgcaccggcgtggccgccttcgggcgcgcagagtggccgccgcgtgggggccggctgtcagccgcccgcgccctcgggtgcggctgatgcgtgggacccacggcaccggccggtg

SEQ ID NO: 17581 - DNA, 1316 bp, Oryza sativa
  unsure (1)..(1316): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccttatagtacccgaggtacgactagcaaaacccaaccacgcacctcgagcccagcctaaaaccaatttggggattttgaatagaaggagcggtgtgaagccaattccacaataaccaaaccattccatagtgtccaggtgatatgaaaattcccaaagtctaaagttataaaattacctaatgttgcctaattaaattgcgaagcatctacctaaaattaaactagtggtgccatgagtagagtgtccactagttggggttttgtttactctagggtgaacaaggaaataataacaatagcaataataataaggtcataacaaaggtaaataggcatggctaaataaaacagtgataacgcgggaatttaaataaagcgataatgcattaatttaaattaaaaataattttgtaaactgggattcaatatgctcaaggatgatgtgacttgccttgctcgctttcccaaatgccggcttcaacttccacgaagagcggatcttccgaagctgcagcgtctacacgaccgacggaaaagaaaaggcttttacgctaataaactccacataacagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaatggatttattgtgtcagccgaggggggggcgcgcggaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgcggggcgcacccgaaggcggccacgccggcacagccgacgggaggtggcgcactcgttccccgatggtcgccgccggcgaccaccggcgcggcggagaggcgcccgagagaggggagggaagggggaaacgaatcggcggtccacggctcaccccgggtcgacggcgacgacgggaacggcgaccggagcggagagaggcggcggcgcggctcgggtcgacggggacggcggcgttccggtggtcggcgaccgaaacggagaggtggacgaggtcggcgaggttgcggcgaa

SEQ ID NO: 17582 - DNA, 673 bp, Oryza sativa
acctatcctcctccaaatggtgaaaacaagggacgatccccgtgactccaacgacccagtggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggcttcgtgctattgagaagaagctgatccttctgcaatgtaacgaccgagagaaggttgcttttgctacacatcagttgcaaggtcctgcttctgcttggtgggatcactacgtggtgacccgtccagatgcaacggaggttacttgggcagagttttgtcaaagcttcaggaaggcacagattcccgaagggattatggcacaacagaaaagagaagaaggttttcccccggtgcgcccaattttggggcccaaaaaaaccccaaaaaggggggggaaaacccccgacggttacagagtacctgcacgagttcaaccgcctcgcgcgctacgctcccgaggacgtg

SEQ ID NO: 17583 - DNA, 21920 bp, Oryza sativa
  unsure (1)..(21920): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgttatgtgaactaataaaaagttaaggattgagagataactggtaacagaatatgaaaatcttactttttctaatgaacgtccacataatgcctgcattgcactgttgaaatcgtcgtagttctcaaattgcacccacactttgcaatttagtccagatataatctccttattggttccgtcttgttttgctccccattcatcatcactagaaatattaaggttcctgaaaattggcagaagaatgccaaagaaaagggtatgcggagtaagttccccaaaatgtgaagggcagttcataacctgcagaatttaaaagaaattgggtgcagtgttatttaaagaagtcacatgtatacaatagacattactccattattgtgcttgatgcactagggttatgtcgtatgttgttttgtgtgacatggattttatgcgtgcaatatctaatactactaaagaaatttattttacccatgttacttcccaagcttctttattatgaattttgaacatagctaacacattcacctaagctaccacactaacatcagaaactgtatgaactggtttttgctgagtttaattgctatcttggagaatcagatcatagatttcaaaatataagaagcgatatgagtgagaagaaacttatatgtggatgaaaaccaactagacagggcagaccttcaggtttcaggtggtgctaattttaatgcgcatattaagctctcaaaaggtgtgtataccggaatgggaaggcaagtaagaacaaaatatgagtccacaaacaaaataggaaaccaccaggatggacattgaacaaaactgaatcaaacaatttccttatggatgctcatgtcaactaagtttaggactcttttcgcttttattagcttacgtccggcactaatattctgccttgtatcccagagatatgaatgcatttacaatataatgaaccaaacagaagttgagaacaccaaaatgcaccttattttaccaagtgccgagaaaatagtgtgtgtgaccagcgtggaggctttcgatgatatcctcgtctccgcaaaccacctggatggcacaccccggacaagaatggtgtctggccttttcgctatcttcctcacaggattccctgagcaaagcaaacatcaattcaaactccacctagcaagaatcacaactaagagcagcattttcatttaaaaaaatgaatcccatactgctactgaggagctcggaggcgtagaaattctcccaagacttcttcattgccctgaagtcatcggagggcgggatctcgacgctcatccgaaacttaaccccctcgaggttgagctcgatcccggccagcttctcgaccagggagctcctccactggaagtacttctcctcctcctgctcacgggtcatctcctcggcctcctcctcctcatcatccccgttgcggcggcgtgggcggaggaaggagaggtcgcggacgtggaggacgcccgaggcgacgggctcgtcgcggcggcgcttatgcaggtcggggagggtgcgcacggagaggtcggagtcggggaggacggggagggagaggggcgggtcgcggaggaaggcgaggagcgcggtcttgagctgccactcgtcgacggggcggacggagaggtcggcgcggaagaaggtgaggagcagcttgaggcgcggcgcgagggagaggccgctcgggagggggagcggctcggtcggccggagggcggcggcggcggcggacatggcggcgcggtggtggggagagagacggcgggatggcggcggaccggcggcgggttggactcgacgggttgcagatgggccgggtgaatggacaatggagaaccggaggcgagagaactgttgcttcacgcgttgagggccgtccgatgggagatcaacgggtgatcgtaattcaactatcgcctatcggcctatggcgcggatgtgttgttagagaaaaggattatgtcgagattatgttcacgtcatgttcatacggactagcgccgatttgaacatgcaatttcgcacgaaattcatacatacgtgcaatatgggattccgagcataagaaaatcataattcgagttcaaagttcgaacacaactccacatcgaagacaatagatcttactatcatcaaatgattcgtataagattcaatgctaagggaactattctaaataaaattttaaggggatattcactcgttgtttgcagctactcaaatggttataaagaaataaaataaaaaatcgacgagatagattaatatatgatatatcaatccacaaacatacaagttaaatttaacttctacatatcgcaatttaaaaaaacaaatttaattgtcaatatacgttaactagctgtagttttttttgcaacttttagaagttgatttttagcttgcatgtttgtaaagtgatatatcacatgcaaacaacaaggaacatccctttaagagtttaaaatctactctcttcaatactctgtatttatgttgcaacaccttattctctcttactataaagttataacccactaactcttaaagcttaacatgcaaagatgctacatcatcgtcgactaacagttattacatttaaatatcatgcaaacatgctatattatctataattttataatttattaaattttagagctttaaaatacaagcatgttaaatcatcatctcacataatttaaataatatgttaatatatatcttcattatttttaataatatcttatatacctatatagttcatcctcaattagttaatgatatttttatcttctctcattaagccatatcacatcaattgtttttttttgtgcttaaatgatttattaaattttagagctttaaaatgcaagcatgttaaatcatcatctcacataattcacataatatttcaatatatatcttcattatttttaaaaatatcttatgtgcctatatagttcatcctcaattagttaataatatttctctcttctctcatcaagccataccacatcaatttttttttgcttaaatgattaatatatggtcaaattatctccacattttcttctttcattaagctatatcacctcaattgcttttaggtcttagatgattaatctatgattcaaactgtctccctacttttcttctctagtaaagtcgtatcactttacttttatatttgaatcattattttatataccatttaaatttaaattatcataaactacgttaacatactcttatgttgtgtagctattttatatattatttttacttattgttatcataataaactactgcagcaacgcgcgaggtttcacctagtatatgagatgttagctctcaaaaaatgaatatgggctggatttgagatcctactggagatgcaattataacttgcaagtcaatgtagcgataaaattctaaaaaatgcgctaattagacacaaatcaccctttgtaagaccctctttcgctgaaaaaaagttctgagtgtacatgtcgcatttccacttgtgatttttttcaaaacgctcagtgatatcactttaacttagaactattgtaccatattttatccccaaatttcattcgagtgacatatagcaatcccgtttgctttattaccaatctgcacgtgaagtgctatgcaacagccttgcattgcaccgggaaaacagtagagctcatcgccctccgccgccccggcggcacgcctgcctgagcggcaccggcgggtcggagagcttgccgccgacgatcagctcgaagacgaacctgttcgccgcctccgtgaagtgcaccccgtcccagctcacgctcctcgacgggtcgtcgcacgacttccccgccagcaccgacgtgccgttcacctccaccttcccgccgcaccggatgtccctgtcgaagttgtactcgccgccgccgtacccgcagcacaccagcagcgggtccccgaatcctgcaacgaacaatacccaccaatttttcaatcctgcggcgatttcaagtgtttcttctccggctccggtggtcagatcaacgtacgtaccgagctgcttggcctggctgatgagcctgtacttggcggagtagacgtcgacgtaggtgagcgcggcgtccgggagcgccgcccttagccggtccacggtctcgcgcagcctcgcgttgaagaaccgggcggccgcgttgtaggcgacggagcagccggcgtcgtccctcggcgcggcgagcttcggcaggagcaccaccgcgtacgtcaggcagccgagcggcgccgtgttgtgcacccagaagtacctccctccgaggctgtacactttctgcactcaccaagcaagcagagcacgtacagtacacatgagcagtcctatcgttttattcgaacggcatatttacaaaagaaaaataatttataaataaattttttatatacatcttcttggcaatataaaagtataggtcgaaaattaaactttgcgatagaaaagtataggtcgaaaattaaactttgataaaaaaaatcttaaaattagctttaaatataaggttgaaaattcagaatttgactgataagtataaacataagcgaaacaataaggccgctgatcatctgataagccgtggaaaaataaacaaaacaagcaaagattatttcaatacaaaacatttatatctctgttattagtgttttaaaagcaaatgctagaaaaaaaactacgatgaaaagatcctaaaatcatctcgaaaattaagttctaagaagattcaaaatttcttagtttgtcaatcagtcaatgaacctaagtgtactgtaactaggctgtgatcactgcattgagctgcacctggatggctgcactgaacctctccatgagatcagggacgtaggcctcgacctgctcagtgctcatgttgtcgaagtagcccattgtcaggtcgttctggccaatgtcgaacgtgtagagcgccctggagaagtactcagctttcggaagaatctccctgtaaattccacctgcacgaaaacagagtatatatcaacttcacaaaaaaaatggaactgaattttgagctctgaatggcgcatatgcagaggctgatcgaatttgtcttcacctatgttgctataaacgaactggcttctgttgatgaactgttcgaattggctggtctgcacgtccagggagatcgggctgatgccggagacgaagatgctgccattcgctggtctgatcgacgcagcggccgtcgcgaaattggcaccttgactgaagttactcccaactgaatcgaggtatgcactgaggtaacgaatccccaggctctgagctgcagcgtcaggaaaccaaaaaaaaaaacacagtagattcagagttcgttccgagtaattgggacgcactgagtattactgacccatgaagtcgatggtgaggcggccgtcgctgaaccggccggcgggcatgccgaagtaggtccggccgaacggcggcggcaccacggcgatgagggccgagagcccgccggtgtccgagttggagtcgccgaagttgaagatcgccgggaaatcgcatggcgcgtcgctgccgccgtcggagcttgccccctcggagagttgcagcaggagcacgacgaggagcaacacgagcttggcggtggtcggaggagcggcggtgcagcggcggcgacgtcgtgaaggcgccattttttctttccaccttgctcgatcgtagtgtgtgtgtgtgagacttgtgcacttgattattcggagctagcgctgatgtttcatgtttcataggggaggtatgtgtgtacgtgtcgaaccaacgagtcacacgtccacgaagcgttcgaagtccctgtccattctttctcaagatttttctaggtttgggtgttgtttgtattcagaattcacacattgtctcaggtttgcatcaggactggtacaatggggacaagagtttgtgactttttctggaagtctgattggtttctccttgtttgttgcacgtggcgtgaggatgacttatctacacttttctaaagtaacttattctctcttttgttttccacgtgtacgctttctaaactgttaaacgatatattttttaaaaaaatacataaaagttgtttaaaaaattatatcaactagaaagttagcccgcacatatgcgcggacacctatttaatgtgtttgtgataatacaaatgtttatatgtgagtgactttttactgaaatattttttactcaattctaaatctgttctttttttgccaacaattcattttggattgctttgaatgctagttttgattcccttctaattacccttaaagcaaataaagtctaaactaaaattacttgaaaatatgaatttataaaagaatattgtgtcataagaatggagttggttaccatgaaattatatatcatttgtattatgtgtatttactttttaaaatatttagcacatcttatttttggattttctaaactttaattaaggtaaaattttattatgctatatatgtctttatagattttagggcatattaattgaagatattttctattaaaaatatggctaagagactattttatctaactatagatatacctctatttacctctactttctccgtctcataattccaaggattcaaatcatatcccaaaatataaaggttgtaaagtactaactgtcccatcgaaccacccctcatttattttgttcctaatcttacttcaaccatctttattttttatccaattttatctcaaccgccttccctatctctatgtatcctttatttaatgagagttgtcatagttttttttcctccccttaattcctcctaaaatagtatgatcccttacattataggataaagatgatacaaagtatgcaccatttatagatggatttgtttggtttgtttgtgcctatgtagattaatttagccttgcatgtttataataatgtggatacatgaactattgatttagttgtagcgacataatattttactgatatttgaactatccaaaagcaagggtttaaatatggttatttaaagatcgatcaaatatttagcaagtatgctcatgaatttagggtggtcaatgtgcacacaaattgtgctgcccgcgcatatggacatgtgaaaaaacagggtcaggtgctctacgcaaattagttaacattccctaccttccaacaatgcaaatttgtttaaaatatgggtcattaatttaaataaaaaattttaagagctgtatgctttcaaattaatttcattagctagctattctcatgttatcactttttcttcaatcttagagttataacagtaaaggaaatctggatgtaatactttataaagataagctataataatcttcaaaataccacgggaagaaaaacatgccaaattaattggcttggtgaataagataatataccttcgtcccgaagatcaaaatttcaaaagtaccattgttatgggaacaaataacttaaaatatgcataaacatcttcagaaaacctgtaatgttatgaggaggtgattattagtttaacatcaaagagaaaagtaaaaaagaatgtgaaaaaactatactgaaccatattaaattaattaatatttttttataattgtatagctgcaaaaacgattatgatctttgttgcaaaaatatgtcattaatgaaggatattggtattgtatcctctctgcaaaacttatgtcgcatctacaaatcacctaaggagaagaaatatggaatttgcttttagatggatgatgggatggtgtctcgctaagcattgtgaggctgagtttaattttcacatgaagcttcctgctcaattaacggatgcagaccgatgccacgcttgactgcttaccggcctcatctttttcttaagcatcttattagccaaaatttgaatttttaatcttaaatttggagttgattttggggtttttttcatctaaatttatttttcagcttttgcttttaaatcactaagaacacgtatataaaagttttatttacaaattatttttagtttacaaatttattgtttcgaaacgatggagccttgtagatgtatacatgtaggacccacatgattcaatgacaaatttatgtggcatggttcaaattttccatatattgtatacagaccccaaaagagctacagtacaaatgctaccgcacataattctgagagcacctatgtgttccaatctcattcaccgctgttaattatatcggctgcaatgatgatggcatcaaacgaattagaatgcagatgcctcgtggccactcagacgaagtaaatctctattacgattcactaattacttagagaagggactaaacaatgcaattagtcttgagtggcattggaaaaaaaatatatagcaccatggatttacctagatcgatcggaaggggcatcacaacaactcgataggaagggggcatcatgatgatcgatggctcctttcctgacagttagcacctagcgagttgtactcgtattattcaagtgatgcacggagattaatcgcagctcctctttccaatctgttgagagtctcggatcgatacagaaacgtgataaactgcgggcctagctaagacataattacgtggattggaaatttttcttttaccttaaaatttctatgatttttttctaatttatttattaatttccttaatattaggatgccacgtggtggcataggagcgttggtaggagtgccacttggcggcataggagcgtttgtaagaagttttatgtaattttagtatataatagattcatttttttaatttttaagtaatacttaattactcaagtgttttgatgtgcttgtcagaggagaaatgttcccaacatgcaccttcaaacacagactactgtccgattgtaacggaaagtgttatgaactgaaagaatatccgctcatcttatgtataccatctcaatagttaaaaaaaataaaaatttggtaggacatattaatacacaatatataactccacaaacatgcatgcaaattcaaatacgatttcagtaagttgtagcaaaaaaatatatatataactgtgaatatgtatacatactcgtcagaatttaatttgactttttttaattaaaacttatagaactcatatttgaacttacatatatttttaaaaattacacagtacaacgcagacactcacaatgcacgcacactcactcatatgaacgcaagcacgcaaaccctactcctatgagtattttcgaagactggaccggcaaattatggagattgacaaaatcaccacaggtgtctcgttgtcgcctaccactaaaagcacaaagccgttaaatcctgaaaaaatcgctcccatagagagtcgaactcaatcttttcaaatatttattattttttagaattatttagattccccgttaaccttcttttctcaccggagaacatagtgatgagcttgaggctttcatggcggcaaacaccgtcattaacaaaaccaaaggtccaagaccatgcgcataacgccttcacatcgtgccattacggcgcaacggcgtctaaacaaaacttaagatgattcagaatcgtattgtcatcttccagattgtctagaagcatttcatcgctactcgttatgaatctcattctccctttattgcacaaaggaagcagtatatgtactttatatcaaccatatgcctctgcaatattgcacacttacaaagccagaggcagcagcagcagcagaaatggcagtacggcacagccaacctgacgacggctcgatgcacccgcaccggcggcgacgattcactgccctctgctgatctggcaggcctgcctgagaggcaccggcgggtcggagagcttgccgccggcgatctggtcgaacacgaacttgttcgccgcctcggtgaagtgcacgccgtcccagctcacccgcttcagcgggtcgtcgcacgacttccccgccaccacccacgtcccgttcaccttcaccttcccgccgcacccgaccctgtcgtcgaagttgtacctcccgccgccgtagccgcagcacgtcagcatcgggtcatccatccctgcagccacaacacaacacatcacgccaatggcacgggggggattgcacgagctcgctaggcacaactagctaagctttaccgagcttcttggcgtcgctgatcagcttgtacttggcggagtagacgtcgacgtaggtgaacgcggcgtcggcgtgggtcttccggaggtggcccacggtttccttcagcctctggttgaagagctgggcgacctcgttgtaggcgacggagcagccggacccgtccttgacgacggcgaggtcggggcggtgcaccatggcgtaaggcaggcagccgatcggccccgtgttgtgaatccagaagtaccttcctccgagaccgtacacattctgcaggttaccaatcagctcatgtatatgggtgtgtttagttacaaagtttttttttccaaacttccaactttgcatcacattaaacctttcatacgcacataacttttcagtcacaccgtctccaatttcaaccaaattctaaactttgggccaatctaaacacaatcatatgtgtagagttccatatttcagttcgaaattttctttttggcaacttcggtcccccgataggaaactattttagaaaaatattcaaattatttcagactagaatattctgaaatttctgcaatttcaaaaaattaggatcgatcggtacccctgtttttttttctttctgcaatatagaaccctgcatgtatgtgctacactactgctgttattagcggagaagaataatttggtgttcttttgagttttgaagaaaatagtaggagtattgtacaatctctgtacctggattatgttcgtgagcctttccattagatcagggatgtaagctatgacttgttcagaggtcatgtttatgaagaagcctgtggtaatgtcattctggccgatatcgaatgtgtagagcgcctgagagaagtattcagccttgggtaggagctccctgtagattccacctatgtgaagaaatggagcgaaacagaacgtgattgttgggttcaacgtggtactgaattactgacagaaatggattttttggttttcttgtcacctttgttgttatagacgaactggcttctgttgatgaactgttcaaactcccaggactgcacgtccaaggaaatggggctgaaaccagagaggaacaaagatgtgttctgccttctgattgacgacccggccgttgcaaagttagcaccttgtgtgaagttacttcctatcgagttgaggtacgcactgaggtaaggcagtcccaggctttcagctgcagcatcagagagcaagagtgtgtgtttacacagtaagaatctgcatttgatcgttcaaatagcagtaatctcgttgcatttgatgatttccgaagagtgtgagttgaagcctgaagcttttacaaccagcaccaaagctatagcacggactgccatgcatcacaaagttaaggtacatggcgaatggttcaaataagtttcacatgcgtctctgtcagtggtgttggtgacgacaagaacccgagttcagagccatgtgcaaatggttactactccagttcatggtttctactgctgtgtactactcaactattcttgcggtcctctcccaattagccaggacaactttatgctaatgccaccactttataccagaatgcttcaactgcaatcagaatttataaagcaaaacttccacaatctgcagcgaatattgcatagcatggcatatatgataagctcatggctgttttgtctcccagtttttctggccagcgaccactaaaactttctaaaagaccccttagggccaccaaactactatcttaaggtaatgtttctttctgtctctcgtatcaaaagctaaataaaggaggagtatctgatatattccccagctgcaatgcaacatcctctctacaaaatctccccgcgaggatcgcatggctgatagcagtggcgtgaccgtatctagagatgctttgccgcgagttactggccggcctttcgtcggattgtggggaatatatcgagatcgtgtcggcgctcggcagcaacttgttgcagtaacaataataccgtgtaatcgatgccatcgttggcacggacacacgggccgctcgtcaataattatggccatggttgggttggttctttttttttagaactgttgggttgggtcttggctggttgtagccagcttgccggatatcacagcactagcaatcaatcagtacgtgaaaatggtagaccttctctttcttttgcggacatttgttctaaagcaatcgagcaacctgttcagacgttcgtttttacttttaatttgggcttaaccattgcgagacactaaaacactcgagcagcaaacgctgaaacatctcgtgtctgcaacctacacatggaacgaattaaagctgatatttattggttcagagtgggagtaggtttcagttcgatcaagtatatgcagtcaaggctcaagggccctacgtgcagtcgtgcggaagaagaggcagtgaaaagttgataatagaaagaacgagagaaggttaattagctgattaagacgtgcaggggaaagaaaaagactctggttgcagtgattcagagacgtacgtaccgatgaagtcgatgacgaggcggccgtcgcagtagcggccgacgggcatgccgaagaaggtcctgccgttgggcggcggcgcggcgccgaaggtggccgacagcccgcccgtgtcggagttggagtcgccgaagttgaacacggccgggaagcggcagtccgcgccggcggccactgagacctgcgacaccagcaccagcacggcgacggtcgccaccaccaccgcggctgcgtacggaggaggcgccattacccccccaccacgcctcgttcgcgcgcgcggggcactgcgagcgagagcgacgacgagcagagcagcgtgggcggaagacgaggcggagcttagcagcagtggcgttggcgtggcagtgggcggaaatggcgaatggagatggatggttgtggatctgcggatagagataggcgggaggcgggaccgcgcgcgtgcgggagagaacggtgggagaccccaaacgcgacgcggtgccgtggacgacagcgatgggagggggagggcgcggtgggatggccggatgggtcacactgactgacgagatggccgtggtgtggtatggtgtggtgtggtggtgcgcgggcgtgggcgcgggtcgcgagcgatggtggagtggagcacagcgcacggtgtgccggcccggtggcgcggcgcacgggacgttggatttttgttgctgtgggttcgtgggagccgcgtccatgacgccgcgctgcctcgtcgcgcgcgcccggtggtggattcgcgtcgcgtcgcgccgcaccgcacgcgaccacgagccgtaacggagatttttctttgctctacgtgacgctttggaggcggcggtggagtggcgatcggcctatgttacatacatacgcgatctaggcaaagcgtgaaccgggcgcgcgtgtacatcaatgacggtacgtgaagtagaaagcagggaagcatggcccacgtggagggaacagatgggtttgttttgctagagtggagcacatcattgggctcaaatagtagtgtgatgtatgcctgtatgagccttatctctcggtcacttggtgtctggatagtgggtggaataagttcaccagagatccctcaacttaatattgagattttttgaggtcccttaaccataaaaccagaaatatatacccctaaactcactcaaactgttcaaaggaggtcccatgacagtatcgactacccggttttgctgacatggcatcctagtcagcaaaaaataaaaaataaatatgtgggacccacatgtaagtgagaaaaaacgtggggtcaacaatcctagtcagcaatctccttctctttttcttttttctcttcttctctttcagtagcggtgcgcggtcggaggtaggcggagcggcagcagcaggcgagcggtggctccgggctcgggaggtggacgcataccgctctcaacactgatccggtcaaatccagaagcggatgcagcttccgccggtgatgccgatgtgaagccatcatcattctccggcgatttggggttcccctcaccattcaccatggtggtgatcatgctctcccttatgatagaggcgtcatcatcacatcccctatcgacgtcacatccttctgcgatcgcaccgctctccggcttgccgtcctcatctgcgtcggaattgatgcggcttgacgacggagtggaggtaatggagcgtggcggccacgtcgcgagcgacggcaaggcagcggggccactccaccacgagctccgagcagcgccaccccagcagcgcgtcctgcagcgacccattgggtatgcggtcgtacgctagcatcatccgccgcggccgcccctcgccccgcgccgcggacgacatcgagtacgtgaacggaagcagtatggagtcccgccccttcccacccggcttggcggcggcggcggggacaggaggagatcccggtgcggaggacaacgcgagaaggtgggacgcgacggcgaactcgttgtggaactcccgctccccctgcagcgaaccagcggcatcccagcaacccaatccaacgggacgcaccggttgcttcttgagcagttacccaaagaggaggacctgctcgaccgtcgtttcgtgctacgggaggcccgcctcgatggcgcttgcaaggagattgtgttcctctaatgcatcttattagccttccatgcgcacccatcctcgtcctcttccactccgcggtcacgtattgtgaggcgacgatgtgccgacgctcctagatcccatgcctcgtgtcactagtctcgttgttggtcatgctttgggtgttgcggtacaaggagatcgagatagagggtctctccaccaaattgatgggccggtggccggttccctcaccatcagcatccgcctcctcctaatctcagcctcccggtcctatcccctaccgtgaagcttatggtgttgatgcttcgctgcttgctgcctcatatcccctctctccccatgccatggtggcaatcgaggaggccatagggggagtgaggaggcccaggtgagaagctcctcgtcgccttgccgaccaccgctttcaccttcctgtcgaggagctagtaagctcgagctcatcggccactactattgatgatgtccatgttgagataaataggaaaagtagagaaagggaagagatggaagaagggatgaatgttccactgacacgtggggctattgtaatttttttatttattttggtaggagtgccacgttgatgccacattagctaaaaccggacataataatgttttgggatctcaagtgcaccagtattgtaagctgagacaaacactatatctggtataatacggttcaaggatgcaatttaaactcgacataaaaatgagggataagaagtgaatttattccgcatgtatttgtatatggaccaaaattttggcccattaaaacgtggcctcatgaggcatacgagcgacgtggatacacatggcaatctccagctttactgtggtggatcgctctcttggttagtagatttgaaatgtccagaaaaaaaaattactagtgcgaatgcgattttagagcatcggatcaaaacggctatgcgttatttgggtggacatctgcaccgcgatttccgcaacggccgcctcctccttctccgcctccaccctctactgcttcgctagtagcttctctgtctgaggatctgcaagaagctatcagcaaccgcgctggtagggagatcatgattgtgatctgcggtcttaccaagttacaagatgttgcgaaggtctagaggatgctgcatgagaagataagagaagatagatgggttggacagtagaggacacaaatatcaaagtcctcgatgatgcaacagatcgatgtctgagtcttatggttttaggtcgttcattcagttatgtgatgttccaatcgaatcaaggaaggtactggaactacatgtgtttggcaagttgcgaagagagagtaaggtgcctggactatgggaattggttggtgtagatgaggccatggccatcgcaatggagggtcagtccattctcagagaattggatctatcggatgaacaaccattggattctgacaatgattgggggggtgtctgaagaagcacctgatgattatgacagcctgagtgaggatgcacctgatgattatgacagcccgagtgaggatgcacctgatggttacgacagcctgagtgaggatgcagcgaatggttacgacagcctgagtgacgatgcacctgatggttacgacaatccgagtgaaagatgcaccttatggttacgacaacctgagtgaagaagtaatcaaggatgtgcaagttgagccggcatttgtatccaaggctttgacctcattagaagaagcggtccttatgaagagcagaatcaacaacctgaaagagcttatccagaaaatgatcaatggacccattcgttttccacaaaaaagttaggaagcaatccacatgatgaacataatggaatcaacaatatgaaagatcccattcccctctctctcgatcaatagaataaacaatatgaaagacccccctctcgatgagcagcaatatgaaatatcccctttttgataaacagaacataatcaacaatctgaaagatcccatccccactccctcttgatgaatggaatcaacaatctgaaagacccccccctcacgatgagtagcaatatgaaagatcccctccttgatgaacatgacataattaacaatctgaaagatcccccttacagaatcaacaatttaagaaaaataaaactgtaacgatttgttattttcacctttacacttcttacattttataacctttttttttgactatgagactgaccttgctcaattgcaatgatgatgcaatgatatgagatgtagtagcataaataaaagaaatgttatctaggatacaatgctctggagtggatatattgcaaggatatcttcaaaccaattgtaagaaatattgtacatgatagctcaaggggatacaatgtttgtcttgtcgaccccgattttggaaatcggagatcttctgtgtttatcagtaccaatctctggatcagaagttggtacacacatacatagttgaatcacaacacatcacgaatgctttttttttgataacaaagaggcagaagcctcagatttaccaaggaagaactgggtgaacaaccagttttacataaaagcccctaaagatgggcaaattacactggaggatacacttatgcagtgaaggacaaaataaagtttgaaaaaagccatcaggtcctgcacaacaaactgctcacaacagagatgaagaagacgatgctccaggcaacggcgggtactgagcgctcacgataggttgcagaagattgaaccatggcataaacccagttggggcctcacaaaggaggttaaagccttggtttttcacatacaaatacaaccatatcttaaatgcttatattagggccagccatgccaacaactatcagagaacaacagcggaagataaaataatacaagtgcccaattaccatgccacaagcagtcgactgggaacaagacctagaacggaattacactacgatcatcttgttaggtatgcaagcgcactgacaagggtttctcttcaagcactatgctatatatatatatatatatatatatatatatatatatatatatatatatatatatatatatagtaacattgagtacaaaagtactcagcaattcaccacacaaaatgcaacaatgtacaagataatacaaggagtggctatggttattttgcataaagctaagttcacaaatatcatttcacaaacctaaaacttagcattgactactcattcagtttcacatgggttataaggaaacacaacgtcgtcttcttgcagttaccacttgctaactgatgtgtttgacattgtgcttctatttcgacatatagatgaccttttgttgtcttctccagggtgatatatgtggtcattacattacttatcagattagttaggttcagtttaatggtaacatgtcgtgtttatgtatctctttagtactccctccgtttcgaaatataagaagttttagggttggacacagttattaagaaagtaggtagaagtgagtggtggagggttgtgattggatgagtaatggaggtaggtggaaaaaatgaatggttgagggttgtgattggttgggaagagaatgttggtagagaagttgctatattttggaacgaattctgagggctaaaagttgttatattttgggacggatggagtaatattaatctcctttttcttaatattgaaggattactagccaagtttgcgcctttgcggtgctacttaacattgatgcaacacagttgatttgatcctgttccgctagtggcagacggtagtttaaccattcggtgcgtgtgtttaattgctgaggtgtacagatgtataatataccaaaactattttttcccatctaagttttttctactttcaaatgtgtactaaagcaaacttgcatacaacattctgtgcatacgtgttaatggtaattagtactcagcacgtgtcttcaacatgttatagcaatcatgcttaattccacgtttaatttgtaattttttggagccagtttgcgcagttatgtttattctttgttcattggcatcatagaccagcgcaacgcaggtccaaagattaatgagatgcggacgtgtcagtcagtttgatcctgcaactgacaagatatgtaaacagcagatcaaaacagccgatcggctgacaagccgatggagtagttccagccagtagccaataatagccgatgtcgatactagccgatagcgatagggtttaagcaatcggctatatgtccaatgtagataacgatataaaggcaatcagctgatgatgatgcaataaaataacaatataatctagtataaaccaatcgactagcaatgatatgataaataagcatcgatccgaaggttaaagcacacatcggctggaggtccgatgtcatgaaatccacaagattagattaaacagttaaacctttgttgtcatcggcgaaatccagcttatatgtatgtgcaatccttatgagccaatacaacgtcctgataactcaccggctgaaaccccgatgaaacccttattggcaatcaagaagcaggctagagattatggttctaagaacgacttagtagatcaaacttaactgatgcagcactaagtatgaaaagaaacataatatctagacaatcaagctgttgactgatttttagggtggtagatgtctgagctaatctaatctagcaacgcgatttagtcgatatcggtagaaaccctaaaacgagaagcagccgatagagctaaattgatatgctaggactagattaatagagacatatgataaataggtaggcaaatatatcatccaaaccagagcaatccaagaggtcgaatgtactgatgcagctttgaatgacgctgatgtagatgagacaattgcctgggccgacggaacattggacttatcccttcgccggagatcgaagacgatgcagccccgcgtcgggtgccaagttccacagaaacgtaaaaaacaaaagtagaagtaaaaagggtggcgatgcgccgaattgtattgatcgtagattgatagattacaatgaccccgggtatacatatttatacctatagggagatactagtccttgtcggacaagaaagaaactaaaaaggaaaagataaagtccttatcagacactaaacatactttcctaaagataaaaggaaactaacaaactatacctaattaatagataactgtcatgtcgtatccttcttgaactcgaactcttctagataagcttcctttgattgatccgactccaccaagaacacgacatcgtggcgacttgactcccatcggctgattctagaactttgaagccgatactgactctaaaccgatggtaactttgggcttaccaaacataggtgatatatagctcgaagcattatcttttttgataaaaccgtttacacatgtgttttttttaagatattggctacttaagataatcttaaattttaccgataaagtatgtctctagggtctttgatgaaactgtttacacgcgtgtttgtttgagtgaagacattgctattcaaataatcgccagttctatcgacatcgtgcaatcaacctctggctccacgctttatagtctactccctccattctaaaaataatcacttatccaatttcgttgattctttttggataaagggagcaggactcaggtccattctaaaaagagtcacttatccaatttcgttgattctttttggatgaagggagcagtacttaggctgagttcttttgttcactttctcaactcaactctctcattttctgtacgcacgccttttaaactgttaaatggtactgtcggagaatgaactcctccaccagggaactgtgaggcccccctttgtgagttcggccgggggcagcgggtgagattcaagtgagattcgagggcttggtgagcggagctgcgtgatcttgagggggttaggcccctccaagacgatgagacaaaaaagatttatataggtttgggccgctatgaagcgtaataccctattcctgtgcatgattgattgaatatagaacaccagtgcttggggttgcgagacccaagcgccagttcgctcggaagtcccccctctccaccactaggcctagacctccttttatacctcaaggggttaccacatgggcctaacaacctaacctaactccggtggagaagtattataatttttgcattaaatgcatgtcttgtcttttgacttgggaagccaagcacacgtcgtcttgatgatagggcctgtcaaatcttgccgcctgacacggggggtgcccctgtcagtcaccatttaatgggtgaagacttctgggctcctattacactgggaaacgggagccttgctttgaccagagcgggaggatcgactccggctgggataagaggatgagaacctctcaccatcattacattatttgatgggatatgtcgggctgcacgtcgcctgacacacgcgatggtgcgcctgacatcttgggtcccatcagtcattcgaccggtcacagacctgttgagtgcactgcacaccgcattaaatgcggcgtggcgcgaccgctcgggacgccataaatgcaggtaggtgggcacctggaagcggacacctaacccaccgtacgtggtgacctagagagggggtcgggggagcccgacct

SEQ ID NO: 17584 - DNA, 43444 bp, Oryza sativa
  unsure (1)..(43444): unsure at all n locations
atcccccctcgggagggggcgggagggagccacgtggcgcctggggcggccttctccctctagtctcggccagggagtggtcgccgccctacctcgggcccgacccccctcgggggagggccacgtggcattggagggcagcctcctccatccagtctctgggaaggagtggccgccgccctacctcgggcctgactcccctcgggggagggccacgtggcatcggggggcagcctcctccgactagtctttggggaaggagtggccgccaccccacctcgggcctgactcccctcgggggagggccacgtggcatcgggggcagcctcctccctctaaacctaatactcccgggcccatatcaccgacaggtacgtttttttaaaaatttttctataggacaattgtttttaaaaaacatattaattcattttaaaaaattagttaaaacttatacatcgtttgtatgccctcctctcggctcctcccaaacaaagggcccgtttggggagattaagattatgagaagcagctggttggtagccagtatttgaaaatctgaaaaagctgggcttttcaacttccgacttctaatttattttctggattctataaatacaacctctcaaaatttaaaccaaaaagctgtaccgtctcgaagcttctaattatgaagaaactaaagcagcaagctcccaaacagacccgatcctcactcgagtcgagtctcggtggggaggcccagaagggtcaagaggtcaaacagccaccggttcgcccaaaaccacgtacctccccgtaggccccaccctccatagaccgcgaaccgcaccgagcacatcccatccgccggtctccatcgccctaccatcccagccggtgggcgtcccctcccgcttccgctccgcctagcccaaagctgcgcagcaccctgaacggcaccacaccacggaacccctcaatttccacgacgcttcctaatcctccctcctcatcaaagccgtcacctcgctcgcgtcggcggcctcgactcccctcccccaaatcggttcccctccaaaaaaaccaaaccctcaaaaccctcgcctccgctctctcgcgcacactcgtgctccctcctccccccatccatggcttcctcccccgcctccgccgcctccgaggaggaggccgtcaaggtgaggtttccgccgctggcgtcgtggggggtgtaggggatctcccggtttgggcgtttttgttggtggagttttggggggactgattcggggggtagttatttggggtgcaggcggcgaaggtgctgatggtcggcgccggaggcataggatgcgagctgctcaagacgctcgcgctctccggattccgcgatattcacatcgtaagttttttttttttttggcttgctacgtgtttgcttcatccccttactcgcggttaaatttgagctgttcctagggttttagccgtgtttcgtgaattgagctctggtatcatctaggtagatgcacgtggattgctgggtgtctccagttaggtagttgcgggatctgtgatagggattggaggatagcgttgaccccagctgacaagtgggcactgtgtagagtatgcgtgggttatccggtgtctatctggagttttttacttagtgctgatgtttcagtatttcttagtttttttgtgaatcagtagctttgtgtattgtctattgtttcaccaattagaaccatgaataaacaatccgtcaggaactttagtattctttgcaaccatgcttggcagggattgttttgtgtaggtcattcttgttagaattcgtcataaaagttagtcgatatagcggaacgacgactaaccttcctgatcacttcagtcattgatcgcccaagacacgccagatgacgacacaggaacacacgatatttgttaacgaggttcagccgaagcctacatccccgaggctctgattatgggcgctcctccccaaccaatatagctcctagccgctacgagtccatggtcacgccgccatcatctccctgcgtgtctacgctacattgtagtcgccatggttacattgtggtgcgcccctctctatttaagagagatgccgggttacagagttcgactctaactccaccccctaacacctattacaactacaagtccaactgtaaccaaatagaactagtatattcgacacctattctaacagaattgttgctaggttcttactcttagatgaactgttatgctgctgcccttgtttcgttcactgctgatatgaaagcctccattcacatgacttcttttgaggttgatgtattgcacttggaccagtttggaaatagacacggtgtattctttgttcaggtatccataactaaatgaaatggtatttgaggcacctaagtttgttatccacacaatgccgacttggctgctattgatttctgatgattttcttttttggactgacgtttgtagttatgtttacaaagaaggaaataaaaccttttctaggaccacatgtcagtatggtactgggagataaattaaatcctcgtctattattttcatttcttttcatattttatctgcttttcgtttttttcttcactgatccgtttcttgcttctgacatactagtttacattacattgtcaaagggtcattttcccttggtgttgatggagctaatgaaaaaaatatcttgatttcctctcaaagtgttgtacacaaggaatttgatctttttctctacagattgacttggacacaattgaggtgagcaatctgaacaggcagtttttatttcggcagagtcatgttggacagtcaaaagcccatgtaagttacatttctatatgttgatatgattaacatagttgtatatgagctttctattatgtatgtatttgttgtattcaccttattattgctgctgcttattctgtttttgtcattgatcttgtcaggttgctcgtgatgctgttctgaaatttaggccaaatatcaatataacatcatatcatgcaaatgtaaaggacgctcaatttaatgttgagttcttcaagcaatttaatgtagtcctgaatggccttgataatttggacgctaggcgtcatgttaatcgcctttgccttgctgctgaagttcctttggtggaaagtgggacaactgggtttttgggacaggtgagttaagaaagtaccactgctctggtccccgtaactcttctgcatgtatgaacggatatataatacactctggcttatcttcttcgtaatctgtatggttaataagatttaccagacatacggccttctagttgagtatgttttgtgcacttaccattgttcactgtgatcatgtgggtccagagggaaagtgtggttgttacttaatcaggccgttttagtgcaaattatctaatgttgatcatagaacaggttttctaccttctccacaaagttcctaaaataatatggtcatttagacattatccagccttatttacaatctaactctttatacagctcaaatcaactcctggtggtagcttggccaatatttggtgcatgttcatataagctgcacaccttttaggtagttacgtacattgcatacagacattacatacttttgaagtgcacatgaatacatgatgtatatcatttgttggcctgtgatgcatgggactctggtaggcaaagctgaagagttcttttgtgtaccttgatgtattgtgtttattatcttgtgcatgatgggttttttgtggtctagaatctagattctgggcttaacaatagtgtcatttaaatcatcttctttatttttttatcacgtatatgtcaacaactaactgaaagaagctaccagtgttcactaaattaactaatggatgaatcgacctcggtcaaattattctgtttattattatattaggccgcaggtggtagaatccctgtctcacgagcaaaacagccaagtaagctaagtctatattttcaagttaattctcttctaaaattatttccattccatattttgcaggttactgttcatgtcaaaggtaaaacagaatgttatgaatgtcaaccaaagcctgtccctaagtcataccctgtctgcacaattacaagcactccatctaaggtttccttttgtcccactttcctcctaattatatccctctactgtgaaaatattagtttggaatgcccttagtcaaagtgcaaacctataaaaatctgaccacttgtgggcatattattagaacttaccacatagggatatttttttatttgtattaataatacggtatttcgtcacatctttttgtattcttttactaatgtatagtctatacagttacaataaactgatgttttggagtatgcgaacaaacttcataaaaaacagctatcagtatctttggattttcagattgggcttacagcaacaaaatgtgcaaatctgtccaaaatgtacctctgtaacattataattttaccttattttataaatataatggagtctattagtcaaagtagttttgaaggatccccccagtgtccaaaggccacctatttgcgactggactggaggaggtaaatagactaagtagttgtcaaggtgtgcattggaaactgtgtcaatatccaaaatggcaggtcacgttgacaaattaataaagaaagaagatgctatctctcctatgctctccatatcttcagttctcccatccaaatctatggacatctcactgttaaaagtgttctaatccatacataacttgaaaatcctcaatatgcagaaggcattcttttaacaagcacacactccgctttatggcattttttgtaattaaaaatctgaacttgacttcttgtgggaatactctgtgaacttgaccatttggaacaagcactgtgctgctctgatcagtttttagtgttagaattcattactgactttttcttttcacagtttgttcactgcattgtttgggcaaaggagttgctttttgcaaaaatgtttggggataaaaaccaggacaatgatcttaatgtccgttcaaatgaaagcggcacttcgaaatcagatgtatttgaaagaaatgcagatgaagatcttgatcaatatgctaggagaatttatgatcatgtctttggttacaacatcgaagtggccttagaaaatgaggaaacttggaagaatcgaagaaggccgaatccaatatacatccgtgatacattacctgaagaagctattcggcaaaatggtagttcacgggacatcaataatgagcaggaagaaccatctgctatggtctctttgggtcttaggaacccacaagaaatttggagccttgctgataattcaagggtatttttggaggcattaaaactattttttgaaaaaagggagaaggttgtattttattcggatctaggttatgtaacctttaaagttacttccatctgagatattttgctcttctggttttcaggaaatagggaatttagtatttgacaaggatgatcagttggctgttgagtttgttactactgcagctaatatcagagcctcctcttttggaatacctctgcatagcgtttttgaagctaaaggtgttgctggaaacatagttcatgctgtggcaacaacaaatgctataatagctggtttgattgttattgaagcaataaaagtcctccatggtgattacaaaaaatataggtgactaggctctttgtttgtttcatgtcattgttgtagcatgtacttcttttttttcctaaagatagtaaacttaagctaaaatacctgctctctggtcttctggatatggtaatgtccagagagttctaaggtgctgccaattttctggaatttaatggcacttcattggctaacaattttacagaatgacatattgtcttgaacacccttcaaggaagatgcttttgatgcctatcgagccatttgagcctaataaatcatgttatgtctgctcagaggtatttttgcactttcttgggctatgatattcgtatgtttgttcgctttctttcaagtctgacccaaaactgctactgaatgcatcagacccctcttcttctggaggttaacacaaagacaacaaagctgagggaggtcatcgagaagattataaaaagcaaacttgggatgaacctcccattggtaatgattggctccactcttgtttttgaggatggtgagggcttagaggaagatgaggctgcaaattatgctctaaaccttgaaaaggtactaaccttcccccttcaaagcagtgaaattatatcctccatggaatttctttctttctaagctatggcccttgcagttgcaacattgttaaaatactattcattttttgccaactgagctttgtctggttattacaggtcttggctgaacttccagctccagttgttaatgacacaaagcttactgttgaggattttcagcaggaattgtcatgcagcattaacattaaacacaggtaacctatgaaccatgtatgctgatctgtttgcatatgggaggtctttctaaatgatacttatctatatgtttttcacatatatttcaatgaagagaaatcctttgccgtccaactatcttctcaaaaggttgggatcttgccagatgtaaactaaaaacagacaattttgcacaagtgaaaatgagctgctactaatttgctatacatggaccagtggtttttcacctttttcactaaagttatcatttgcagagtattatgatgtcacaacttttagtttcataaaatgtcctctacgtataactttgttctaacatgtaaggttgtttggctcattccattacatggatatacagtagcttataatgctgtgctatgtagatttggaagctatatgttatgatagtgtcgtagtgtacacatacagttgcctactctttcaagggggtagactgatttttcagtgattattacagggacgagtttgatgaagaaaaagagcctgatggaatggttctatctggatggtctgctccagtggagaagcaagttacgagtaatgggggaaaccagtcggttgcttcttcatctggtgcagattatgctgacggtattgttgaggacatatccactaaacctggaatgaagcgcaagctggatgaggttttagagttgaaggagaattgcgatgcatccagtagtgctcaagttgtcgaagatgacgatgacgacgatcttgttatgcttgatgagaacccaaagttagccaagaaaaagagattgcaatagcaacccctacggtatctgttccagggataacagcggttgacttccgctattatggctaacacattgttccaacgtaacatcttttgtaacttaatgatgtttagggctgataacactgaggtatcagtaagcgtactcagggtcatttttttgctttagatacggtactttaggaatgtaatttgtagcgtttaggcacaggagtgactaatgccctgctgacagtcagctgtaaggctgcacctgtgtttgtctagactggagcaatggtgatgttcttgtctactttctcgtttctgctatgcggtgatatatcttctgattgttttcatggttccgttgccctgatacgaggaatatattggtggatttagacttctatatagtgctcaaagcctcaaacgtcacaagaaagcagttcccacctgtgctacgtgttataagcaacagcaattttctcctgctgagttttctcccgttaagagatgcatatcgttcattaggtcttgagagatgcagatccggcccagttcttttccgcttaatgcatcaattgactctggtgtaagaactttatatataaataaatactgttacctcttcatcccttgtctatcactaacatccatatgattttagatgcatatgggttcaggtaaaaatctatttaaaatccaaaatatcttataatgtgaaaaacatcttataatgcggaatagaggggtataatagttaatccatgtattacactcgaataggtacatctcctcagccatccatcatagaacacaattaaagttgattagtaggataagcatctatattaggttcaagtagaggttgatcctaagatgaattcctttcagatgaaatgtggatgaaatctgagtgatgatctccttatatttgtaaggtaaaattaaatatcactcctatgttatgagtggtagtaatgttgatggataaagtttatttttcagaaattgtatttttggaagtgttgtgcaaaggcaactgatccacagataagctgaaagtagacctatggagtacttgagacaaacgaagatgaaatcacaaacacaagggaacacagtagggctcaattttttaataggaattgatcaaacctgagtataaggaaactagaattattttcaactagaaatcgaccaaacctgagtataaggaaactaaaaccgaattgcgataaaaaacagatatatcaaaaattgaattgaatctctacgaagtatactagtattccaacatctctcgttttctatcttccattcagcaatgcgatcatcatatcacagttgaattgaatcaatattccaagaacactaccccatccacaagaggaaacctacaactctgacgccgcaattccccaattcagggcaaaacactcgtctcacgaattcgaaacaacaaatcaatcaatcaatcaacaaaaaaatcaatgcaggaaaatccgcgctagtttccggccaccggccgtcctcgcgaggccgtcgacgagcgcggcgcccctcaaatggcagacgagggcgcagaaggcgatcccgagcagcagcgccgcgagccgccggagcccgccgcctcgcctcctcctccctcctcctctcctccacaccgccgcccacacgccgagcgcctcgccgaggcccgacgcgttccagtagtcggcgaggacggccagcttgtcgccgagcgccagggagagcgccagcgccgcgagctcttccgccggtgttgccctcctcctcccccttccccccatcccgaaccatcccccaccgccgccgccgccgccgaggaagaggacggtgagggggcgcggccgcgggaggaggcggcggagggaggacgagacgaggcggcgcagcggcggcggcgggaacgcgacgggcttgggcttgggcttcgatcggcggccgcggccgcgctgggcggcggcgcgcggggtgaagctaacggccgtggaggcggcgagggggaggtgcggcggcggcgtcggcgtcggcggcagcatcatgtcgttgcgtgcgaattgggtggagcggatcgagcgggagggggaggaggaaggcgttcgcgtgctcctctcccccgaccaatttggatttggaggacacgaattgcgaaatcgacgtgtccactgctgctactgtcgcgctctcctatgggtgaaggttcattctctgctcagaaattcatggctcgctttttaaactgctaaacggtaagttatgtgagaaaattttatataaagaagtttctctaaaatattagataaagggtgtagctatatttatggcgctatattttttatcaaaaaatagtcggcatgtatttacattgtaagtccctaaattacatatgtaattttagtgtatttacaatgtaagtctcaaaattacatatgtaagtactaaaattacatatgtaaattcgaaaattacatactaattacaattagtatgtaaatttgtaaatgaggtgtaactactgtgtaagtggctgaaaaaaaatcgactgtagcatatggcgccatatttctagcaactccgtagataaatatattttcaagtttgtaataattaaaactcaattcatcatacgttattaacaactcgttttgcgtaaaacatttaatcttcatcttcatctacattagtttcaaacaccagcattgtatgaaattctacaatcttgcttgaagtacaaaatcaaataatcatgaaattgattggaatttggaagagtgtatctctttgcactttgaaagcacaagtttataaccaatgccctatggtgcattagatggcaaatgcgcgatgttcaggtaatagaggttgagtccctaaaaaaagttgtatcaagttacatggtttgtttgactgtctattttggtttacaagcagcaacgaataaccaatcaaaactcggggcaagaaaacagctttctttggtttacttttccttactgaaaatgctattacaacaaatgactgaatgaacgtaagcaattgagcatcactcatatcatgtctgctcagtcgattgagggggtccgacatgctctttggcctttatgcatcgcgcatctctttctccctgcaattggctgattcttacaaggagaaccatccgaagctcgagcaccacagattgatggccatcctgagcttccggaaaacggtacagaggaagcatcggtgacctttattccttcatgcgcatcgcatctttctcttcctgccattggtattgtttcacggcatctgttgtccgtcaacgcttcacagatagctgcgacattgcctgtcactcttttctgacgtccctggcctttggatgacagtgtgctggtaggattctgcaatttgatcagctcaaaccacattcttccggaaggctgattctcttgggactgatatttaccatgagaaatctcctccccactgagcttgtcaactgtcatgcttttgaccttttcttcattctggagcaaatcaatgactcgagatgaaacaaactcttctgctttgcaaccattatgcagctgacattttttacttcctgaaattactttgttggtgcaggcagagttgtcactctttttggcttcacagatatcaatgacctcagaggtttcctgttttccatcttctataggagcttctccagtttttatttctttcgcttcaaagctataccatggtcttgatgattttttcactgttgctggcaaaaatttggagaggagttcactggtttgctgtgcttgatctgactcgctttcattttcagttagtggagatatggattcaacaactggaatctcaacttggcaagaatagctacaagaggagcctttaggattgactgtgattcttcctagtcttctacctttgtgtaattcacacctcttccttccttgtactggatggtcaagacaagaggagccatcttccagcatcactccacaaacatcgttagaatcttgttctggcatagttcttcgttttataacattgactcttttgactttgtatccttcagaacttcgacgtgcttgtttgccataactgttaccttcagatgtatttttccagcgaatgccaatttccttgtcaacattgtcaccagagttaactagctgaggtctgaagccaacaaatgttcgaattcttgggagcatatttttcataatgccagatgagacatcaacagacccatttctgcttatctttatacctgctttctctctgaacacttcctgtttgaagtgccgtactctgctaagcagagatgatctattgttgactgccccttgttctaacttgataagtatttcttcacggcgaagaccaccgttctgaagcttgttccatgcgtaatcaaacactctaagcagccgagcctcagtcttctcagcttcttgtttgttacccatctgtttatttgcacattaaagacacattagaaaagaaaaacgaaatccagtgctaattgctaaaagtggaattatgccataagattcataacttttttagggcacataatattcatagttgaccccgttgcttttgcaaaagctactaaagatatagtacttatacactccatccatcatagatactctgatagaccaaagatcttaactagttattaaaagtgataagatgaatctgagtgtccaaacatttgtcatgagcaaagcgtaacaaatcggatagctgttcgtgtagactacatgatagacaatgctggtgctgaagacaaaatgcatttttcagttcttcaaacttcagacttgggcatggtataatctcaaaatttgtggcaattgaccatcaacttctatttatttcactcaacaatttattcggacacgaagccattattgatctccacatgaacggtacagttcaactgttcaaggatccatttcttatctgaagaaacaaaaaacgagcatggaaagcagttttgcacttaccagagcacatcggaacaccaaggagtagcctctgacgaaaacttccctgaacaacccattccccgtcgcccgcgtattcgtctccgcttcgccggcggacggcggtgggttcccggcgtccaagtgcgatcccgtccggccgtactgctggagcctcgccctgacgctgtcggcctgcccgaggtacacgacgacgacgccaccaccaccggatccattccaccgccgagccgccctgataccctcgtcggaggccctcgcgacgcccagctcgtagaggccagggaagttctccggcaggttgagcaccctgtacctctggatcccttccttgccggcggcgtggtcctcccagtccgacggcccgacaagaacctgcaaccaggttggggaattcgatcgaggagcaaaaatcagatccaaatcaattcaagaactggcaacgaaatcggaggcggtagatggcaacccggggagttcaactcgactccaccggatcagatctcgtcagctctgcgccggtggcgggttggcaaggggcacctaaccttccatggggagaagagggagtcgtgcttggtgcgtgggtagtcctcccgcttcagcctcgctgggacggcggcggaggccgcaggcatcgtcgatccggtccgcctgtggctgcggagtggtgcgctctcagtctcagcgccgccggagccgccggcgccgctgcggccgcatcggcgccgggagcgggggctcgtcgctttttgaaaatctcgggttctcttttgggctgggtttgggccgtgagcccgcggctcgatccgacccgggcctgggcgctgtttggttggggttggggaaacagcttttgccgtgtgcgctcggccgttggattgacgatccgatggtctggatgagggtttacctaaccgtatggttattgtgattatcacatgtggtaacttttcagttttggaaaccacgatatacctcgtgataaccgcgcggtaatcgccaaactgcggggtgacggtaaccccacctcaaacggtttggtaaatcctagtccagatcaagagtggtggaaaaacaaagggggtttcatttgtcaggtactctaactgtccaagccattcgagctatagtgtgactgtgtacaactcgtgcggtaataattgtggtagattttcactatatattattagagaaaaatatgtagtgaaaacttaaaacttttgtaggatgtaaaaatatatgtatgagatttgtctacgtcgatatgaataaaagttttactcataatgacataaataatccgagacatttatttttctatgctatgatagtttttagtttttttccactataatgtggttttcattacatattttcctcgcaggggaattaaagggggcacattctcttcttttgcctcagattgagggagaaacatgttgagaaaaaattggtgacatgaattccccatgtccctcatatagcactttgaagtttgaaatgatagtttgtctctccctccccattttgcatggaagacatgcatgatgtagcatgttttctgtaaccagcgacggacatgaatttcctagttccgaacttacacatatatatatatagcttgtttggttcgtggccaatctcaatcaattaaaaaaattgtttatttctactagtagaatctgggtgagtggacgatttacattttatttactcttcgatattatcttccactatgatttaacgtcaatcattgatggtgatgtacgcgaaattcgatcggcacaataatcggtcgctgatttaagatattttaatttgtttccttggtgttttcaggagaagacaataactgttttgcaacccgttgaggcaacaatggttatgcatattttgtcaaacatatatggatatttaacaatatgtgctatctatgcctttaagttggtgttctaaatagttttcttgttgtctatgctttcaagttacgattttgtaattcgcagttgttcgacctgcaaggttgtaacatctgtaataattgttgtagcttttgtgaaataaagatagaaatgaatattgttgtttaaaaataatatagccatgatggggaggcctggcgatgagtctaggcaatcaatgtgttcaggtcttaggtccaagccatgtccacaacaggattttctctctttaccttgggtcctatagagacttttattgctttacttgaattggtaagcatcttcagcaatagctcctattttagagtccctaaaggttaaatgggggctgccctcatttcctcaggactctaagaatggttctaactccagcaacaacgtctatttcttagcccctatttctttttctcctctatttcatcttataatccatattttatgtttagtttaatattacaataatgtaaatattaatatttccaacgcatagaatttaatcaaatttaaattaataatttcaaacaacacaattcaattgaaatttgaatttttttttctaatatcacactgatatgtgcatatacgtacactagtgtgagtgcatggatgactcactagaatgctcgattagtgcatctgttgcggctagtagcagtagcagttcatccatcctacactcagtatccaatgatatacatgcatatatggatgcatataatcatatatgagctggacaatattaataagatatattatatccagtgcatacacaaaactgcatgcatatatgcaaggagatatagtagtagctccttctagatcagcatcaaatctcagttggccactggcggcagatggctgttcacacttaacaggaaccaaaccacgtctcatcgatatgtggaaaaatccatgcatacgtgcatccatgcaggtgaccaatactatagcagggcgatggccggattagagcagaaacacccgcaacaagacagtcggcagcgtgcaagcaatcgcacgggaaggagcacgcgtcgtggaagcattcccccgcgccaaagaaaactggataggggctggggatagagcccccaggcctaggggctgtaggagggaatttgggagccttcctactttagggccttaagtaggggccctgttgtactttatttttttagtctcaacctctcaaagttgtttaaggactgtatttaggggttttactgaagatgttctaagcattcgtggaaattgtactgcgaggaattttttttggttcattcctattcttaaccttgccattttttttttggcaacggtaagagttggtcattgcttttttttttggcaaaaaatagttagcctttcgcttagtttgctaccaaagtaagcaattagttgagcagtgtcaattttctttggctacaaaccaaataaatgactaatatttttgcactgtcaaatttactttagctagattgaatttggctacaaacttaaacagacccgagaactcaaactttcaaggaatttttgcactgcatgatgtatcaattttcccgtcattcgatttttatatacaacctaattctaaagcacaatataaaatctacagctgtacaatcgctgataccatgcaaaccgtgtcacatcagcatttcgtcaaccaggcagcaacagcaaagcgccatgaagctgcatgatcacgtaagaaaaatgtcatgaggataaaaattctacacgaaattcatagccccaagaaaacgaatttctagcatcttacaatcctgcgatgaatccacatttgggctgaggatgctccggcggcgcgggctcgtcgtacgccgccgacggcggcgccattggccctaaaaaattgcaaaccacaaaattaaggcgatcgattgaacgaaattttgccaaagcacacgctaattaatcagccaaatggcattcaaaaaaaagaaggcattcaaaaaaaaattaatcagccaaatcctctttttgccaaaggcggaatgcaatttaatagacgtttgccgaaacagcatatatctgagatttgtagaattactaattaattacctggtgctccatcgtgatgcaagctgctcgcccggtgctgcatatcgccgtttgctttgcgacgaagcgacggatcaaacgaaacgagagagagagagagagaacacaaacacaacacaacagagatgctttctttctgaacgaagagagaatctatttgttcagagcaaggaggcccaagaaaaggttaatcatgctgtgtgctgttgcgatgaacaggccacgcaggagagaacacagctggtttaaggttaggaagcctgcacaacgacaacgtagaggcaggcaggcagggtatccatctcttttcccccccggccgttaatgttagtattattgtgagccattgtttgcccgtctccagctgtatctctctctctctctctctctctctctcaggctcagctttttcttcctttctttctttctttcacctgttggatctaatcttggctttgcgagacaggaggtggtgaagtggcagttcgctttgccttgcgacgtacaggcaggaagcatacaatgcatgcacaaccccaacatagttgggtgcctttgctgtcagtggtgtggtggtggtggcatgcgttgcgtttttcaccgtcaattgtgcgtccccgtgtgcgtccttgcagttgccggtacggatacagccgggttagggcatgttgtcgtacagcagtgttacagtacaatcatgtaatataatctcgaactgcggaattgaatttttgtctctcgagggacactcgttttgtgcatgtcattgaaaaagtcatcaaaaattttaaaaatatttatcaagatagatcaatatatataatatattttcaaaaacatgcaagttaaaattcgactaatacaattcgaaataaaatataataaacttgacaatgaattacgtattctattcataattaaatttgttattgtttttctacctgttaaatttgaatattcatgctttgtgaagtaagatattacttttttttaaaaaaaagtttgatactttttaagtgacatgtaaaaacgacgagacatcctatttaagggatgaatagagttttcccttgtactcaacaattaggtgtgattatattttatcattgtattctcttacaacctacgacttcctctttttcaaagaaaaaacaatcttccaattacagtactggacatatgctatatctaaaattcgtacctagaagttttttttttcatctcttgtttggacaccagctgcctgcaatcacctcattcgaccaatcgaccactgtcatcttgttgtcatcgtgttatgatcgccataatgttctcaagcttgttggtcgaccactccagctgttgtattcacacttagacttcgtgggtccctagatcctacgctgctcactttgctggtggccaaaacgattgttgccagcctcagactatggaaatgcaattgttgtcctccatgatcacctgatttggcatcattgtgtcaccaatcgttagatttggcgcctccaacctttgggcggatttggaatgatcgagcttgttgatgaccgtatacagtactccctccgtttttaaaaatataacactgttaatatatattaaaaatatatatattaacggttttattgttactttgatttatcgttaaatgttatttaagtatgacttattattttatatttgcaaaaatatatataacacagtaatccctccgttgatcattcatcttactttaaaaaaattatgtaattatcatttattttattgttactttctttaagtatgacttatttttttatatttacaaaaatattagaataagagaaataatcaaatatttgttttaaaaaaatcaacgttatcacgcactaaaaatggaggtagtatctctgaccttgccagcagtactcgattagtcctgtttggagccatagtgctagctagcgaggcccttatctaggtctactctatctaccagcaagggccttggggagcgaggctacaccatcgcctttgtccgcataatattctcggccaaaacacaagtcaaccacaaagagacctcttttatatctctcccccatcttatatttttgctaagttatgagctatttttattccgtaaaaaccaagctagtacgggatgtacttggttttctatgagatggagaaaatatgtgttaaatatgcacttagcccattaacccaatctctcataactaatggttcaatatgcatctattttgtagtcaaaattacacatctatacaccgtactagtaaaaaaatgaactagagtgggtttgcaagttaacctacatgctctacttggttcatgctcctttattaaatcataagaatttcatggaaatttcataggatttagttcaactcgtctaaaattcctttaaatttcctccatttcaaaggttttagttcaacacatctatacaccgtactagcatacacgacttaattaactgagaaagatgattctcaaaccgttcatgcatgcgtagagatctattgaacatttgaactagttaacatgcatggaactgggcaaagtcaacaggccatgacaaaaagaacagtagtagctagataattcacaattagcaaaagcgtttttaacatttacagagcaagcaagcatgcagggcagcctaaaccgtgcatcctcgtgtgccagatgctttttattgttctcctcgaattgaattcctccatggggatgatcagatgatggatagctaggtacacgtatcattcgtcgtcgtcttcgtggtcgatctctctcacaacctcctgctgctctcgagcctcgtgtagccgaggatgcagttggcgtaggccacgttcttgagcgccttgccgtgccaccggccgacggcggcgacgccggtgcgcaccgccttgagcaggcagtcggccgtcttgacgacgctcctgacgcccatgggcagcgacaggtagggcgcgttgaagaggtggaactcgagcgacgccgcggcggcgtggtggtggtggcgcggcgacggcggcgaggaggaggaggcgagcatcctggcgacctggcgggcgaagccggcgccgagggagtggccgcagaggcagacgttctccgacccgaacctctcgatggtcgccctgagcgcctggagcgcgccggcgagccgcgccgagccgcggaggctgttgcgcgccagcaggcggagctcgtcctcgacgtcgcgccggatggtcggcccccgcagcagcgtgccgcggaacgcgatcaccgcccgcggcgcctcgccgtcgaccgcggccgccggctggtggtcccgctcgaagatggcgccgaacacggagccgtccctctcgtcgaccagctcgtgcgccagcctgtacctgaacggcttccaccactgctgcgccaccgccgccgcgtccctcctctcctgcctctccagctccagcaggtacaccgcctctatcaagcacgccatcaccatcctcctgtagtcgtcgtccctccacaccgacacgttcacctgcgccgccgccgccattgccatcgcaagctaagctaagctcagctcagctctcacactactcactcgatgacgccctcgatgtcgtagggaaggcgaggcaggggtggcgggaaatatatacgcggagtccggaaggcaagctggatggatcgatcaagccgaattcatttcgctttttactaattaatggcgggaataaagccaccgaatcgggagctaagctaccgacggatcggccgatcttttcacggttcctgcgacttgactggatcgacggatcacaacgatccgaccgatggatggcaacgtgcagcccgtgggtcgtaagctcactctctcacaagttcacaatagtcgcctccagctagccgtctggtttgatggatcgatcggatggtgtacgtcgttcgcgagctttatttaggggagggagcatatattcgccacggctaagcactggaccatggcttatagttcgttcgttcgtctcggtgtagtttaattgccctaaattaacatggctaaggatcgaatctgacagcctcagggtacgtgtgggtgacaggtggggcacgcgtttgcgccttggggattgtgcggggacaggtaggaggagtggggttgcttttgtcaggaggaagggtggttggttggttcgtcgtcctccggttgattagtgccgaagattgggtcgtttactttttctttgttagagcaagtttaatagtatagcctactgctagctttaatttatctatagctaatttaatagcatattcatataatagttgcttactatactattaacatatatagtccatctgtcatatacacattgcgtcttgaagtccgtgctgcagctggctacagattcgtagtctgctgcttttctctcttatcttttatcttattaaaatatgtttatagttagctaatagctcgttattgtacctgctcttatgtttccgttttcttttgggttttgggtggtttcggcgagaggatgggagagaaaaaaattagtgattaggaggtgatttgtggcacgtttaacactaaaccgaggggaatttgttccatctgatgacgttgggggaaggggggttaattcggtcgcgctccgcgtgtgttgattcgttcacacgctggcttgtgggcggtttcttctcgttcgtaatggttagacgcgggagtcaagctgcttatacgggcttggttttcttgttttcttaagaaaaaggggggccttggttttctttggaaaaagttacggggaatatgcatatttcgttcacacgcaagtgcgtggaaacatgacattggctacttcagtccttttccatcacatcaacatgtcatacacacaaattttcagtcacatcatctccaatttcaatcaaaatctaaactttgcgctgaactaaacacatccattgttctaagagaaggagagcgtttgataaatcacatagcaccttcatcaaaaaatagtttcagatttttttttcacatttgaatgtgaacatgctaatcatgtgactgaggctgcgttaacttttaattcttggatgttcaccgacaatttatcctattttaatcttgataaaaatctttatttatctttggatggtggcctcttccgttatttccccctactatttcaaagacgtgtgtacagggtttacatttcaatgaaatattaatgcgaatatggtatcgcaatatgccaataacaaataaggactcatcggttttattttccaaataagttaatacttattatacatagaacatgagaatacacaaatctactttaaaccctagtgtaatgcagagcaagaccatctcaagcccgcatggctacttaactacgagctttaggttagacttacaattttacaatatactatatatgttttaaaatatatggcattgttgaattttagacatgatgtttgactattcaccttattgaaaaaaactatgtaagtatttaccatgacttattttattattaaagctaggtactttacgggaatgctactgggcgagcgatccgctcgctcgcccagggcgatcagttttgcacacccccctccctccctccacatctccaccttgtttccttttttggcaccgcattacttttctattttagtaaatttatacacctaaagtttacacatctaaagtttagagacaaaaaatttataagtcaaaagtttatatatccgattcaaatttgaatttgaattcaaatatatatatatatatatatatagtatttctatacatctaaagtttatacacctaaagtttatagacctaaagtttataagacagtttatatacccgtttcaaatttgaatttaaattcaaatatccgattcaaatttgaatttgaattcaaatatttttcatatatagtatttctatacatctaaagtttatagacctaaagtttatatacccgattcaaatttgaatttgaattatatctgattcaaatttgaatttgaattcaaatattttctatatatagtatttctatacatctaaagtttatacacctaaaatttatagacccaaagtttataagtcaaaagtttacatacctgattcaaatttgtatttgaattcaaattttttatatatagtatttctatacataattttttctaacttttgtttttcaaaaaaatttgtgtggtctactgtagtagaaagagaaggggaggaggaataggggagaggagggaggagtatagggggaggggggccggatccgattgcctgggcgatcgcctggcgatcgatcgcccattaaggccccccggtactttatatataacttataatcaaaccttgtatccaaaagtcactactttacagacaaatagtactatttcataccgggcatagaaaaaccaccattttgtgtttctttatgaagtttttactatctagtctacttaattagcagagcacaggttattttttgtttgtacctgttcagctgctgtcttacggctgtggcacaaccggcaccaatagtgcacacgcatacggcatggccacagccacaaccagcttgccgaacgggacctttgtttgggcttggactggtcctgaatgctcaaaagggcccgagccgcccggttgacccagctattgttgcttacataaacaggccgggttcgggctgctgaagcttgcagagccaagctgggttgagtggttgaggcgttgagccacacactacatgatgttgaactgggccacgtctcacgttagatgacacgaactaattaacaacactagcaggaatctagtaattaatcaaggcaattttatttcctggagcgtgtgtttcatatatatatttccaatgagctccatgttgtttttacatcagaattgttataaccactgctccttaaatattatattacttcacattattagcaccttttgtatccatcaaacagatcggcatattaatcctgaaacccactgggaatgagaatcttgttgggctttggttctagcctacggtcgatctgcagcccttaggtgctatataaacataaagtactaatctataactcattatttttgcattgccagcttgtgatcaccagacggtacactgggcattaaaaactgaaagcatgatcacgaatcatataagtgtgatttggacccatgaaacttcaatagaatacattatcaatcttatgcttatctcttgctagactctgtgtgttcacttcctccttagagtgtcagtggagtggtcctttgtagttggcatcggtttttttttctttcaagaaagatgaaccaaaagttattatgccttcgtacgcaagtggtaaggaagaatctgcctgaaacaaaatctgaaattgttggattggatgtttgggatatcagatttcccctaatgagagggcactgttgtgacattggtgtcaaggtctcaaagttgtctagctactcttgtctatgaaatgcgtattcgatcgatcagcatgatgatgttgatgagatgttcggctaagaagaaaacgagtagaaatgcagtagcatttagggatggtagaaagtaatctctggtagtataggtgtgctagtgcaacaagcttggactaatcaggagcaagtataagtctaggtagctttctaatgctgtaaagataagattaaactaaattaaagtgaaacaaagtgagatgaatgtaaagtggtaacagtactttgatcttcaggtgcaaccgtccaaggagaatatttatcttggcgaggaatatgtctggagaatattgacgatgactgatcgatccaagctgcaatggcttatctgaaactcatccaaaaatggagactcgactactaactcataaaccctgatccgacgaggagtttcgcgtgccttcgaagcagtgtgttttcttgtgctggaaagataagtttaattttttttatgacaatgaagataagattaagttaaagtgatatcaatgtaaagtattaaagttgtaatgcttcctgtttatccccaggtgcatgcaactatataaaaggagaatatttgttttcgtgaggaatatgtgtggagaatattggtgatgcctgatcgagtttgagatggcttatccgcagaacaatggagttcagactcatgcaacactctgttatgccagaagtttgtacgcctcttagagcaagtaaaatgtgttagatgttggatgggtcagaattaggccttctccggtacaccaataccatccaactcaactaagtatgtgaactatgaaatataagtccacttgctatccctcaactttgcgtcgagtttgtttgacatcaatctccaataccagaaaccttcaaccctaaactatataaaaccgtgtaatttgggtcccatagtagtatggatgtctcgtttcgctgacgtgggatcctagtcagcaaaaagaaaataaaaaatatgtgaggcccacatataagtgagaggaaaaatatatgtggggtttacatgctctccttttccccctgctacttgcttgcttcccagacggcgtggtgtggcctcggacgagtcgatggtggccttgtggacgctgtcgcacgggaggcgggggatcacggaacctaaacctgtgcttgtccatgtctttgcagatatggaaaattttgcgtgcctccaatcactgtcggcgtcaccatccccaccccccaaccccccctcctccgatgtgcatggtggatggcaccgccacagagatgcctctcctcctttcccaaccacgacgcgagcaagtgcacggcgtgtggccgtggcgtgggccccacatatatttttttcttttcactaacatgtgggcaccacatattttattattttctttttgctggctacgatgtcactttagcaaactcagacatccatatttctattggatccaaattacacggtttttgtatagttttagggtgaagatttatgatattggagaaaagaaatgttaaacaaactcgacggaaagttgaggtggggggggggggggggctcaagtggacttattcctaggggaccagtgcagttatgtatttgaggccttgttctaaatgtttattgggccaacattattcgcatattatttatgccaagctttcaaaagtatgatttctcaaaaaaaaaaaaacatcaatattgtttagtccatccattctaagctatttacaaggttgatgatagtactacttcctataaacaagttgatcatctattagccttcatccacattattagaaagaacgggtctccaattggaaagaatgaagttcacacattttttttaagaaactgtgcatggataaattattgtttttttttgaaaaccgaagtcagcaaagctggtgttattttaagtaggggagaaaaaagtatttacaagattaccaaaacggtgaaagagaaagagagaggaaacaagaagctactaaacaatgaatacatcctaggccaataatctcacaatatttgtagctccacatatcttccatagcttgatttcatcatgtatcttgtctagaagctgcggcagggatttttcctgatttcggaatactcgtctgttccgctcacaccattttcccatgctactagcatgtaaactttttttttctttggctatgtctttttcaccttgagatgcccttctgatccaccattccaacagcggctcatctatatcacgtctggtcaatttcgttacagttcagtctacttaggattctctcccaaatcatttttcataagaatccgaaacattctggagttctttctgaataaaaggaaattccagtcttccaaacttggtgagccggtgagcaatgttgtcaccttagggagtatttagtttacgttaaaattgaaagtttggttgaaattggaatgatgtgacagaaaaattggaaatttatatgtgtatgaaagttttgatgtgatggaaaaattggaagtttgaagaaaaaatttgcaactaaacacggccttatatgaactagtgcctgcagaaacttcaatacaggggatgtgttcaccaaatcaataccaactcaatgcatatggtacgtccgtacatgaatgtactagactcctgcaggtggcattgcaataaatcaaagcaaacgaatctctttaattaatatgccaccaatactttcctttctgttctttaatttgcttctgttggtgttggatgggccaccaatccaccatacatgtgatatctggcaccctaaaaaagatgaagagaagttgtaaagacgtacgagagatggatttgagatcagttgctgctaaatcaagcaaggctggttagttataaattatgcaggcattgcactgttatcatgcaaaaagtcccctgttcaaattaggcaaatattttggagatgccatttcgaccatgtaaagtatgtgatcagattacacatatggttggataaatagttcactaatgttcaatttttatacccacgaatattacgtatatggtgtgttttcaatagaaatttagtgaggttgacctccatctcattgagaccgtgttaggaaacacatttgcaggtgtgtgtggtgcgcatgtgcgtcttccttccataaaaatcgttaagaaaattctgacttatcataagctagcactggtcagccatcatatgatcccatttcaggtttccccctcccctgagaaaacacaaatcacaccttttgagtttttgaccagtgaccaatccatcattccaaatttctccagctaagctatgacgcattgtccccaattaatacacacactgttggccgcctgacaaccgaaaatggccaacaacaatttgctaccaacagtggcaacagaataatttgggcatatgcattcagcgttcatgcaggaacaggggcgtgaggtgacacgaaagaaagctcagctagcaaagcaaccaattgcatggcaatgctcgctgtctgcagatgagccgcatcatgggaggcatggccagggccaggccgggaatagtgttgttttcagctagctgcagctttgagctggctatcactaaccacagctcgagagtgtggctgcactgcaccaggatttacaaaaccaaccgatttttgtaaaaccgctatgtcttggtttatagaaacatatcggttttagctggttttcatatgacattgaaagaaagtcttcggtttttgttggtttttgataaaccggtgaggatcggtttttatttctaaaacgaaaaggcaaaaccctgcactgctctatggggggctagcttgacgcatcatggcccattacaccaccaccttgttgtagatcttggaccatggcacaagggaagaagctgggggaggaggaaatgtaggggatcatgtcccattttgcaaggacagatgggggatcatggatatcttttttccaggtctagactattttgattggacagtaaattctgcctttttctgtttggagaagatgaaataatgagttgactaatgcatcacgaagcaccgtcattggaatatctaccaacaaaaagtttgtcacaagtagtttgcagctgataaggaatagtaatactttaataattcatacaaatgaaaaaaaacatgttagaaattcttataaaaacatggatctcttagctgtaaaggctttgatttggtgggtactctgtacatcagcagttaaaatgaaaatgagaatgagttcttttttagcatagcaccgaagatgactgagattgtcaagccccacttgtaatgaaaagagtaaattgcactcacggtacatcaactttgtaagtgggtgcaatttagtgcaagaacttgagaaatgagcgatctagtgcaataacttgacatgtaggtgcaatttagtataaaaactttataagtgatcacataaatacaacaactagcataaggtaatatccgtaggattactatgtaatggcataatgatatcgtgcgaccaggaaaaaaggtattactttactgaactgaccccgggcgtgttaatatcagttgaaacacgctttggtccctcatccgtgaatcaatccctagcgggtcttgtctcgcgtgattcagtttgagcaacagatcctgacgtaatacatcttcgaaaaaaaattcacctaccatacttagccaagttgatgcaccaaaatactaaattatcaagttcctgtactagaacgcaccaatttatcaagttgttgcacttgactgttcaattctcaagttattgcactatatcgcatccacctatcaagttgttgtaccttgggtgtaatttactctaatgaaaatatagtaaaatatggatattttggaggctataaatcctataagaaattttggcaagggacgatagatatatacctctaaagtctgaaaaaaaaacagtcgactgtaagagcaagtttaatagtatagcccactaatagctccaattcatctatagctaatttaatagctaattcatataatagttgcttactatactattaatatatggtcccacctgtcatacacacattgtgtcttggagtccgcgctgcagctggctacagatatgtagtacgctgcttttctctctcatcttttatcttattaaaatatgtttacagctggctgatagcctgctattgtacctgctctaacacccaactcgtttggagtccgtagtggttcttgtgttggtccacgtggcccagttacggtgtaatggtggtggtttaatatcaccttgaaagtttaagtagtttagggttcctaccaatttttcaaaaacataaacacaccattgttccaagcaaggatgacctcggaacaaaagattattgggttacacaaactgtatcgaaattcttatgaaaatgggctggcgctttggagaagttttaattgagttcatgttttttcataccatggcgagtaaactaccccaaaattccttagaaaaaaaattgtgttgatgagttgtttggtttgttgcctatgttaaccataccaaaggaaacaaaaatggcaatatcaatccccatctagttgttggcctatcagttgtgaccaaaattaaaattttgaaagacaattttagagttaattttgggtttttttattgtggtctagattatcaatccttgacttttacaatgctaatagcatagatataaaagtttattcgtaaattatttttagtttgcttcgtttattttttttcacggcttatcagcttcagctcaaattaatgtccaaagtgtaaatttatcattaccaagaatcatggtcatctttacgacggtctcaatccgaacaagctctagttaattgtgtaggtcttttgcccgcatgagcgcgggtttacggccggtggtaggaaaggcgatggatggtgtcgttgaacatcgaagaacggggagacgacaaaccagagaaaaagacagtgatgaacagcggccgtttttttatatgtgcatgcgtgattgctttgagtcctgagacgagtgcagaatcatgatgtcgccgtactttggcctcctgcttgttcgatcgattcaaatgaggagaaggaagaatgaaagaaagaaagaaaaaaaagaagttcccggcatacatggcagcacaaagctacaagtacttatgactgcgtcgtcgcgtcgagaagagagaaaaagaaaggcaaattctgagcctcccggatgaatccacttcagagattctcttcatcattggggttgcaaagctggttaatttagttttccgacttttccccaagaaagatgcatctcgttcaaacatgcgattttttttttctgaaactggacgaaaaaacagggtgtttagataagaaactacagctactgcaacagtggcaactctgagatgttatggatgtatttcttctgccattttttcagtccattttgttggcttgcgaaatttttctggcaaaccaaactgggcatatatggatgctagctggggcacactgatcatcattggactgaaaattctatttgttgagggtatatacctgtacatacatgccatgtgctgcagtattatcgtgccataccgggggtgcaaaacgaaatcaggccaaattcattcacatggcatccatgctatgcactgcacgctgctacggaagcgtacaaagtatgagaattttgtcacttttgctgctccatctacggcggcagtacagtagttggtacagggtaccccatgtcgaccccatgcatgatctgaatatacatacattcacacagatatattgcacatttacagcatgagtgcaatttaatattgctttcttggcctaaattattgatggtcacacccccttcgtttgtgacacggcgctacctacgcagagagatggttgtttcgttctgcgacacatgacacatgagatcgatcgcagtttcggtttcagattttttcttttcgaaaatatacaaaagaattacatatctttatattaagaccgagatacttatacacaagcaaaggctatgtaaatgtatggctagatcttgcgatatatatggttttgtgaccacgacagggccatcggttggcacaaggctagcatccctgaggactcccgtagaggagaggggaaacccgcttagatagggcgtaaacgtgttacttcctctgcagctgcgccaaccacctttctccgagttttgtgttggttgttaaagatcctattgttaccttctttccaaattaacgtggctaggatgacaattgtattatatcctttcctcggggttttgataaccaacttcctactgttgtaccgccacagtgagaacgattgtggattggataggaagcaccaagattggccaatggtgtttatgataatccacccaaaaaggtctctgggtaaccaatctagatgtagttgatcgtttcctcttgctagtcgcagaagacacatttgctctgatgaggcaattaagccatgcttgcttagcctgtatgccgtccaacaacggcgataagcaaccaataggaaaaatacagcacggcggcacgtgtttttttttcttttcaaaatggcttggatgggcagatttcacgaccaaaaaagaggattatgtaagctgacttggtggagtattgccctgaagcttcccacttccaaatgagttgctcgccgtctaaggtgattgcacctgaactcagagatttagactttttttacaggagaacagtaagggaggacccccacggtaaatatcaaattaaggaatatttacagggtttatgtgaggcatgaaaattacatagcgccaatccatgattgaaacaaaggtctatctcaaattctgagccttaacgtcaactcatcaatcttttaagcatagctttccaagttacaggagaaggatcaatatagagatcatcctattcaagcatgctttgatccagatattcagtttcagattttgtatatgtacatgttaatttgttttatatctggctgcatacgttaactagaatacgaaatgaaattgtacgtattaccatatgtctgcaattctcgaagtactgctcggttcatccagccgtctagctgcgtaatatatttcagggtgtagctgtagtagtattcagagaaccaccatatggagccacatgaacacgtttaatttccgagataacagttcgtcaacatttgtgactgacaggacaagctggaaccgttatacaaaacttaaaaaaaaggtaacatgtgagatgtgagcatggaccatggatatgaaagagagacactagctagtgttctaattggaggtacgctctgcaagaatggtgccaagttgccggggttcagataattctcagaagttttcccaatcaaagttcagtagtgatcagctaccgatcgatctatcaatcaacaaacggaccaggcctagcttctcccctctctttcaaacccctgatcatggccgaaaccatcagctgccgctgccgctgcacgtactgcatgctttgctacagctcaacagtcaaataccgccaactcacaacacaacttctctatcagtcagtacagtgctcgtctgctcgacctacccggccggacagtgcaaaggtccccctgcgtttccacgaccccatcactgcacgatctagcatatgatattaggtaaagagagagaagagctagcagtagcaacagctgctagctaaacctgcatgcagctgtgtgcagcagcagcagcagcggtagcactgcatagcaagaaagagacacgagcacatttctctcttttggagcaacaaagcttaagctatagactagctacagtgccggccggccggccggcgtccatcccaactagtacgtgatataataattatatatgttaatcaaacgatatgttagacaggttcttgttcttcagaaaagagaaaaggaaagttggtggtataatagtcactcactatagtcatatgtgcatgcagggccctgtctttttggccttccaaaaggagagaattgaaaccgggcgataaattcgtggcaaaatccaaaagaaggccgtgtatctaggacctttctctactatccaaaagggagatctcacaaagaatgtactagtccagtatatagttgtatatgggttgggttgcagtagtggtggtggccggccggccttgacgacgaacgatgatggccaccgcgtgcacgccgtgctctcggtgcgagctccagcttttttgcttgctagctaagccccttttgtttttcagccgtgctagttgctagctgctgcatcacactgctgcttgctgcttgctgctgctgctgcctttgcttgcttcgatctgatctccatattcttttagcctttctttcatgtgtcgcgcatgtgtacagcctactgatgggctcgccagtgtacgtactactacgtagcagtacgtactgcgtgctgctgctgctgctgctgctgctgctgctgctgttgtgtagagagtataattccttcttcacaagtcacaactggagggcaaatgggcaatgcgatgggagattgggagcaatataatggcatgcagcaagcaagggaataatttttctttcctctcaactcatatcagcatgcagctgatgcctgacaaagcctccaaggtaggttgctgtcgtcctggcctgaacggtcatttcaggcgcgcactagctggtctttgatgtatcccaggattgttggggcgacgggggaatcgcttttgtccagaaattggaacggccaaaatgtgcggtgttagtttttgatcagatgttggagttgcgctgcttaagagagcatgattagtgagattaaaggccctgttttcaacgtggggttcttacaggaattttggagagtttggaacagagagaagacataaatttctgagaagatctatatacgatactaccttcgtttcataacatatggatcaatacaaacagtacattttattagtatgaatgatcagatggtgtagattaactggcctaccaacttaaattaattgtagtataaaattgaaaaggggataattgtctttctaaatgtttgcttgcagacaactgttgtacataaatgcacaatgctagacgtgttcctcacttgatttcattccccagtcccgtagttgtcgtccatcataggccataccgccatagagagacgccacacgcactgcaagttcacgcgcaccacgctattgtgcctgcctgcctgtaaattaattcgaattgcctttctttcgtcttctcaatttccgacccacccaaaaccctagctagttcctctacctggaggaggcagcagcaatgatgcccaactccccactctccaccatgctcacgcgaacttgtacatggaaattcctagtgtatctttgtatatgccaaaaatatatattgctagtgtattgtaccgtagaagtccttcaatttctttaatcaatcccttccaaaattctacttgttctcaacagaattttcataggattctcctagggtctattggctaacaccacaatctgattagccaacccagctcacatccctcctatcttaagggtttattcgattgaaggggtgtgggattaatctccttaatctcatgtgaaattaattgattgcccaataccctccaattgccatgtgaaaaggattaatcgaacaacatgtaaatagggtatatggggaataagtcttgttcatatgtactaatttgatcaagattttagtgacatttcaagatttgcgactcatatcccaaatgccgtagcacatgactacatgagcaataaatcctgatttttttcccttttaaaacaaccttaatttcatatatgaaacacgtctctttagtagaaacaattaattttaccattctagataaaaatgggtaaatggttttgtagttgttttcttacgttaaaaaattagaaatgtaacagtttttacgattgtgtgcaatattaggtctggcatggagtatagaggcacgaagcatatgttcacgcactccattctagagggagtataagagcagggttcgtgtttccaaagggaacgggtcaaaacccatgaaattatgaggtttccacgtaggataaagtatattgtgattgaaaatttgaatggtcttttataaattcaaatttcaaacaatatatatgagcaaaatttcatcaaaatttgacaaaaccattgcaccgccgaggttgggatccaacaatccatcgaaaaaataaaccatgtactagagtaaatgttacaacatttcttaataatctattacataggattttgatttgtacttctaccataggactatcacattgagtaaaaaaaacaaaaggaaaagacataagtcaaacctaaccaaagcaagcaagaggagttcatccaaaagagaaaaaaaaaagaattaggatacaagataatattggatgcttgaaatgtgttttacactagattcttacacatggtaaaagacaaatgctctagctaaatgtccgtcatagttgtgagagagccacaaccaataaactttttatagattgcgtgtttaatggatttattgtctctattactttagtcctacagaagactatttctctaggtctagatcatgtagcggtggggccaaaaaaaatttagagagtatttgttatgaaaatcttattccctatagtaacagtaacataacgattttataatgtgttcgtcgatgggtcaggtagccgcctagggttatcgagcggtggctccaccactgagatcatgtacgctcgcatagtaactcgcggtatttgaatcgattggacactattgtgtctctctcttccactaactaaaggcgataaattgaatttttaaaacaatggtgataaattgaattgagagtggtggggaaataataaacagtgctcctacttgcagggtgacagtaccggtccacctccaccatccatcccctacactgtcgcgagcgctctctctctctctctctctctgagttcgttagcaaagccaaccaaaaaaaacctaaaagcaaggcgagcctcggcagtgagatcgagatggagaaagcaagcaaagcaaaggcagaggcagcaaaaggcgcccacacccactgccgctgcctgctgctgctgcccccggtaaatttaaagaacccctccaatcagagcgaggcatcatcgatccccctccctctcatcctctccctctccaccctcctctccttctctcatcgatccggccaaaagctactcaaatgttatcgatctcaccaaaagagaagcaaagagaaagagagcatcaaaagcacaaacaccaagccactcaccacacctcgcaatttacatggctcctactaggttgtgtagctgctactagctagctcagctcggctcggctcggctcgccattaaaatccccttgttaccgcgcgttgtttggttgtaccgcgccatatgttgccgcctcctcctcgtcgccgttgcttagatggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcggcggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatgatcggatcgtcgtgatcgatggatcaaagctcaccggtgagtggaacagcatggaagaaaagagctccatagctaagcaagcacgcatgcatatccaccatgcatggggtaagctagcaagctctctcgtgtgtgtcacgatcgacattaatggcggctcacacaaaggcatgtagggttttgaaacagcgtaggaagctacagaaatggatcacgtacgtacgtacacattgggttgcagcgatcgaggagggagatgatagttttagttcctagatttgcatccatttttattcatcgatcgccaacaagttcttggcgagaagatgattttgatttgcttgcttccatcttcttgtttatttttccccctttcgtttgtgtttcttcttaatttgtaagggttaacgacatttttcttcactctggagaaattttacgtgcatggtttttatcatgcgtacctgcatcgatctgatcatacctatatatattcatctagctagtagctagcatcttgcaaacattcatgctttcttgcatggttgttgagatgttacttcttgtcatcttgatgggagaaagtttagggcagacatttgcacggcctagtacttctagctagtcatcaaacatgaaagcactaattaaagtttgctactttgctagtgatagaccatagatatgtgcttacattatagtatttctttatgtacatgcattgtggttaaattaattaattaatcatccctttttcatcattctatcccatttgtaatatcactgcgctcaaaccacaccactaggcgtatatatatagtttggtcatagaagattatgcatgcatggcatggcatggatgtttatttaagttgtaaaatgactccccccgttcaaattattatggtttggatccttatttataggatatgtgatacatcaagttgatactaaaatactactactagtagtagaattcaagttctagccgaatatatattaaataacccctgatcctacacaggcgttgatcgatatatacatctgacttatttatatatgccaaattaagtagttggagcaaattgacctgcgggcctgctgtaagcattggttaaacttgacaaatggccggccttatgttgatttggttaagctaaagctagggaccatttattttctccatatatactactctctccgtttcataatataagtcattctagcattttccacattcatatagaggttagtgaatctagacatatatatctatatagattcactaacctccatatgaatatgggaaatgctaaaataacttacattatgaaacggatggagtactaatatctgatatggagtagtgaaaagatctgtcaatagttttgtgttcatgtacgtagttggtccaagaaaccagatcaagttttgttgactattgcaggctaagacctttgctatcttttgaaggaatgaccggcctgtcgttgacagattagtttctctcctcattaactactacttaatcagctaattaaatacttagagctttgatgctgtacagtataggacaacaagagttgttaagagaaactaatcagtggcgcactatgaaaacatatttataacaggttgacgaataacacaagagaaggatgaggaatgccagttctctcagaggattaggtgatggggtgatatcatgagctcagaaaccatttctagaaaaatcataagcttgcacactttctccttgtccttttcatgcagaagctgcagccgtcccactatagcagattacaatcttattttgactgcgtgcttgataatcctgctgcactttactttgtcctcagctttgtgtatatatttattattactctgtatcactaatgtctgacttgcctgttagagcacgcacttgctgtaaaaaaacgaaaggaaatggagtagttcataatcatcgtggaaaataaaacaaaaactttagtaattaaattaaattaaatgctaccagcaggagtatgtcgcaaacggcacgcagacaggatcacaggagctcacatatacctgaagaaaatgctagaaactgtagctctgaccgaatccgattcctgatctaattccttccgctggacacatcacacacatcggtgagatttcatgtgcagcatctctcccattttactggctgtggttggtatgatatgcacgctagccgtcacacgtacgctgaacaactgtgtatatgagattgtcctttttcctttaaccgaacggccggcgatcgaggcatgcatgggtgtacatgccgcctgctgcctacatgcacgtcagcatatagtagtacatgcatacaccgaagagaggaaggatcatatcgaaggtgctcttcgttgttccgatccgctcgaccgtttcccgcggcgatcgcgcaagccgctaggctacaaaaccggccgcgcaccgtgatgggaaacgtacgtcgtcatgggggcgcggggggtcgttatcgcgcgcgtcggcgccgcggccggttggggggatcgcgggttacgtacggggcgcggcgcgcgtatgcgtgagagatccccgtgtcgtcgctgggccggtgtgggggcgtgcggggcggacgggggggatgcggacgggggcgggagggaggcgaatctcgtggcggggcgcggggtggaatctaacaggagaaggtggtggtggacttggagtggacgggacgggacggacggccggctggttggcgggttggctggatggctagtggagtgcgtgcgtacgtgcgcctgcctcctgcgcgtcgcgtacgtagtacgtgccgggacccccacgatctttttcgcctttccgtccgttttctcccgcggaattattacgccgatcgacccatatgcaccccgcgcccgcgcgcgcgcgcgtcatcgccgcgctccatctcgcgacacggatcgctgtccgccgcgacggcacgtactacgtacgtaccggccggggacagcatcttggccccctctgctgcccggccgctgcgcccagcttagcttgcatgctacttcttctcgtgtacgtacatgcatatgtgtgatctagtactggccggccgatcgatcgagatcgatccaggcttgtctcgtcctatagtatatggatctgttgatcaccagccacaactaagggcatgttctaaacagctaattgaaaattgctactcctcgttttctgttatcatattttttaaactgttaaacggtgttttatgcccaaactttttatataggatatgctttaaaaatcaaataaaatcatttttcaaaatttaaataattgatactcattaatcatatgctaataattgtgtttcttgtttttacatacagccaaaacctgcagccgaaaagaacacgcctaacaacggaggcaatcgagttagtattatctattatatactaaaagtcctttaaacttcctagaaacactcttaagccgtcacttgtcacttctacaaacgtttctaagtcgtcacatggcactatctaatctcaccgttgatttttacactgatggacctgttattttacaccattagattagatttattatttaaaaaataataacttcctcatgtttatatcataccagcgctactactgttgtgccgtacgtacgtactaagttaataccatacaaacgttaatgttgttcttccggtacgtacatccatacacgattgaacgtacctacgtacgtacacaattgaaaacaaaataataaagcttgctaatgtctgccggaagaaaaaaaacatacgcatgtacataaaaaacgacagaaaaaaacatacatccataaaaatcgacagtctcttaaaatttgataatctacaatgtaaagttaaaatatattacttcacaaatataaatatatttagttaaataaatatttataataaatatccaatcaatgttccttaaaccatcttctaaatctatctattatataccaaaagtacattaaactttgtacaaacgctcttacgccgctgcctacgtgtctctctaataaattagataaattctaaaaatctattatatattaaaagtccaataaatatcgtacatatgttcttacgttgtcacatggcgctctaatttattagagaaatcctagaaatcgagagaacaaaaagaaaagcatccgatcttcaaatttcactgaaactggtggacctattattttaaatattagattagatctattaaaaatctcatgatactaatctctataaaaaaaacataatgtgcgtatgtgcgtacttcgtatgatcgccctcctcccgaaaaaaaaaaaacaaaacttaaatacctacaccatttacgataaaaaaagataaagcaaaaaaataaaaataaaataaaacacgcacacgtacatagtagaattggaaagaaacactaaccatcagtgccaacactgatgtgttgtcaacggtctttaatctacgattttattaaaatctttattactatacgagacacacttactgattctaagaatgtatttattttattttcacaaactaatttacactaactaattcgcctgattgcacttagtgttgggttcaatagtgtataacatttgtccatcaactatattcggcatataaatttctatcaaccataaaaaataggaaaaagcacgaattacctcctcaccctctgaaccatcgtgttcgaccgaattacccctgaatccgaaaaccagacattacccaccctgaattttcaatactggacgtataactctccttgacccaatccgaagcggttttgttctgcgtggcatacgtgtggtaatccagaggtcgagtcgccgagtgagctcgagacggcggcgaataaatttattaaatcgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17585 - DNA, 863 bp, Oryza sativa
atggcgacccttctttttttgcattaaggaatcgccgtcattgagccattagctaacagcagcaacactggaaaaagcaaattaagcaaaagcaaagatgaatttaatttttttaggagggtttaattatgaatttaccattttaccccctccttgtgtggccctatataaatgagtggtactcgctctcctcttccccacacacccacaaacgcagctgagctgagctagcaagcgagcgagccgagctcgagctccatttgcttcttctcgtggcggcagcgcctcctccccgtcgccgtcgtctccacgtcgtccgctccgatccgcctcgatcggcgttcgatcgcgtccaccacctcgatctccagaaacctttatataagcagccgcgtccgcattcttgttcgatctatctctccacaccatgccttcgttgctcgactcgccgccgcagatcacgccggcggctgctgccggcgactggagctcgctgtacgcggcggcgcaggcggagacggccgtgaaggcgccgcggcatggggcggtggcggtgaagaaggccgcggcgtatggtggtggcggcgggaggaggatcaagaacctggagatgtgcaccgaggcgctcgggtgcgagaccggcggcgtcgacggcgcggcggccaccgccgccgatgccgtcgttgtcgctgctgctgcggcggcggcggcggctgaggatgccatgcccgtggtggtggagaccgacggcgcggagaggaagaggcgcgcccgggaggaggaagcggggtcgatggtggagctggcggccgccgcggcgagggcgcgccgcgcgggcccccgcggcggcgcgccgctgcccc

SEQ ID NO: 17586 - DNA, 7561 bp, Oryza sativa
  unsure (1)..(7561): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataggatatgttcccaataaaatatttttacaaaaatttggttttaaagtttttatccttgctaaaattacacccctaacgttatatgggaggctttttatgccgtggcacatatcctttggtatgctgtaataattgagcgattgataggtggtccccttgcagctcttaggagggtggcaaacgagttgcctgtaaaatagcgacatacgatattttgcaaggtcctggctataaatggccaaccctggtcattttataggtggtctctgtaaccctttgggagagcggcaaggagttgcttgcaaaatgaccggttatccttcatcactcgatgtgaccgttacaatgtgtcaatggacgtgtgccacgtcataaaaaatgcattttggaagggagaggagttagggatatagaattgtaaaacttgaaaaccagtttgttttaaaatattttaataagagtaaattgcattggagatacataaacttgttagatgggtacaatttaatgcataaacttgtgaaatgctcgtttcagtacacaaacttgtctagttagtgcgaacgaggaccaaaataacttggcaatattaattttacaaagctgatgttgattaagaattgtgacgtgcatacgtgtagtgagtatgcataaaaaaagcaatatttataaatttggtctctactttatccttcatcatcgaaatgatgaattccatatatcctgattggatttttttatcactgttggatttttttaatctttttctactattactatatcctattcttttttttattgaagatgtgtatgtctagtagcaaccttctctgatatatgtctacatagcatcctaatcaacttctaaatcaataagattagccatgcagtgtccttttcgtcttcccccgcatgcaccagacaagttcatgcaccaaaataaacattttacaagtttgtgcactaaattgcacccacctgacaagttcgtgtaccagcaatgcaatttactcttttaataagtaaaattaaaaattaaaaagggaaatccgagatctcccgacggcggcgcgtgtttcgcctgcgccgatggcggcagttggcgcggacgcccgacacgagatcgccgacgcgatcgcgcattcgcgccgcgcccaccagcagagcagaagtgcaggggagaccgagtggaggagccggttgggcatggagaccagggaggaatcccacgatgccagcgtcagacgagagctttgtcaacgacaacgacaaacgccgacgcgacgcgcgatatccccccagccttaacttaagatcgacgtcacgtcgtcgtcgccgtggagaaaacaatccccagagttggaaggcgtggagttgacctgacgcgggaggttgtgagaaactgagaaccaaccaaccaaccgctgagctgcacgcgtggttgccggagattttgctgctcgattcctgcactaccgctgctgcttccttttcgcgtgcgtcggcagctagcgcgcgcagcagcgagcttgtgctgaatacggcagtattgctcgctgtcgcgtggcgcgcgcactcgcgtagtacaccgtcgcgagcacgcacgcacgcgcattgcctcgatcgatcgagccctctcgacgggagttttctttttgtcgccggtgtgtctctccttttgtttactccctcgtgggctcctgtcaatcgtcatgtgcaaagccggtcagatagatagatagatattcagatgtttcgtcttttctcaggccgggagaggaagacaggaagagacgtcgaattgcacgtgttgtgtgcagccatgcaggtgtcaatacatgtgtgatgtgtctactaccaatcgcatgacctggtcgctcctttcctcgtttgttcaagtttaaccagtaaccacaccgacaccacgcgaggtccaattaagttcaatttcgctttggttttatatcattgatatgtatgcatggctgattgtttcgctttggttttattgagtttatgattaaacaaattaccaacttcaagcagtaccagagctagaggcactatcgaccctaggcgactaatatcgctcctaggtggctaggtgtccgatcacttcttgttgatatcgatggcaccctgcacccgatagagcaatctgcagtggagatgtaatgcgcaaattaagctagcttgggtggccgtccaactatggcctagctacgatacttcaagatttatcagattttgaggggaaaacattaaaattgtggtggttaagtatcatagtatatctattaagtttacttattagggtttaaaattctcgtgcgagtagcctttggatagatatcatgtgaggtccataaaaaaaattattaagcgctatctaatgtgaaaatgcaagtgtcggacgtccaatggacccgagaaaaatcgggcgccgcaccgcccgccgcccacgcgcgtgctccaggcgtccccaccacgctccacgtgtcccccaccacacgcgtccccgttacaacagtcgtccggatataacagaaacaccctattaagggaatccgttttatttttttccaccaacaatatttcagcaagtgaactcgtgatgtttcattatgcatgaataaaatgttgcagtgggttttttatactgtttaatattttccatcttgatggacacgtgggttgttgatatacacggggtttaagtgttgaatggcttcgaatcattcgttgcatacgttgaacaaaattgtttcatctagcgatctgaccgtgtttcacttttttaaagaattgaaacattctttcgctatttgctgaaactttatttttatatagggtaaaagagcgtctgattttttggaacccgttgtttcatatgttgtagcaaaatgtttcatgaggtaatttagttgtgtttcaactttttaaaagactgaaacattttcgatctatttagtgaaacatattctgtcagggttacggataaggtataccctctatccttggatatacgttgtatgctgacacagtatacctgtgcgtatacggatatttcctgtatatattaagaaaatctatcacgagatagaaacggagtccacagatggagggagttctactcggacaagactgggtcgttaccatatcgtgaggggtccgatatctccgagtcccacttggagatcaactgatccgcggtataaaagggaccccccgggcaggacctaagacatcgaatctcactgccaacacatacaccacagcctacgaagccggagcctacaggagccaagtcgccgggtgatctagtcgaaccaacttgactacgatctcgtcggtatcattgagttccattattccctttgtaatatgtgacttccatcatataatcccataccaactggattagggctattacctatcaaggggcctaaaccagtataatccttgtcttctatttgcttgatgtcgtattacgtagatcctcgtaccagcgtaccccaataccctctatatccggtctacgggtatcccccgtcgacatattcgatctttcaaaaatcgggcgctcgatttataggcgcctcctatctattgagcatataaaaaagggtgtatttgtactttgggtttgttggaaccatgccaccctatatttgcaaaatttgagatatgccacccgtatctcaatgacatataggacccacatgaatcgatgacatgtgggtcagggtggcatatcacaaattttgcaaaatttgtgtggcatggttcaaattgtcccttgtacttgtgtgacggtggtgtgcctccttcctgctacaaggaaaaaaagattagattttgagatgagccaagttctttaggacagatcagtatctagcttgtgtgaaatgtcggcatggtccctttcctcatttttcatgtttaaccacagtaatatccacaccacccctaaggtctaaggattttgatgtgcaaggctggttgcgtaacttaacttggtttcattggacttaccctcttcagatcaaattttctaggtggtttaaacatatagagttacgagatgacgatttgacgactccgtgttgatgcgcggagcaattttggacgctaacgtcatgacgtagaaatgatcaattttcagaatgaccttgatttcactaggttgattcacttttgtagaactgaatgaatgatcaatacagtgaatcggtaaagaaagataactattgccctaacctaatgctcggtaggaaaaaagacctaaagaaaggttttgtcagttgtgttgctaactccaatttgctacggaagtgaccctttctatttatttatttatttatagagatgactacactcgcgaaaacaaacactttgcacacgcaaaagtaaccaaagcctaaaactaaagcctgacataattttttgcgtaacttcacatagttgaaaactatataactctatcttcatttagatataaccaaaccaaattatgattaccaattgccttttcacattgtttggtcgtattctcaaatatagcgtgcgctctctctctctctcctataggaggatctctatcacatttaacagtttgttttttgaaactatcaaatacaactatattataattaaaacgtaaccctacatacattgtaattaatttgtaacatttatatacttcattgaaatgtgtatgtgggcaactggttagcagcacgaaccattgtcctacaaagcgggagtttgacttccactagcgtgagtcggataatttttctcggaaaatgctagggatcgggcgcccgccgcttcccgcgcctccgcgcgggcctccgtgccgtccccaccatgcgccccactacatgcgccgttgcaataaattgcctacatattatggaaacgctctattaagggaatccgttttaatttttgttctaccaacaatgtttcagtcagtgtactcgtgatgtttcactatgtatagatcaaatgttgcagtgaattaaaacatcctttcgctatttgttataacattgtttttatatatggtgaaacaacacctgattttttggaaaccgtttgtttcatgcattatagcaaaatgttccaagaggtgatttagttgtgcttcagctttttaaacgattgaaacattttcggtctatatagtgaaacaattctgatctatttggtggaacaacgtccgatttataggcgcctcgatttttctcctgccttgcatgaatctagagagaatacgacggtaaaaaaaaatcaaaagcgttgaagaagaaaagctttacgttcttcagaaattccgattcctttatatgtcaatttgacaatatcggctacgatacaagtaattactttaggccaaattaagtctccagcctgaatgtttttgtccacacatgtgctgggagtcaaatcagggtgtttttttttcttaagttatgcggatatgacacatttgggcccatgatttttaattaagtgtgttaacaggatagtactccctccagtccaaaatataagcaattttggatcctgacacggtcttcaagatgctactttgaccaacaatatctataaaaataagatgttttaaataaaaaatttgcatatatattatgatagtttgcttaataataaatctagtaacatcaattttatatgattgatctttttttttcttattaatggttaaagttaaaaacgtttgacttgttattatgctaaaaatgcttatattctgggacggagggagtactatctcagtccaaaattagatgtcgttttgacttttttgcttgtaaccttttaccattcgtcttatttaaaaattagtacaaatataaaaagaataagtcatacttaaaatatttttgataataaagcaagtcacaaacaaaacaaatagtaatttcataatcttttaagtaagacgaatggtcaaccattacaaacaaaaactaaaaacaataagtatgttgggatggagggagtattcacataggtgccattcaggataaaatgacttcaattttcagcagatgtgtgcaagttgagttgaagagtgttgaatacccggttttaaagttaagatgtatattttagattaacacaaaagttgaaattaaggaggtaaaataaacttatccctatgtaaaaatacctgcaggttgccatcgtacagtacactacccgcagctcgtccggccctacggggcccaagtgcaaaaaaaaaaaaaagcacagtcagcatccagatcacattcgtggacatcagcacagattctcatctagtcatttggttccggcagcgtcgctgcactgcatctcccttgtctccctctcacaagttttccgccgttcgcaaggcaaaaattctgaagcaagttgacgcagcagcgagagcgcgtggtttaattggttggttttgtgctgttttctctaaaaaaagacactgtttgttcgttttgttttcttgcttcagaaatgatcaacagagacctatacctgcataacgactcagaaatatcctgaaccattttaagccaagtgtttactactgaagaatatgatcacatatggtgacagtgacacaatggcatatcgattgtagatcacataattaagccacgggtttttcattcagatgcatccatgcatacatatgcaagccaatcaataatattgataacggctactaattacacctcaatcaccaatgatataacggagtcatataccgttcttgactgatgatcaatcaagaagctataaggtgagagaaaaatatagatcgaaagaggcactgtgagatgccagagatcaaaagtgttcgatcaatcacgtagttatggataccatctcctaggtagagatggatcaaggtgattaattaattaagcttaatttagcctagaaattgattgattagtagttgatgtgatgatgatgttgatgtgtccgtcatcttaaaagtggttcaggaggtggccacccagaatggggcagcctgctccggctcccacttcttgccgcgcctcgccgccgccgccgcggcgacctccgcctccacgcaccgcccgccgcgaacgtacttggcgacgccgccgtactcctcctccggcgtcgcctcgtcgccggcgtcgtgctcttcttccttcttcgtgacgatggcggcggcgtcctctgcctcttgcttgatcagttgcttctccttctggtggcactcggcggcattgctgcagccggcgcaggggacgaggaggaggcggaggcggccgccgcagcgctcggcctgcaccccggccgtccgcaccgcgtacaccgccagccccccgtc

SEQ ID NO: 17587 - DNA, 3102 bp, Oryza sativa
ggggaggaggcgctgccgccacgagaagaagcaaatggagctcgagctcggctcgctcgcttgctagctcagctcagctgcgtttgtgggtgtgtggggaagaggagagcgagtaccactcatttatatagggccacacaaggagggggtaaaatggtaaattcataattaaaccctcctaaaaaaattaaattcatctttgcttttgcttaatttgctttttccagtgttgctgctgttagctaatggctcaatgacggcgattccttaatgcaaaaaaagaagggtcgccatggaaggggcagctgctgctgcgggttgtgtgctactctctctgccctgtaaagttaggcagtgtcctccaatggtgaatttgcctttttgtgcaagtgagtgtggtgacgtcctcaaatgtgctgattttatggcttatacaagagatagttggtcactgaaagtgcatcagcttggagtttatagggtgttagaatgaagctccaactggcactgacgcatgcttgattgcctttgagttagggccaatggaaataaatatatggagccactcgcaattagaatggggtaattggttgtccactgttcactggttggctgggagttatacttaaatattcaatctaggccgataaatgcgtgcaaatgtcatagacctataaaggtagaagttttttttttactgtacttaaggttgtgcagtatcaaatcttagctgttgatctagcatcatccaacggtcaaaaatcatccgtacctcgtggtaccgcacctccccattgaaacgataccgtgggtgggaggtgtcacgcccagaaattcccgaataggattccaagcagaatgtgtattaaaacccccgtccaggaccggccgggtacacaaacgacaaagttgacatacagatccacgtcttacaaacatcataaagtcttacataaatgcagcagaaaaattaaaagataactggagctaagccttgacttggaccgcagcgggatcaccactccacaggcatcctcgacagcacgaacgaagcctactcctcggagaagccaccatttgacaaatactcaaactctggggtttggggaaaatagagcaagactgagtactacccaccgtactcagcaagtcatatcaagggatagctatagaggttcgtttgcataaagcgagcatttataaatagtagttgaaagtagtaaaacaattgtaataattaatcaatattaatcatccactgtccaacgctataccacgttgcaacaggcccaaccacccacctatactattcaattccattagactagactagggtgaaactaatcacggtgaatctggttgaccgcccataaccgcgggcacggctattcgaatagatttactctgatcagaagtgtacaactatacccacaagacatagccccacgacacgtttccgtgcgccgacatgccaccacgacataccagatagaggccgtgacaggaccgttcacataaccccctctaaccaagcataccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcagctagaggaaagctacactacaagcccagccgttgcccacgctggcttgtggtaagtacgaggaattcttctagggtttcccgcgaaccgatccttaagtgccatgggcgcgactagcaaaaccatgcacccacagcccaccatttaacatattttaatgaagcgacaccaggacggtggctctaatccaacatcaacactagatcctgaagtctatacattaatataattttccccattgtgtgctagttgaactaagcatggctaagcaatccctagtccaatatctaggcatgttatatcccaagctaacaaaggaccatggtacaaaatagcatggctataacagtaggtaaacatcccatggtaatattataaaacaatgcagtatttgaaggaaaacaatggagcatttgcaatataggatcaacatgttcaagtgacaagaatgacttgccttgctctgctgctggaggaacctcggcgactatttcaaagtacgccggagcgtcgggagagccggaatctaagcgacatacaaagcaaacaatacaaacaggctataagactactgaaacagagaacaaaaccatttttaatggattctatatatatttcttgatttactgagatttgaatgggcttaaacggagctcagatgaattagatatgaattttagaagattcactgtgtttttactaaaaacagaaaaatccttaattgatttattgcgcaataaataaatcccgggagagagaggggcggtgccgacatgtgggctccacatggcagtggctgcgggcgctggtccatggtggatggggtccatggaccgggaaaggggcggcgcaccacgtggtgctgacagggcgccgacgcggcggccacgcggcagccacgcgggcagccgggttggacggccccgatctaccgcccggtagatcggacagcggatgcggctcgcggccggcgcgcgcgggcacggctcaagctggcccggtggccatggcgcgcggcggcgcggcgcgcacgcagcggcgacgcgaggcagcgaccggcggcggagggtggcggcgtcacggcaacgtgggcggcgatagcggcggctaagcggcacgggagagagggagaaaggggaggaggggcctcaccaacgacgatcaacgacggcgagcgacggagggcgatggcgaaggcgagacgagctccgggaccacctaagggatcaaaaggtatgagttagagagggagagggaaaccatggatggctagggcggcgaccgaaggcgttggccacggcgaagctcaccggtgcgcggcgcggacggggttctggcggtggattgctatggaggaggggtggacggaacggcccccacgacggcgaacatgacgacgtcaatggcgtggctcggcacggtggcta

SEQ ID NO: 17588 - DNA, 27110 bp, Oryza sativa
agggtcgatcgtggccggggagaccgcgatttcaccggcgggtggggaggggtggggaggagagagaggtgggattcaaaaattgaatcccggccgtctcgagcgcgggcgcggacgggagagagagagggggagtgggcgcgagggcgacgttgcccaggagacgcgggagcggggtgcggcggcggttgcggggcgcggcggcgccgactggaggtgggagacgggcccgacaggtgggccccacctgtcggcgacccagggagagaggaggggggctcgggcggctggctgggccgtggccttcggccggcccagcggggagggggagagaagagagaatgggccggcggcccattcgaaagagaaaaagggaaaaagaaaaagaaggaaatgaattttcctgggattaaatattgcttgtgctcaattttaattggttaaaattatttctagagctctaaaaattccactaaaaatcttgttagcgtatttcgacatgtagaactcaagaaaaaattccacatgccaatttcgattattatttgcattgatttattagggtttactcttgcttttacaccagtattttcttgagaccatttataacttcaatttaggcttggaaaagaacttcagggtgtgataggagggtagttttgtactttcgcgtttattccgcatcacgcacgcgcatctcttcctcctttgtcgctgtttccgcatctcgccgggcaggagcaacgagagaaacaaacccgaagcttgggatggcggcaggggcggtaggtctcgaaccctagatcggcgacccgatggtggcccagatcagcgacggttgcggcggcgattcatcagcgacgggagcttgatgatggttgcggtggcgattcatcagcgacggcgggcggtggtctcgatgcgacgtcggcgctgaatcggtgggagtccggcgatggttgcagctaccattcatcgggagctcggcgatggttgcagcagcgattcgtcggaagctcgatgcgacggtcgccgcggcggactcaatgcgatgcgacggcggccggcaaactggttggccgagaggttgaggtactgaatgccatggcagctggttcagctcctgcgccacgaatggtcgcgtcgtgttgatgaacacctccaggaggtggttgtgcgtgccgccctcggcgaggaaccggcgcaccaccgggtcgttctcccagcacgccgtgttcacctcgtcagtgccgccgtggaggtacgggtccgggaacagggccaccatgccgccgccggtgagggggttcctggagggttgagggactgccgccggtgagggggttcctggagggttgagggactgccgccggtgagggggttcctggagggttgagggactggaggccaccgcaggacgccttgaaggtgttcgatgaaatgtatacctccacgtgcgtgcacggcaagagcattatttaaccccatcatacccatcctaaatcaatagttagattagattgttaccttatgatacctcatggtacctccttaaggatagaaaaaatgctcataaaaataccatcacggtatggatgactggaggggagaaggaaaagaagagtcgactctttacaaggcaatgaacgaagcataagacatgaggcaaactcatgccagagaaaagaaaaaccaacataggagctgctagctctcccgacttctcgtcgccggggacttaggtgccaccatgcatatcgttggtcgtcgctcgtccagattcagcaccagaggagttaattaaagtaaacaagtatgtatactagtgtggtcgaggaggggttgttagatctaatatcagaagacgtcgaatcaatagaggtggtatatcaacggctgtaagacaatttatgttagtcgagtacaactcttgagggcctaaaccttgatggctagaatggttcgggttgattagtatttacattcaaatttccttcttccaaagggattgtggatatctacactcatccaaataagtaagaaagtgcgtatgtgcatgaataccccttttcttccttctttgagtaatatattcatctcttttcagtttaccatgggccactaatcttgtctacctgtttatttaagtccatgaacttttcatattgaatttgaggttcttaaacttgtctaaactcttcaacggtccaacctcgcccacacctccatttctactaccatggtgggcactcgtgcactgcagctggaatttttgtgccgtttctaggtgggggcattttgcagttaaatcatctaaggagtatgatttacattagtcacgataattatggacgtgaaacaacttttatgaatcaatgaatgcctatttcaaaggatagctatgatagttcaagcgcaacgtaatatttcgactgtgaacttgacaagcgttatattcaattatttgaaaatttttaggtggaaaaaagagggcacatgatcagattgtacatgttggtttgttcttatccacccaggcaccatgtagctgccatgtactacctccgtccaaaaacgcgtatccagattcatagctaaaaattactatattttgggacggaggtagtagatggtgcaacgtgagttagatttacgggctgttttagattgctaccaaaatatgccctatcaataatagtatatactagttgatacctcacgttttactacaaaatatatggatgaatacatgttatacattatagaaaatgatgtggatataatgatttgatattacatatcgagctctaaaaatataataaattgtaaatgatgtgtcatgcttgtatgggatttaagatgctctaaataataattactaatgggtgatgatataacacacttgcatgataagatttaggagttggtgggtaccaactatacagaaatcaatgcctatactaaatttagtagcaatctagaatactttttactatatatagttttacaatttcgctctatggtgataacaaacaaaaacatgaccaatataaacttactctaccagtaattgttactgctaaaacttatcggtagcgctaatccgcgtgctacagcgcggaatattagttcaaacgtagcacgccctctccttctggttttcctgttttttaccaccccacctttcctccgcatcccatcttttctcggtttgtttttttcgttttttaccacctcaccttccgtgtttcttttttctcttttccatctcatccgtgcttcatcaatgggctcggtaaaatattaaccatctagatttttttgtttttcgttccttctctgtagtttttctgttttcgcgttttagtaaaatatttaccgtctagtttttctttctgagttttctgtttttctagtatctccgcacgtttcaaaagtaacgaatatactccatggagtttttcatttactcccagcctcccacatcggctcattcaaaagtaacaaatttactcgcatgaatgcctccacatcgtatgacgccatacctagatggtcgtaaaagaattactactagcttaaaacgctagtaattccaatattataaatattgtttagatttcgtggtctgtgagtaaaacaattactaccttcctctcgatatagcccatgatctcgtagccaccgtgtagtaatatgtcactgatgtgttcaatacatagtctaagaataaaaactaatattttgtggtcatcgagtaaaacaattatcaccttcctatcgatatagccatgatctcgtgtagtaatatgtttactgatgtgttcaatatacaagagtaaaaactgatactaaaagtatcgttgatctgtatcacaaaatagtcgtatgaatgaaaaaattgcaggctcaatcacagacaagcaataaaattactcacaggtgaatcaaactagaaaagaaaaaaatgattcagccaaaaattcatctggcagctttgctggatcttgctataaggatgaagagggtggtttgtgtcttgtgactggtagtggagagggcaaccgggtggcgagcagtagtcgacgatggaatcatggaaggatgtagtggatgagctcgattttgcgcagtagcagccatccatcatctagcaagcacgaaaaaaatgcaaaaacattctcgttcatgtcaatagagatgacgagcaaaagaaaaatagcaaacaacctctatcaccggcgtactccaccctatcctctcagggctagccacatggagaatgatgtgcaaatgtaggacctgtgcagcctatcaattgagatcaggtaatattggagattgcacgttaatttgatttgcaaaaaaaaaaaattggggcttcatgcgtgaagttgaaggagagtatgcagatgcaaatcagagtgtcatttccttacttgcttgttctagcattgtcgctgacgtggagcagccgctggttgttgctattgacctaagtgaacacctccttgttgtttaaggtgctgcccagcgtccggcagcgaggaccgaagcagtgccttcgcctgaaccgccgctggccactgctcgccagccaccaccatcaaccaccacggtgtcgttgtcctcctccatggtgtgtcgccgatctgtgcactaggaaggtagatcgattcagatccgaaaaaaaggaaaaaaaataaaagtgggggcgagagtggttggttgggtacgagaaaaatagaatatatataccggaagcagagaagttgtttttatcgaagtaagtcatttattccgataatagtgggagcacgatgcgggacgtgggggtgggatcggaagcaagggagtggtttttattatcaaagtaaatcgtttactcgaatataggtgggtggtagaggcacgcgataggagtaagtcgtttactccgataacggtaggagtgggatgacgggacgcggggtggggtgggcctgagctgatgcatgtttggcgctgcgctcctaatagtagttctaaaaacgtatctatattttgatactaacaatagctagtaaaccaaataggcccaaactataatgaactatttagacaagtttagaaaactcgaactacagattcaaagtttgtagatctaagtgaatccgctggacaagtttagacacacgtggtttattttactcgtaatatagcttgtacattcgcaaaactttttgttgtagctacattttcctcacaagaaaagttggatatatttcatgcaaagtttccaagagataattcaaaccatgtcggaccagaagaaaacgtggcgatggatgacccatcaaggagcagagaatgtggagaaaagggcaggagatgatagtggcccaagccttgaaaacaaaacaaaagaaaagaccttgtatcctacagcagggtttcctcggtggatatcagtctagattgcaaagccatcttattttgttggcgtgttttttctttcttcaaaacatagtacaaatgctaacgctcacacacacctctataaacgcatacatacatcctatccatatgagtatcttcaaagagtgtgtatgaatatcttaagattgacgaaatcatcatagacaactcactatcgaatggtatatcacctaccattcaaagaataattttttttagataaaaggcctcacatccctccttatattgaaagcaaaatgttgaacaaggttatggggaatatccattttacagcacaggcttaagccacaactaccacagtaaaactaaacagtcaccacacatcaggccatgagcagaaaaactctaaggtagacagtaaacaaaagatactatgacaagctaaaacaaggcacatcatcatccaacgccggttctctgagcgccaagggtagttgttgtcacttttaacttctcagccatcgtctccatcagcaaagtcacctcagaacgacatagggctttccactgcaataaaaaggaaatgatttggaaaggcaggatcagtggagagtaaaccattttatctctgataatcatgttgtttctggtggtccaaagcaaccaggaaacaaccataagtaaagctggaaaaactatagaatttgccttattgttctgcttagaaatgagaaagaaatcatcaaaatctctcggaacaaagacccagccaaaagaatatctacacacacaccaaacaaaagaagccataggacaggtgaataagatgtgagaagtagtttccaaggcaccacagagctgacaaaattctgagcctgcgcagtttttctttttcaattgctctgctgattggattctacccttcatagctaaccaaacaaagtgtttcattttcatgggagcagggcatttccaaaccatctacattttaacatctttcatacctctaaaagccatagcctcatagagcgattttgttgtataaagtttattagctgataaaccccaggtctgagagttaggtgagacacttagggaggtattttcagttattcctctcagctctaaccactgatttctctccagttctccaaaagtctcctaaaagttagcacattagcacctcttgatatcagctctgagactgtaacattctgttgattacagatctcaaataaattgtggaaagtgattttaaaaggacaagaaccattccaaacatctttctagaatcaaatatgattcccaactcccagaagccattcagaccctaatgtcatccattttctaacattcatcacacctttccagaattgagacccttgtcaccaatgtattggaagataccatcctcttgaatatattttctcctcaacaaatttatacaaagactattattaggggattcaattttaatgattcatttagccaatagagcagagttaagcattctggttttagttaaaccaatgcctcgaaactctttaggaaaagaaaggtctatccatctcaccatgtggtattttctcccttgtttattgccagcccaatagtatctaacctcttatcgaatcaaacttatgatgaatcccttcaggaagttggtaaaaacccacagcataggatgggatagaagataaacatgcattgatatgaatagctcttcctgcataggttaagttacccccaatccaaagagagggtcttttttccatcttctggggaaggaaatcaaactcttggtttaaaattttgttaggaccaatgggcaaaccaagatacttcatggaaaattcacctataggatagttgagcatctttgcaacctcttcaatttctaatctctctaaacccactatgaaaacctcacttttatgatagttaattttcatccctgccatctcttcaaagcagtataagagaatttttgtgacaatcacttgcttagcatcaaaagaaataaaaataacaatgtcatcagcatattgtaaataggtgatccttcctgggaaaatctcaggaacaaggcctataagaacaaatgatctcttagcactatcaagaatagctgcaaaagcatcactgactaggttaaaacaaaagaggagatagaggatctccttgtctaagacccctgtaagttctaaagaaatcacttctctctccattgatattgacatggactttaccacccataacacaagccttgatccaatcaatccatctatttggaaagttcttcttctctaggacctcaaataagaaattccagctcacactgtcataagctttttcaaaatctattttcataataatccctttctttgattttgttttcaacacatgaagaacctcatgtaggattatacaacctttcagaatgaatctgccagggataaaggtagttgtgtatgccaaatcactaaagaggtcacctcagagaatctgttagtcaccactttactgatgaatttaaaacattcattcagcacacaaataggtctgaactgtcttatattggtgggatcagagctcttagggatcagggaaataactccgaagttaagtctttttaggtctaacttcccttcatacaacatcagcagcatctcaaacaactcatttttaatctcaggccagaaagctctaaaaaggtgaacattgagaccatcaggacctagagcaatatttaatttggattcttttagaactttgtccatctcttctatggaaaaaggtcaaataagatattctttttgactatctttcaagctcaactcttaatgccaaataagtggtgagaggtgaacatttgaagggtcatcagctctaaacaaagtcttataaaactcaatgacatgggttttcaactcttctttagaatgcagctctttgccttcatcttccagggagagtatcatgcatcttcttcttcttcttcttccattggccattctgtgaaaaaattcagtgcttctgtctccttgcaacaaagtcatgtcaccacatctcttgtgccagaacaattcctccatctcatatatgtgttctaactcaggttccatttcatatctcttattccattcctctacatctaactcccttaggtcagcttgagagtccatctcttggatcagagacgtcaactcagttttgtgttgattcctctccttttttgtatttatctcccatcccttcaaaaaccttcttagggaggattgttttttattccagtagtcaaggatgtaagaactatctctagggatcaaatttgtctaaccatctcatgaaaaccctctatggctagccaggttgactcaaatctaaaatatttaagaggtctctctaaatcctcaccagtgtctagaataaggggagaatgatcagacccaatcctaaggagggaggaaagagtagaatttggatatctatcctcccaaccagcactaactagaactttatctagcacctctaaagtagggcaatcttgcttattagtccaagtgaattttgggccacttctatatgaatctctaagttcaagatcaaagataaaagaattgaaagactccatggatctcagattcaggttatcatttgatttatcactagcaaatctgtacatattgaaatctccaccaatgataaaagggtgttgtttatcctataaataccatctcaactcttctaagaactcatctgtcaaagaatccacaacaggaccacagaccacaattacttcccatatactgttgtctttcctatatttgatatcagtactcaggaaaaaagcaccaacatgagtccccaacctctcaatcacctcattgttagtatctaatagaattacaccagatgcacctcttgaagattcccaagcccaagagaaatccttggagccttggaaggagttcaactatttatcctgaaaactcattttctttgtctcttgtaagcaaataatgtcagcccctctatctctaactaactctttcaactgtctttttctagctttatttcccaaacctctcacattccaaaataatactttcatttttttcctaagttttttaggaccgcctctcctcttctgttctaagctctcagatgatttgtttactacacctacctcttgttcagtgttatccacaatgtcaacctcttcggatttattttccaagacatctctcaaatcagtatgtggtatgtcatgagtctccttttccttctccttctctttttttccatctcagtttagctaattttagcttgaacctcctccttggtcttaatagtatcaatagtatttgtcgacggggaatacccgtagaccggatatagagggtattggggtacgctggtatgaggatccacatagtacgacatcaagcaaacaaaagacaaggattatactagttcaggccccttgataggtaatagccctaatccagttggtatgggattatatgatggaaaccacatattacaaagggaatagcggaactcgatgataccgacaagaccgtagttgagttggttcgactagatcacccggcgacttggctcctatagactccaacttcgtaggctgtggtggatgtattggcggtgagattcgatgccttaggtcctgcctagggggtcccttttataccgcgggtcagttgatctccaagtagggctcggagatatcggacccctcacgatatggtaaagacccagtcttgtccgagtaggactccctccatctgtggattctgtttctgtcacgtgatagatttccttaacgtatacaggaactatccgtatacgcgcgagtataccgtatcagtatacaacgcacatccaagtatagagggtataccttatccataaccctgacagtattattgatttctactaagttactatctaaggaaatattagcagcaatagcaatgttattcaactcaaagggatcaattaactgaaaaacagcaaaagggttggaattacccgtggactccagattcttctttttggttagaagttcagctctattcctcaggctcattcttgaagtaatagcaggttctgctttcatgggtctgttcttcttgtaaggaacctcttgaaagctatcctcttcatcacactcttcctcttccatctgttttgcaatgtcagacaaggatggaatgtcacatttctccaattctaggttttcagttaacatagtctcattatccccctcattagatttttgtgtaagctgtacgtacactgaggaaagaataattgatcatatatacgaacaagtcacggcaaagatcagctttaacagctcagttggcctcctgatatcatccatgtctcacgaccaacttaacccccaccaaaaaaaaaaaacaattggagcattattcacatcacatcacctccctcgttgtatctggacattattttacattggggacagaaataagttgctccaatcagttgctttaaatttgcagggcacgttgtgcacacacgtccagaggttttggatggatgaggatataccgtggacaaaccaccaaggagacatgcactcgtaatggtgtaaataattagcactaatatttgattatcaacgcaccaatgtaacgtctgcacttgtgttataagtgtaaatcgtagcagtagtgtaccggtgtcaatggtgcacaaatattgatcaataagtgtttttttacgaaatattgatcaataagttgtccctttccttctgtggttgtaattgctttttgctaattatcttttgtgaagtaaacaatttccatatgatgtatttatattaaggattactgtagtttgctaggcagctgaaagaatctaaatccattgtggatccacctgcaccaatcagacttcagaattgatggttcagaaattttcggatgcgaaaaaataattagtaagtgtaaaagaatacattcctagcaatttaaatggaaaaggtctttttccctatcttgtggaggagatataaaaatacgcactggttgggtgctttcttaatttttgacctttttttctgaaaataaaaataattccatgaagaggtcaatttccggtttgtgctttgctagctttttggttctctggatagtggataagaataaaaccaaaaggtgaaacatccctcacatatgttactaccttagcttgtggacacaatggatagtactgtacatggcatatgttgattttgttctgattattttctctcttcttttggagattacccgaaaacaaaaataagacaaatgacagtaccacaccagaaagttgctatcaattggtctagttcttcaaaccattgattgaattcgaaatgaattgtaactacatagcgtttttttggctatgtgcatgcatttttttagagagagaatcatggcttttgaagattttgtttttttttggtcaaatcagtagtaatacatctccttatataaacacttgtgatagtcgatacaatttggacggccgaggtagtttgcaagcttaattgcttaacatagcctataaccctacattacctatatgttctaacttttgcataaatgttaagagtatctagggttggttaggtggtaccaacctacaaacccctgtctctacattggtccctgccctttttgccttcttaagtgaaagatcactgttccatatttctataataatatgtctgcctctgcattagttttttttttttttttttgcctttagctacccttcttaagcagaaagcaagacatttatgttcttaagctaagctcatctttttggttctcaagaaatgactggacaatgttgctccaagatatatactactagatgacatcaaaatatggacaatgcctttttcctttgagagcttggtcccctggctagaacttctgttacatattcagctttgttaaattcccatgtattgcttactgtcaaatgtatcccataatacaccgatttgagatgtgatggtgccatggtctggccacatctggcactggccattgctaattaagctatggcctctcattttgggtgtcagtggcgttcttctcccctgttgacacctgtagctcagaatctttgcccctggatgatatgctggggtttcagacaaagttggccggcaaaaataaaaaggccgtggagtttcacagacaatgtgagatctttggccaccggtgaatcagccaaagcgagtaccgtcacttcgagcccggattgtgctgtcaccttgttcagatttgcgagatccatcgaaatcgtacgtacatatatatgcagaaaggattcagctaagagcaagtttaatagtatagcccactactagctctaaattatatatagccaattcatataataggtgcttactatattattaatatctggtcctacctatcatatacacattatgtcttgaaatccgtacttcagctggctacagatgtgtagcccgctgctcgcttatagcctgctattgtacctgctctaagctctagctctagcatagctaagctcaaaccagcgcctaggacaagaagccgacaaacagctaattccatggtctggctgcacgagcaggccaccatgattcatagtatagttaattagagattaaaatgaaggattagcttttcactaattgcgacacgtcaggagtagtttacgtagctagggagacgttttgtctcctaaaaacaaagtgaagcctagtcacctacgtactcttgagcacagcaaagctcatcatcacttcttcatctcaatggaaatctcatgcatacacgatcatttgttgtctcacggacatgttagcccttcgtttgcttatgtttctcttcatcttttaaatttatgtaagtatgatttattttgctgtgaaacttgttttacattaaatttattttaattataacaatcagtataacaaaccgactgagttatactccatttgtcccataaaaaacgaatacaggaccggatatgacattgtatattcagattcgtagtactagcatgtgtcacattcgatactagattggttttttatgggacggagagagtatatttaaaacggaggtatcacagtgactgttcgtgacgacaacgttaaaaacaatatttaggcatgcatagtctcgatcacttttaatatatctacccctaatgatgtcaacttagcaccttttaacacaaggtaaacaatcgccttaaccttttgtgcttgtgcttcgcatgtgtccaacgagcgttgagctgaatccagcaccgcaaaggcaagaatcctaccgtgcactcgcggctacttcatgcattgtactactcttaaattaaagaaaaggggtgcaaaaaaaagtttatgctgctgatgctgtgatgcatgcaggacaagcaattaaaagtactcccaagacatgctttagcaaaacaaacataaacaaggacaaaacatggaatggtaggcgattattaggcacccccagtagctgctagtttcggtagcacgaaaattcaactgcttgttaattaatctgagccgaaggaattagtagaaataatcttggaacactggcatattgcattattattgctcaccggaatgtttgaactttcaggcagcattttttccaatcctagaaagagaacaaatgcagtttgaggaagcacatttgacgtgtgtggatacatgactcttacctatcagaggttaaatcctagtacccgtaatcgtgcgattacgggcgcgcttccataaagagttttgttggcttttttcttcttgtcgcatatgaaatgagaacgcactcgtggatgtgtgtgtatggtgtatacatatgaaaagagagtgggagagaataaattcagcttggcatctgttacccacaagttcagtgatataccgtgcagcttggacaggtatccgtgcatatgcatctacctgagacatggtagtgaaaggaagaataaagagagcaagagagtggcagaaggcacatcaccatttgttgccaagacctccaatcagaggaggttttatgggcactcggatggcatttgactaagctatcaacagtatctagttgtactctgtagcaaggcactaaccgaaaggctagatgcccagatgcacgacagctacaagatttcaacagaagcaattaccaatgaatggtgtagtacttgtccttttgtcttaattagacgacggagaagaacttggcataagaaaaaggggtgatacgaagtaccaactggaccagagaaattaaacaattggaggatatacggctggaataatgccataatgtgtattctgtactgtgtacgacaacaaacgtttattagtgaatgcaagcagtcgtattgattgaagctagccataaaattatgaaaaagcgttcgcgaatttaaaatttacattcaaatataaagaactgtttacatactatgtatgtagaaactcaatctaaatccagcttcatgtgtagggcagtagttccaacaccattgcaaagcttttgtaatggccctgggcaactaacatagaacagggaaaaacatttgaataatgatcgattgaacctgtggttgcattgctcctgattacgtgataagtatcacttgttgagaaggtacaacatatattacagatatatctatcaacagccccaccataatacaacaccaactaacaaaatttgatgagcgcatatcacccatccaaggcatgagtgcaaataaatgaagaaaatttcaatggaattgaaacctcatgattcatgaagattttgaatttcaactttcaaagtttggagcttacgctcaacagtggacaactcaccctgaacaccctgcagccaatctatcttttgctgacatgcatcttgataaggtttgctgacagtctcaacaaaatggactaattgattagcactacgggatatatcctgctgaatagcttcgtcaactttagaagaaagtttttcagcagccttgccgatcttctctactgcaagtttccgacgggtaggaaaatttgatattgcaaagaacctgaaaaaggagtattgtccattagatcaatatgcatataatttcatatcagctgattccatgcatagcaaacctatttactgaaaagtggcctctagttatcaatcgagaattacccgccagctgagcaaagagctagagcaagaaggtcttcaagtgtacttgtcaaaacagaggtcaaaagagaagctgacaatccagcaacccctagccctccaaaggttccccaagccttcacttagcaaagctcagaatgagaacagcgaagaaaaaacaagtataatgaaatcatagacggcctcaaaactagatgctctcaaacaaaattgataaccatgggaagtacgaagtagtagtaataggaaggcttcatctaccccagcaagagtatctacttgcccaaatactaattacttgcctatgataaaattaaaatagttggtacataataagaattaagaagaccattattatcattttcattaagaaaaaaagaatcaaagtaagcttcagtccaactcccctacttcaggttattttaatgttattatagttggtatatcatctcttccatgtgactttctgtatcagtattacttgagacctttcagtggttttaggttttctcatctgtgctgaaaacttcagggcttagaagtcacactttgttagtttataaggataagcttattctacagtttcaggaataataaagaagtatactgtatgtataaaaaagttataactatatcttcataggcataccacttcacgaatttcttcttcaaaaaccttagcagcagcactagcactgaagccatccagtgcctttacacagagtttctcttcttcattgacaagttcatttttctctggcggaatcctttgctcctgggcaaccaatgcaccccatctctcatggaagcagtccacatatatatttgcttcacggacattggtagaactcaaccatgtagaatattcacttagcaaattctagacaaaagaaagaaagttttgttgataacacaaacaaataagcaccacaatgcaaataaataaccaacatgaagcaaatgttagaaatcttttaaacaaataggagtaacaggcatgaacaaatatgaaccagacaccaggagttaatgatgcccactactcaattttctcgtgatatttatgtatctgaattgtttgcaacaaacctgggcaatttttgtctgaatgacatgtgcaagaaaatgtggaaaatacaaacatgtagaaagaaaatttttaatatgatatgtaaatgagaagagtgttcaacatactgctgcgtcatcaagggaagggctcagaatatcattttgaaaaaatgatgtaactttggtgggagtgcttttcccccctgaaagggtgtatgtaaaaataaggtcaatgtttgacaactgaagtgtagattccatgagcgaaattgctcggcctttagctctcgcaatctgcaagataaaaagaaaatatcaatgcaacaggttaagacatttgtcaactatacagtattacatatggactaaagatatctcaactgaagcacatgccactggaagaaaaactaaaccacccctcataatttccttagaaaggagaggaagactttcactcttttgttcgcataaacttcagggagaaaaaatgaaaaaccagcaggaaaaacaccattatttgtatgttttctcttattttgcatcaaagctaactactatgtatgccttatggttgcaaatagggaatatatcatagtagaattgaagaacataagggtaaaacagaaatagtcatcttcagaaaacctacaagggatgaaatctgcctttgccaagaatcactgtcagcctcaatcttcacagcataattgtttgcaccagaaacaagatccttgatggatgttaggtcatcaatagccttttcatattctagcttcacaagcctttgacatgacgttagcaaacgatctgcaattccaattggcgtttcaagtttcagccggaccctttccttcccattttctgttgatccatccaagaagctcaataggtaatgctctagatcataaaacttgctgtttctccatctagggtcattaaacaaagcttccccatgatgctctcttccatcattttttgaatacaaaagcttggcctccagagcagagcgtgaagatacaggaaataatgtcacatcctctgtgttaagcaattttcttgcattttccttgataaatgcagtagcctcttcaagctaaaaccgttggattgagaagcaaaatagcaatcaggaaaaaggtaaataggataggcaatattttgcagggattttgaactagagatttatatcagacctcgttactgttccgataaaggtccaatttgtttagtacaaatacaactttcttcttccactgctgaacatactggagaaatccgacctagaagtcaagaacgtttttagctccactgtaaaggacaaataataaaggaccaaggacaaaactgcatccttgagagataaataaggattatagaattttcaataaaatatttgttaggtaaggaatcgcataaggataaaatcctaagcaatatgcaatctataagtttaaaaaggctcgtcacagatggccacaatatcacgttcctcaaaaaataaacttgggtgtgaaaatttaagtctttagtcagtattcaaataagtgtaccaaactacataaaaaatgtgagacagaatgcatatcataggttggggccaaggaagtgtgttctgcaataatttaggcaacaggcaacaggcactttcctaaggaagtgcagcatgctaaattgccaatgcatgataaaaggatgcattgagttaatcgccctgggagattatattttaaacccaccgatcccaggaacttagacaagtcatacagacaatccttcccttttgattaatttcataattgtaaagaactagaaccaaatacaaatcaagagattattcagttatccatgcagaggaaataaaaatggggcacattcaacaaatgatctattataggatttgactcattttttttattgtttcatgctttctacctaccattcctaaaacatagtggtgagataatgactatcaaatgcctaaagaattggcacaatcaaataatcataatcattacctcactgtcagtcaatggtctgtctgatgaaagaacaaagagtattaggtcagctcggggcacatattcttcagtaagccgttgctgcctttggagaataacatttgttccaggcgtatcaactaggttcatctgttcaatagtacacaattaaacatctcacagccatggagatgaagtcatgagtcaagaaaattgcaccagtaagttggcattgtaacattaatgtaacccagaaacactaaggggaaataaggtggaagacgactgccatttattttttgaaatccctctcaattatagcgaatgcagacccataaaaagtcagtaaacagctaacagacaggttgtacatgctaaaactacagcattttgtagaggaaagagttgtattcctctatttcatacatattcattaactcgaatgcttccttagaacaaatatttctttgagattcatagagaaagcagccttcaagtagttgaaaaatattatgtttccttacatcatgataaccatcctggcgtagctagcttgttcaaccaaatacagtaaagggtgaaagggtagcatcaagacatcaactatgtacttacttccttcaatacgggtgccgataaatagcacatgtattgaccatccgggtgcctctcacatcgttctgcgctttcagagtcaacatcagaatatgatagcaacatgatctcatttgttgtgggcacaactccttcctgaagatacttcctcccaagtagagcatttataaaagttgattttcccgaattaaattcaccctgagataaatttagagactaattaagaaacataaatgtaagagaagatagattgaccaatataatgtataacagtctgaagaacagttcaactttttaataaaataaattgatttcatcaggacaacaagcacagcagttcagtttatgcctttgtagaacaggacctatgtttggtggagttataatctgattaattataatgaaagatgaaagagaaaagcaaggggctttatgtcagctgatgcaaatggatcaccatcaaggatgtcggcatatatgcttccagttacataaatgaggatgtggacataaatgagttttgttttaagaaatgtccatttaatagcgactcttctggtagtttatatgaactctaaactacaaaaccagatattttttaacatcaaactctcaaccctctcacagcaaaactggattgcttttgtttatgtggcatttgcatgccacccccttgagattttgtcagtgccagacctaaaaaagactttgctaggtgggctggcatgtgagctaaaacatcagtgtggtcatcagcatgtgagcagacatcaaccaaaccagcctgagggtttaaaaagtgaacaagattttagagtttgtggtcgcaaaatgtccaattctctactccaggaattcaggttgggagtgatccatttttaagttccaaggttggaggttgagatagttgatttcaacactttgcaaaggtgtgggctgtaaatggattttttcagaaaaacatagtgtatgtcagcatcatacgagcatagtgtgaacaatatttctcctcttaaaaagaattttagttttttaaattttttagccagagttcatgatgtaaaatcagccaaaatcaacattaaatgctacaggtttatctgaaccgcctaaaaatataattgctgctaagcattgatccaacatggtcataacttctcataaaaaaatccttggggtgagaaataatcatataatataaattgctttgagaaaatccatggcaggactgtcagtgttatccagcgtgagaagcagcatttccatgaaccacataatacaatttcattatttatgcaaacaacagaagaatcatgtctaaaaaatcatctgtctatgaagtataaagcaagctatcaacatttaatgtaaaccaaattaccacagtaaccaacaaaaatggctcactcaggcgagaagcagcatcaactagaagctcaacttcctccatctgttgccacaaaacagaaaattatatttcaagtcgaggatatgctagaaatgatgatgtgaagaaaaactgaattcattccagggcaacttcaactaccaaatatgtaacattagatgatcaccattggtgctgccttgcggataacagcaacagcttcacttagaataggcttttctatcgatatcagctgcattactttttcatctagttttgtgaatccagcaacttttgccttctcacgagttaggaccattacattatctgcttcttccaaagtactagctgaagagtaattagcctgtaggacactttcagcggtatccacttttgaaaaatcccgttctataatatcatcagcgagtacttgaataccagccaaagacataacaattccagatgcaccggattggagcaacctggatgtgttatctgagtaagacccttcactttgcgaatcactcaaagtggaaaaaatggggatcttcacatgctgagtgccactaacaccattcataacattaatagcatcatcactgccggtatcgatgataagaaaatcagccccctctgaacttgtggcgcttcttgcagtgtctgcagaacgtatggttctagcgacaagagggaggtatatggagtccgagttggacttcatcatcatactccttgcaacaatagcaggaatacctgcatcaaagtacagaaggaacctccttagaaaaatgcttggttgttgctacatactagtagtttcttttttagtacttctaaagaaactgactgattattggttagcaccacgacagagaacaatatctagcgaaatctggtcaaagttattgacatgacaagtactgaaaactgggaaaaggagcaggtaagacaagtgactaaaaaatgtacttccttcgtcccatattaagttcatttttagcccttcaatttgtcccaaaataagttcatttttggagtaatcattgtgaatgactagttgataccccacgcgttgctgcgggacagttatatcatgaatttgtaagctataattctagaactttttttttgactgaataattctagaacttttgactattggtatagtatcattacatagaagggaccatatagttataaatttatcataattacatgatcaacatgcttgaacgttcgatctgtacattgaattgctatatgaatagaaatgacatgattccaattaagatactcccatttcgaagaaccataaacggtaagcaaacatgacactatttttattatgtactaaattggcttaagatctcattcagatattttaaataactaataaaatatttctttttgtgagaaaacaaagagaaaatacggataatgttgcatgcatatgttggtatatgatcttaaaaaaaaacaactattgggtgcatgaatctagtaatttcaagaaacatgttcacctataagtaaattggaggaactgtggagaaacaaatttagtgattgcggtcttaaaaacacaaagatttggcacaaccttttaacacgaagaaatcagatatgaaaagaagcaagatcatgatagagtaccaaaaaccaatcaccataggagataggcatagatacacatccttgcaattggtaaaaatcatcgagtgttgtaatctgtccaacaaattttcgatgtcatctatgacagtgacaaaccaaaatttcattggaccattgacatttcctctttagatgattgaggaagcctgttcaagcataaatattccaagaaaatccattggatcaacctagatatggctagtagatgcattagaaaaattaaaaggaatgataaaaaggtagacacaaatgtagtggtgtaggctttaggtgggagatgtattggttagtggttagtgataaagggatatataatgatgcgtgaggtaattaagcggaagacaaaaagcattggtcctctcaaatgccatcggctgagaagaacttgatctaatggttgatttgcatagacgcaagatgatctaatggttaatataatcttgatgatgtggtctcacagaatttaagctttatagcataaatgacttgtagtgggtaccaactataaaggaagaaaggatggtatttggagtagataaagtgatgaatagttgcattgggatttgataaaataggagtattctagttttttttttgttttttatgatatgcgtgtgattgatgaaaaatgaacttattttgggatagaggtggtactaaattatacgaaaccatatggcatattctaaagggtaaagtccaattatggcccttaaactttgctcgaaatccatttttcgccatgaactataaaatcgattggcgttcggcctcaactttcaaaccgaataaatatcaccctgaaacatatttttcaatggctttgtttcaaacaagcaactacctaccacaacaagcaactactcgtacgaaatacgaagctggggagaaaaaaagcagtcaccaaccgtcgtcagccagcacgacgccgctggcaccgaccgccgaggcgacgtcgacgcgctccgcgacgagcaggtaggcgcggtccccgaccgacgccttgagcgagagcgcggcctcgtagacgcgcccgccgccctcctccccggcctcgagcacgacgatccccacgccccgcgccacggccgcgaccaccgcgtccccggaggccagcgcctcgtcggcgccgacgcggaggacgagcgccgggacccggatctccggccgcttgaacccgcccgggaacagcgtcctcggcggctccctcgaagaagcagcaccgccgcccccgccggacactccccctccggcggccgcagcggcgccaacatcgcggaggcggaggcggtggcggtggcgcgggaggaggagggagcgggaggtggggaggaggaggaggccgcccgcgcgcggcaaggggaggccggtggaggaggtggaagcggcgaacatggggagcgacagggatgggactgggagagcgagctctcgcctctcgcgcgcgcgggcgcgtgtggacagcggagagtggaggtggaggagaggagaggagaggagaggggggagtgggaggtagagccgcgcgtggagtggagtggaggggatatggagttttctcgcggatttggttggatagggtgattgcggagcaccgcccggcgcccgcacgggggattttcccggtcgcgctcactcgcacaaaccgtttgatggcagtttccttcaaaaactagcgtggtttaagtgacaggttttttactggagtttaacttccggcttgtgcaaaatgcgtcgggagacatgagtacgtgcactaaccagatattttagtttactataaaagatgtctatgcgttacaacggatgaatattattttaatcttattattgttatacggtttggctatggtaaaatttactgtgagaattcgcttggatattttttttctagaaaatcatgagttgtaattaggagtctgacactcatcttaagttagtatgcaaatttttttaaagagatttcttatacgactccttttatatttctaaaagcaaacgaacttaaaattggactcaaacatggatgtatatttctaaaagcgaaaaaaatttaaaaaccgactctaacacggatgacgtaccaaaataccagcaaaaacatcttcaatttttataatagtagagatagagatacagtttaattgaacacattgaacacatctatcaactaattttgtaaaaagaatatctgctaagaattattggggttgtttggctatatggtttaatgttgtgctatagcaagcacaaatagtaccacccacacaagacagcggcagataaagttgcagctatagtttcggcctaccgaacataaccccattagtagctataagcaactaattaagaagagtgaaatacgctgacacttatatcacgatataatattgattcctaaactttgaaaacaacataaatacacgtcggtaaccacgttagtacatagagtacacgtcctactattttttttaacttgtatgatagtcactctgcacttaaatatacttatcctagtaaaacaaacaaatcagataactgctttatccaaattcgtagtgctaacatgggtctaatctcattctatgttacaacatttgaaaacggagtgggtatatttaacaagaatgaggggttacatttgtatttcgaaagtttagaaactataatgacaccaagtataactttaagaattgacaatgcatttgactcaattgaaaaaatagacgagaatattagcacttccatctttacaccatagattttcacagctcatatggaataatagaaaagcaaaggaattttgaaagatttgtatcctatgaaaaaaaattcaatgcatacatttaaaacaaaggatccagcactacaaattcctttaaaaattgtatggaatggacggccaatccatgggaaacatttaggaaaataagattgaggttgtgcttcatgttttcttcttcccgtgactcaaattttctgcatgttccctatgtataatagttttgaagctttatgtatttttaaagttaacatagaaatttgattgtcatcctatcatgtttctacgtttttacggttttcctattcaggtgatccaactagaatctatgtttgcttttctatcaaaatccatcgtaccagaacttgaacagggtaacaaactagacaaaccatggaaatgctatcctattaaattttgtcattgcgcatattctctcttatggacacagatttgatatcaaatcgaacagttccttttcattgtttccaaaatttggtactatgtcattaatagttactttttatttagacatataatatatatacgatgatgtgtaagaaatgaagtatgtacccttaaaatgtttgaattgactttctccgcacaaaggtgatcgtaatgggaagagagaagctaggacctaagatcacattgcaataccaaaatatttttttcttaagttgtctatttatcggttgccttctttttttttctttttccattaatcacttttacatgcttagcattgcctagaaattcatgcacgtcaacaaactaattaatccatctcttcgtgatcaatcccaccattcatgtacccaaacatagaactcaatatcaccgctactctcaagagacaaagagaggagggcatcctgaatctaccaaccaaaaaagccactaaggacaagagccctctccagctctagaatagaagaaacttaacatcttgtacacactacagcaaaaggatccagataagaacatatgagtagggtattacgtttccgtacggcgaacctgtataaactcattgtctcgtgttcccgactttaggtccgcacactagcgccttggctgaatcacaaaatggaggttctgtaagtgttctggacatgagatacttcttacttctattttaggctcggtgggaccaaccatatactaagtttaatacagaatcaagtctcatatatggaaggtgttctggataagggaagagaaacaaagtcctacttgaacactacaaggtctacttgaatcgtatccatagttgcctccctcgccttacttggacaagagagcacccgaggatataaatacaagtccaccagaaggagaagggacgcacaaataaaaaaccaatacagattagcataagtcaagacaagactatagcgccacaaaagctagggcaatctccaatcttgttgagttcatgttcgaggaagtcgactactactagtcgtcgacagctttacaccactatactgatagagattatgttaggtcatccttattattgtactcgtgtgatattgatatataatagcaacaccagttccgatcaacaggagtaaagttattacacgtaagtaagagtcttggatatgtataaaaaataaatgtctctcgtctcttaacttttaccttaatcttgcgtataccttgacaccaacgactcctatacttcaaaaataccatatatggggtatagcctgttgacggattccttttctccctgctagagtagtgacacccccaccttcctatgcactaccgcctctagacttgttgtcactcgttggtattgctttcctattaccgccaccactagtgtctccgtctctcctcttctcaagtcacctaaggcccaatttaatttagatttttaa

SEQ ID NO: 17589 - DNA, 3900 bp, Oryza sativa
ccatgtaagttttggagaaattctaacatgaggtagaacctcttagaaactttccttttgagtctttatctctcctctaattcctatgtttttcctgcggtccaatcaaacggtcattcttgtattttgcaatcctctgttttacacttatatttctatcaaaatcctgtgttttttctattcctatgttttcgtattcctatgatttaaagggctcttagagtcttgaagactgaggcaaagtctgttatcttaatcgattgttacagtatcggagtaataaattacggcagtggtagccgacccaccggacagagcctcccacagtcctacacccatcatcatcaataaactactcctttgatgatctccccacgttggtacgtccagaatactcgctcacccgaacccgcggcgacttcgccggtgaccttcccgatggcgcccatctcctgccgcgaactctccccgcacctctcctctctcccccgcgccgccgccaccaccaccgcccacacgcacctctccttccgacgcgctccacctccgtgccgcctcctcaccggcacagccagcgacgacggcgacaggctgcgcctcctcccctccgcggccacgagggacgatgcgctcgcctccctcgtcggccagctcgagcacgacgtcgtcgttcgccacggacaagcggcggaggaggaggaggaggaggaggaggatgaggagctgtatcaccacgatagccaggacctcggggcggcgcggaggcgccatcaccggcagcaccaccaggacgggcacgagctggcggcgcggtggcgggagatccacgggcgcgacgactgggcggggctgctcgacccgatggacccgctgctccgctcggagctcatccgctacggcgagttcgcgcaggcgtgctacgacgccttcgactacgacccgtcctcccgctactgcggcagctgcaagtacccgcgccgcgccttcttcgaccgcctcggcatgcccgccgccgcgcggggctacaccgtgacccgctacctctacgccacctccaacttccgcttcccaaacttcttctcgcagtcgcgcgcgggtgccaagatctggagccagcgcgccaactggatcggctacgtcgccgtctccaccgacgaggagaccgcgcgcctgggccggcgcgacatcgccatcgcgtggcgcggcacggtcacgcgcctcgagtgggtctccgacctcatggacttcctccgccccgtcgccgacgagggcatcccgtgcccggaccgggaggtgaaggtggagtccggcttcgtggacctctacaccgacaaggaccccacctgccgcttctgcaagtactccgcgcgcgagcaggtgctcacggaggtccgccgcctcgtcacccgctacgccgcgctcggcgaggacgtgagcgtgacggtgacggggcacagcctcggcagcgcgctggcgatgatcagcgcgtacgacatcgcggagtcgggcgccgcgagcgcggcgcacggcggcgggaaggaggcggcggcggcggtgtgcgtgtactcgttcgcggggccgagggtggggaacgcgaggttcaaggagaggttcgagggggagctcggggtgaaggcgctgcgggtggtgaacgtgcacgacggggtggcgcggatgccggggatcctgctgaacgagggggcgccggcggcgctgcggcgggtggcggagggcatcctccgggtgccgtggtgctacgcgcacgtcggcgtggagctcgcgctcgaccacaagcggtcgccgttcctcaaggacacgctcgacccggcctgcttccacaacctcgaggcgcacctccacctcctcgacgggtaagccctccttcacttctgattaagatgatagttcgttttttaaatttactaaaaaataaaactttcgtaggtttttcttggtccctaaaacttttagatttgcaaccatgagattgtctccacatatgtctccaaatatgtgcatgaaaaaaatcgatagaaaatgttgtacttaaaatctcagtactaactaactaaaccaaactatacttgaatacaagttttatataagttatatcctagtttagtgtagttaaaatatagctacactgaaagtttttaattaaaaaaacttgcggtagttttttaaatacgccctttttaatataaaacttgcataaaatactttcagatgaaattaatttaaaatattaaataaatttattttttaagtttatataaataattgaaatttaattaatcatgtgttaatagtttttttattttctatcctatttaatgttcattagaaactaataatggtgaccatctcaacttgacctcatcagctttgcacatttggtacctacctcatcatccatgctcaaatctccgaaagccaacttttgaaagtcagaaccgagccgattttggtaaaaaaaaaaaggagttgaaataaggcaacaaaagcactatattaagttttttaaccaaccgctcaatcacgagaagatttggtaactccaaatacttccctacatctggtaatttgcacgttttcactacctcctcatccatatgctcaaatatctgaagctaatttctgaaagtcagaactgaactgatttcggtaaaaaaaatggttcttataaaataaggtgacaaaagctatattttaataaaccacttaatcacaagttcacaacaagattcggtagctccgaatacatcactacatgcacgtttttaattcgtactatcaaaaagctaacttttgaaagtcagaactcaattgatttcggtaaaaaataaagttcttgaaataaggcgacaaacgcaatattttaacaaaccactatcactgaatatttagtaaccctgaatacatcactacatctgcataccaacctaaaatggtaggacgtcaaaccaaagaggtctttctatgcctatttcattttaaaaaaacaataacaaaatttgacgtcaacaaaatttaataaatttattttgacataaaacgaaactacctaatccctaaacgtcaccgcatgcctatctcagtcacgccggcccagtggtttagtataagctaacaacttgaaggtgatgacgtcgcctgaaacgggctgtgtcatagacttaagtacattgaaatggttgaaagggctaaacagacggtagaaaatgacagtagcgtggtcaccgggtaagagtataaattctcgaacgcctacaagtaatcaacgatagaaaaggtggttcggcccaggaatattctgaagcggtcaagtcatctcattagtactcttattaattattttttctttgaagaagaattagtactcttaatgacgagattatggcctagtaagagactaaagaccggagggcagaaggtcgaccacttggccagtttattacaggaatgcaacatagtacagtatatgtatagtagtaggtggcagcttgcattcagcatgtgtttaaaaaaatcatgtgatcatgtggtatactagtatagatcgatcatatcgcctattagtcatacagggacatgagatgcaattatatgatactactcatgatatatgatcctctctctcttttatttatgagagatggcaatgatagtgtgatcttgtttgagatatagctagcgtgcgtgatccgtcatctagaacatgcgtacttttctattttccaaaacataataaataactacaagtgccaaatttattggttcatgacaaaatttttaaaaaggacacagctgatagcatttggtgatagtggtgatgtcctttggttgaacaatttgcggtctctactcgtatcacgtattaagatgttgaatctcttgaag

SEQ ID NO: 17590 - DNA, 8748 bp, Oryza sativa
aaagttagaagtttatgtgtgtaggaaagttttgatgggatggaaaagttaaaagtttgaaaaaaaagttactaggaactaaaccaggcctcgctgaaagtttgcggtttgaggttctgttaaggttgtctactcctatcaagggggttcagcaaggtcgggtttatttaagtgggatgccagcctgtttgacagctcaataaatgttgatcaatacggtaggatcaatgcacaatgcgacctgattaatgaatactaccacaccatggtggtgtggctactgtcatggtgctatactagagttttcaagaaaccgggtcccttgtaccggagcaatcatcaagttgtcatgccagacggggggcatagctccccatttactctacgaaaccaacgtgagcctgactgcctgagccacatcaaccagccggccagccagcggctgcaactaccaaaggcggaccaaaacacacgtacggcgtgtcattggtctagtcaatatttgtcgttttctatcgttggctgagacgtatattttgccattggcaatctgtatattaactagaaaggtggtccgtggacattcgtattattaaaacgtgatattatagtttttttggaaattgtaccttataaaggtaaattataggttgggcatgtctaaatatcatttatcgacttagaagataaatcaaggttatatgaggtcgactattggatctagtaagtaaatagtaagtaaataatatgtataccatctgaacacatactgtacaatattactataaatagtaagaaatttaaagttattgtgattgaatcgcctcatgaagatgcatgatttagtaacaaccaaattaaggatagattaacggttgcattgttcttcccttcgtagaagttcaaaatgttcatatttttccacacttttaaagaattaaaggctttttatgttagggcacaaatcacctacacaattgcttggtttagtagtgcacaaatgcttggtttagtagtgcaaaaatatcagcaattatttgaagctatttttttttgtttttcacatgttcaattgttttcttcaaaataatatttgtttgaaataagagagaaattatataaatttaattagtatgtgtagtgtttatcgacaatcatgatcactttggcaatcacttttagctacctcagctacgaagctttgttatatctgcagaaggcaaatatgaacacgtgtgttgtgcagaggattgaagataggtctttagaagctttttttttctttttttacgtaagatagatatgtctgcctaattaattaataggtccgtcagtttaagtaaaaatcgatggcaaaatattttattaaaaataatttaaaatagtgagtccactaattgaagtataaattagttaatatagatcataaattggtaatttaatggtacaaaacatagttctgtaacctttattttaaaccgtgtgtttttaaaataatggttcgaaataaaattatattatattgttaatataatgggtgaaataacagagtccaataaattttatttccaaagattatggatctaatttatttacgtatatattatgatatatataatctatgtttataaagttatagttctttaaaatttaatatcactaattatagttacaatctcatctatacatgcatggagaaaagagaggaggagatggaagcggatgtaatttttaatgatacatggaataaaaatttatgtttttttccattttatcctttttaatcacacattacagttatatatgtattttttggtttttttattagctgtgtgtaagtacctttctctcgtcggtgcgctgagagagattaggtgtaaggttattaatatatttaatttaatgatccgagataacatatccactaatttaaataaaaatcgatgaccagatgttttgcttttttcctcgtatttttctagaaatattttctaatttactaatgtgtatttttacaacttaaaatattaacagttaatatgtgtattgaattattaatttggttttctatctcatcaagggaaaaaaagtgagagtacgtatgtacgtacgtatgtggaactttttgtacgtgcaaatcttacaaagataaacatagctaggaaatcttagatagatctaattgtaattagctaaaaaataggagtagttacctagaaaataggagaggaaaagagaggtcagagggagtacctgcgcatgatagggatggggctaccggattttttttccggaagagatctaatggttaaaatatatgggtccactgatttaacggaaaatcaatgcgactcaagagtgtttataggatgacatatagcggcttaggagcgtttgtagaaagtttaatggacttttaagtatataatagatagattttttatgatttgtcacgtggcgactcgatagtgtttataggatgccacatgacggcttaggagcgtttgtaggacgtttaatggacttttagtatataatagtagatagatagatagatagattagcatatactacctccgtccctccgtcataaattagtaaattagtagttgctttgacttttttttttctttgaccattcgttttatttaaaaaattaatacaaatataaaaacagagaaatcataaagtacttttgacaataaagtaaataaaaaataaaaaataaatctataattttttaaataagatgatggattaaaagttaaaaaaaaacttgacaagtattctggatagaggttatatcatcgttccgagtactactactagtcctgcgttttctgtatcgatcggtcggtgacggtgtgtacatgtgcgcgatggcgttggtgcatgcaggtaccacgggcgcggggagcggttcgtgctggcgagcgggcgcgacccggcgctggtgaacaaggcgtgcgacttcctcaaggaccaccactgcgtgcccccgtgctggcgccaggacgagaacaagggcatggtccgcgcccccgacggccgctgggtccagcccgaccgccacagctggcacctcgacgaccacgacgaccaccacggtgaggggcaacacgggcacgacggcgccgtcgacggcgcgcaccaccgccacagcagccacatccgcctcgtccggcgccagcctaattagccgcagcgcacgcggccccggcccgttgccgggcggaaaagcagtcgcagtcgcagtcacagccacagcctcagcgcgcgcgggtgggtgggcggggagaatggggagatctggttcgcggagagtatgcaaagtgtaaaaacgtgcatcggtgtcggcatgtacatggaagaacctgttcctgttgattcatcgaccaaaacgcgttgtgaacttgcgagatgcgatgcgatgctcccttatctctgcgcattgtccaaggtcgtccagatgcttgttccgtgtcatcttttcttgtattaaaatcagagaagagaataagctgagggtgctttgaggaattgaacttagaattttgacgggaagtgaaagcccatgaacgtataatttatcgaatattaattattataaatttaaaaattaggtttatttaatttgttttacttttatatagataaattttacacaaaatacatggtttagcagtacagaaaacgtgctaataaaaaacgatgaattttactattaaagttactgagccgtcaacgctagcgaaagtccagaaggaataagttcactttagatctcttatcttggtgtcaagtttgaattatttcctttatccgcaataccggatataacgtgtccctcaacttataaaactggtttgcccgaggtcccagagcggtatattgcacgggcctcacatgtcagtggctaaatcttcctcctcccacctcttccctcacttccccttctcttagattctcaccaagcctttgagcagaagttgatgggagggctttgagtggtggggagaagggtggcggctaatagggagaggcagccaacgggagggtagcaagcggctgggaaaagggttgtcgacaagggggagggggtggtgcacggtgacctactagaggtggcaagcagcgtggagaaggacggtcttggagaggagcgatggttgcagcggactggaagggtcgtgttcttcctcctctaggctcccgtgctcacggactcgcgctcactagctcgcgtctccctaccactgcctcccgccaatagccttccttctccccatctctcgccacctattctgaagagggatgggaaagaggggagagggggagggagaaggaagaagagtgagttgctagcatatgggatctactcgctaagtcaaccaaaacaggtattatactgcttcaggtaattggtacactggttttgtaaatttagggatgcattatatctggtattgtggtttaagtatgcaagttaaactcgacgtcaagatgatgtacctaaagtgaactttttccaggttcggaattcatgatgagcattccgaacgtgtgcagcccaccatgaggggcacgcagcccatttgcgtagcagcacgatgcaatctgggcaactgaaccttgttggtcaacagctagctcatctggctactgccatcattcgttggagctatgggctagtactattttacagtgattttctcggaagctgccctagcaaccgtttcatccaaacgacgtatgtcggtatctgcaaatcctggaaaatcttacgagttcggacgatgttggagtatctactttgacttctgggttcacaagtcaattgttcttgcagatcaagttagctttcggatgggtttttcgtttataaatgataaatgatgaatgagtcaacatatttccagccgcgttggttactaaaaatctttacgtcttacaatattatgaacttattaaaaatgtaagctcaaataaataggaacaactatggtgcaagacgtgaagaatagatgtcaaagttctcaaaaaaaattggcgcttgtgggctagggcctccaatcctgtttagatgagtgttgggccattttggatctgtgtcaaaatgtgccatgacgattatttggcaactctaatgataatgtgattgggttggattagagtcaaagcatggataattcccatactcaatcttttttttaatctcccattgctccatactcaatttaacaacacttaactttctttgctataccaaacatattgatagcaaactacacatcggcattgattggctacgattgctgcctctttcgtagcggcacttaaaagccgctacaaaatagaaatgattttcgcaggcggtcaaaataggtttttacagtcggtcggctggtaataccgtgagatcaaaagccagtgaaaatcgacaatcttcgcgagcgggtcctacaatgtcagtgaaaattgatttccagaagcagctatgttaagccgaccacttgtgaaaatcatttttgcaaatggtgaggttaagccagcaacatagattttcagtgaaaaaaataaaacttttagaaaccctgctcccccataactccctgcccactttcacatatcaaacacaaaaaacaaaacaaatcatctgcatcattgctctcctaggaaccctagctccctgcccatttccatagatcaaacacaaaatacaaatcaaatcatttgcatcataccaacatggatccggaagagaacggaaagaacaaatagaaaagagaaaaaaaaaagagaggcagaggacgcacgcctcgttggagcacggtttgttgtcactggatcagccgaactaccgcttgtaccttcccacccacgcaagttgctgccaccggactaccgctaatgccttgccatcggatccaccatcccgcacaagtcgtcgtcgtcgtcgcatccgccgcccgcatgcccagctcgagctccaccgcccgcgagactcgatgccatcggatccgccgctgaacggagtcgctgccaccggatccgccgcccatgtgcctcgcgcgaggtccgccgacgaatccactatcgaaccaagtcgccgctaccagatctgtcacccacacgcctcaccctagcttcacccgcgcgcctcgcctgagtcaccaccacatacagcctgcgaggctcgcccaagctcaccaccacccatggggaaggacgaggagaggggcacacacctgtggaatccaagcgacgccggtagggaaggaggcgaaaggagggagaaaattgtgattttgctatcgcaaaagaatggtttcgctggaatgctatcccttcaaagtgattcattaaatgctatcataaactaagggtgttcactgaaatgctattttagatctttttgattgctagaaatgattttactctattttaagttttgttctgaccaaaatacccttgtgtccttgtctttattacgttgtgaaccatggtgcatgtgaaccactggtatgttgtgaactactgttatgttgtgaaccattgttatgtgaggtattttgtgaaccacatgctattcaatattatgtctacatgctgtccaaatttgttctattttgtttttacaattttttcatgcccaaattttatgggttaagctagcttctccattatatctttataacttggagtgagaaaaatcttgatgtgtatgcgcgcttgtggctgaactggactacacaccatttttaattgtacaaaatgtgaaagcaaaatatattgctatagcaaagcatgtgtcaaaaccagagaagtgctgtttgactttcaaaccagtgcactagagcttttgtattagtgttaatgatcaattagtatatatatatcacgcagcggagcgtgagccgtgcataggtttcacaaatatatagcaatatattttgctagagcaaagcatgtgtcaaccagccattatcctgggcgaaaggaggacatagaggcgagggcattttggtccggagaaaaactaaaagagagtaaaaacattagtactaaccaaaaagatccaaaatagcatttcagtgaacacctcttaggctgtgttcgggagtgagggttgggaacctcacttcctagcacggaaaacggagtagcgattagcacgcgattaatttagtatttgctatttttttttcaaaaatggattaatatgattttttgagcaactttcgtatagaattttttttttgcaaaaaacacaccgtctagcagtttgaaaagcgtgtgtgcgtaaaacgatggaggaaagttgggaaccatgggtatagaatgcagccttagtttagaatagcattttaatgaatcactttgaagggatagtattccagcgaaaccattcttttgcgatagaaaaatcacaattttctagaaaggaggagggagaaggagactggtacataaggtggagaaatatttaactatttgccactattacttgtgacaattaaggatttgctattggacccacatatcatagacatgtgagggctcacatagattgtgaataacaaattcctaattgccacattttaaaagtgacaaaaagttaaatgacccagaagctgaagggagagggaggaaggagaggtaagggagaggatgaaggagagggactcagctggtggattggtcaaggactcctcttttattatgtcgattttttttccttacgatcctctttatccaatgaaaattgattttttcgcaacgatgacttaatagacccgtttgtaaaaacactctatttttacaagtggaccttttaagtgactgttagcgaaagtcgattctcactagcggttcatgaccataatctccaaaatgtattttcacaagcgtgtgtttttttaacccgtcaataaaataaacggacggtgatatgaaaaatggtaatttagtagtgacataaattttgaactggctacaccctaccagttcattaccaaaattttgaccagagacaaatacgccagttgagtcgcactcaaatgtgtgtagcacaagtgtgacgtatgcacgtgtatttgacttatgctcggggttattaaaaaaaaaacatgcgccaaactcaaagtcggtttgcgtcggttcccggtttcccagcactgacacgaaccgccatagcggagccacctccacgtcgaatacgtcaaacacaaacacggtcacgcacggataaagcggccttggccgcaccaccgaccggcgaccacaaagcccaagcccgtaacccccttcgataccgcctctcgcggcaccgccgcgccgccgccgcaaacgaggctacggaggccgaggccatggcggcgagcgatgatggccagctcaggacgtgggtctccgaccgcctcatggcgctcctcggatactcccagggcctcgtggcgcggcttgtcgtccgcctcgcgcgggagtgcgcctccgcgggtgacctcgcggcgcggctcgtcgacctcgccgggttcccgccttcccccgacaccgccgcgttcgccgaggacgtgtacgggagggtgccccgcagttgcggcggcggcggcgacgacgccggggtcagcgagtaccagaggcagatgcaggaggctgcggcgatggccaagaagcagagcaccatcaagctgctcgacgacgacggcgagatcggcgtttccgcgtcgccctccagggctgcaggaa

SEQ ID NO: 17591 - DNA, 19340 bp, Oryza sativa
  unsure (1)..(19340): unsure at all n locations
gaggctgacggatcggaagacgaccaagcgggagcagggcgagctcgcgcgccggtcggacgccatggacaagaacgacacctcggggctcaggaggctctcccggcgcgcgtacctgcagaggcggaaggagaagaaggtcgaggagatgcgcgacgagatcgtcgaccacgagttcctcttccccggcgtccagctgacggccgccgaggagagggacatgaggcacaagaagcaagtctacggcctcgtgcacgatcgcgacgactactacagaatgccggacgcctacgacgccgccgcgaacgtcgatcaggagaagaggttctcggtggcgcggcggcggtacgaggagccagctgaggcggcgagggacggcaagacggcgaacgccttgtccgagcaggaggcctgggaggagcagcagatacggaagtcgaggctgcagttcggatccatggatcgcggccggcgcggcgacgagtacgagctcctgttcgacgacggcgtcgagttcgtcaggtcgacggtgatggcgggcaccgcgcctgcagacgacgacgacacggcggcggcggcggcggccgacgagtaccatgccgaggccatggatgccaaggccacgttgcaagacgagaggaagactctcccggtgtacaagctcaaggacgacctgctcaaggccatcgacgagcacaaggtcctgatcgtcgtcggcgagaccggctccggcaagacgacgcagataccgcagtacctccacgaggtcgggtacacggcgggggggaggaagaaggtggcgtgcacgcagccgcggcgcgtggcggcgatgagcgtggcggcgagggtggcggaggagatgggcgtcaagctcgggcacgaggtcggctactccatccggttcgaggactgcacgtcggagaagacggtgatcaagtacatgaccgacgggatgctcctccgcgagttcctcggcgagcccgacctgggcagctacagcgtcgtcgtcgtcgacgaggcccacgagcggacgctcgccaccgacatcctcttcggcctcgtcaaggacatcgcccgcctccgccctgacatgaagctgctcatctccagcgcgacgctcaacgccgacaagttcagcgacttcttcgacgcggcgcccgtcttccggatccccgggcggcggttcgaggtgggcatccactacaccgtggcgccggaggcggactacatcgacgccgccgtcgtgacggtgctgcagctgcacgtcacggagccccccggcggcggcgacatcctgctgttcctcacggggcaggaggagatcgagacggtggaggagatcctgaggcatcggctgcgggtgctcggcggcaaggtggcggagctggtgatctgccccatctacgccaacctccccgccgagctgcaggccagatcttcgagccggcgccggcgggcgcgcgcaaggtgnnnnnnnnnnnnnnnnnnnnnnnnnnnnnnnnnnnnnnnnnnnnnnnnnnnnnnnnnnnnnnnnnggggttctgcaaggtgaagtcgtacaacccgcgcaccgggatggagtcgctgttggtggcgccggtgtcgagggcgtcggcggagcagcgcgccggccggtcggggcgcaccgggccgggcgagtgcttccggctctacacggagtacaacttcgtcagcgacctcgacgacgacgcggtgccggagatccagcggagcaacctcgccagcgtcgtgctggcgctcaaggcgctcgggatcaacgacctcgtcggcttcgacttcatggacccgccgccggcggagtcgctgctcagggcgctggaggagctcttcgccctcggcgcgctcaacagccgtggcgagctcaccaagaccgggaggaggatggcggagttccccctggaccccatgctctccaaggccatcgtcgcgtcggagaggtacgggtgctccgaggaggtgatcaccatcgcggccatgctgtccgccgggaacgccgtcttctaccgcccaagggacaagcgggtccacgccgacgccgcacggcgggcgttccacgccggcaacgccggcgaccacgtcgcgctgctcaacgtgtacaacgcgtgggcggagtccggctactcgccgcagtggtgccgcgagagcttcgtgcagcaccgcaccatgcggcgcgcgcgggacgtgcgggaccagctgggggcgctgcttgagcgggtggagatcgcgccgtgctcctccgccggcggcggcgacctcgacgcggtcaggaaggcggtcacggcgggctacttccgccacgctgcgcggctgcagagggacgggtcgtaccgcgccgtgaagagccggcagacggtgttcgtccacccgagctccggggtggcgcaggcgccgccgcggtgggcgttgtaccacgagctggtgctcacgaccaaggagtacatgaggcaggtgacggagctcaagccggagtggctggtggagatcgcgccgcactactacgagcgcaaggacgtcgacgagcctgagcccaagaagacggcggcggcgactacgccgcaagagcagacgacggccggctctacaccaacgaagcagactccgaatctgaatagtttcttcgacgtgtaaagagtgccattggaacttgtaaatagctgtaattataccaaactaacaagtgaaaagttcaagacaatttgtttgttgctcaacttgtgacttatcatgctttaatcaaaacgaaaaacattgctacaatccctactggattcaggcaatacacgctctaacaaacgtaatgcctaatagaacacattaatttcttcgacgtgtaaagtaccattttaacttgtaaaatagctgtaattaccaaaccaactagtgaaaattcaagacaatttgcttgttgctcaatttgtgtatctcttatcattctttaatcaaaacgaacaacattgctacaattcctactggattcagggcaatacacgctctaacaaaatgtaatgcccaatagaatagattaagcacaagttagcatcaacatcagagtttaagacaattggcatagtgttgctgagtttaggtaacgtactactgccagtttccgtactgctgctggttgcgagaaccaccttgttggggataatttgaccctcggcctgggccagaaggaccatatgggccgccttgctggggataatttgatcctcctccatagccaccaccaacgccaccccttgggccacctgttccggccattccactgccagggtacggtggcggcggccctcgaccttgttgagggtaaggggcatttccatagctgccaccaccaccttgtccgccgcggttcggatatcctccaccttggttcccaccctgtggatacctgcttgagcctcctggccctctgggttttgcatagtgatggcctggcccagcagccatcggcgcatgggggttgttcatcggctggcctggtctgatttgaggatggggctgtcctgtttgttgaattggaggcaaacggccatgtggttgaggatgttgtgtcttttgcctcttcgcagcttcatcggcttgacgcatttgttggcgttttttcttggtctggaactcgtgtgaagattcatactttggcaagctgcattattccaaatgaaaaggatatgatcaaataaagaaagaagagatccaaaatagcaaccttagatggcaagaacaggagagaaggccatgatcactaccttttaggatcacatggtaggggatcagaccagaaatactctgcatcaagtgcatcttgtgctgatatcctctgaacagcgcaaaatcatgtcaacttacagctcagtaatgaaatgcaatgacagctgaggaaatacgcaggtacgggcatttcctatgtcaacagagtaagcaaactaaaagaagaaaatatacctgtgctggatctagtgttaacatcttttcaagcagatccagagcaagcctgtcaaaactgaaaacaaataaaggttaagtaacctggaagagtagccaagcaagtttcaaacaatacgagtataatacttactgcttaaagtactcctttacacgtctcttcagttggcggggaggcttgaaattgttgtaccaaggcatttttgtgacacccggccagtttgattcatcaggtgtgccacaaacatcaaatattttgctcagttgctctggctgcataaaaaggcagagcgacaaaagttcactcacaaatgtgcattattaactagattaagttacatattcaagcttcgaatgtatgacagcaatgaaacaattcaagagactgattgcatttgtctaaggtgagggagagctaggtcagacagggagttaccgtgttcagagttcatgtcatgtacaaagtaaccccacaggtcttgaaacaaattaagattcataaagctgacccacagtgaatgtgttaagttcatgttcctcttgggaaagcataaaggcatttctcaacttctaaaacaaattcagtaaatgagcatgcactaggtgcaaatcatttttcgtgtacagggctgcaggatgaatcatgtttttccctggtggctgcagcagcaaagtttaatttatgactgaaggcagtacactaaatatagggaacttcctaaagtttcattctaccttctaaattgcacaaatctatcaatttgttccattatctatacactctggtttcactttcacatgtatgcagaagtcacatcacttcatcagaaagcattcttaaacataagttttgtcgataatcatagtaataaacagaaacagctgttaatagcatttaaacaaattatgacaacaaagaatccgtatttcttttggtcaacatgaggtagaatcataaatttcctcaacggtagcacaataagatattagttcagaacacatccaactccaagataccaagactagtaaaaaacttaccatatgaattgctaatcctaagatagtgatgttactagctcaaatcctgaagaaatcgtacctcattctttcctggcagaattggctttccattgagaagctctgcaaaaatacaaccgacagaccacatgtcaactgctggtccatacttggtgcttccgagcagcaactctggaggtctgaaaatcattggcaaatggtcagcatgatccaagcaaaaactaaataccataacacaatatgcaaaattcaatggcaagttcataattctgcaatacctgtaccacaaagtgatcacacgattagtgagatttccgttatgatcatttgaaaatgatcttgctaggccaaaatcagccagcttcaagttaccttcattgtctatcaagagattggatcctgcaagagtagattttgaatcaggaatattttagcataaaaaccacaaaatcatgatcactatgagatgaataaaatgtaacgaagcttagtgttgtatacctttaatatcacgatgcagaacttgattaatgtgacaataatgaaggcctgtaaggagttgcttcatgtaacactggtacaagaggttataccagttatcttgccatcattggatcaagaactacctcctagcaaaccaagagccatcataacataatggatggttttaccttaatctgcggcacggtgaaacgcatcccaggcctatctgccaacccagtcaagtcatggtccatgtactcgaagaccatgtaaatgctccccttgtacttgttaccatggactatacaacgacataacaacttcaacataaaaaaaaatatatgcagcaacccaagaatatcaatatttatcgttcttttaaaaagccgtacttggtttcccctgctcatctctctccggtcctgcaacaattaaccaaatccatcaattcctctggatacagaggatgatttttcagtaaatcacaagatgttctactatgtcgaatcattggttaaacctggcgaggtgacgatctccttgagctggatgacgttctggtggtgcagcttcttgaggattttgatttcgcggattgcagtgatggggaactacgccagataccgtaacgatgaagaatacatcaatcaaaccaaaaaaaaagagagagagacacaaaatcgccggaaacaggggcacggatacttacgccctcgcgctcgttatccatgcggatcttcttgagcgcgacgatctcctgcgtctccgtctccctcgccatgtacacttgcctacgaacaacgcagccggattggaacggcgtttttcaagggattagaaatcgaattgagattggggggagaatcgataggttcggggcttacccgtatgtgccctcgccgatctgctcgagcttctcgaagcaatcgacgctgcgggagccccacgacggcgactcgtcgaggttcagctgccccggcgccgccaccgccatggctctctctctctctctcgggagcctcgccttcgctacgcgtttcttagggtttcgacttccgaggggagaggagctgaggagggaacgacggggcgagttttttttttcctctcttttaattatcagctattttttttaggtttttctttcctttttcttttccttttcgcgtacggatcagccgttgcagagggtatgggtatacccacggcagcccatacccatacccatacccatggtagcccagccctcaccgaatcttacccatacccactgggtatatgggtaaacaacaaaatgctaaaaaatagggtgcgtcgctactgatacaatcgagtgaaaattttcatacattttcacgggccaaactgttgaatgatagtttctttaaaaagttatataaatttgcttcaaaaaaatcatattaatttactttttaagttttaagtaattaatacttaaattaatcgtgtgttaatggctcatctcgttatgtatcttctcagtatttttcttttgggtcaactgtacatttgacctattttaaagttgcggtaaattgtattcctcatcaataatgtcaggctccggcctcaaaggagctagggtacggcaataccattgtaatctagcaataccattgtaaccgctagagtgcaagacgagggaagagaaggttaggggacgtacatgtccttgtagagaaatttgaaattatgccattgtaaaaaatgtaagtctcgttaatatatcactctatagattggtttcgttaatttactactctcaaacgctcatcattgacaaaatattttcttaaaccaaaatacccttctttcccatctttaattctccctccccctcccccaatttgtgcttgctggtgacgacagattggaagtttttatctaagttgggtttggcaatcataacatgagttgtattccacgtggattttcgcattaatccaagtggcatcgcccaacatcccaaattggaagtttttatctaagttgggtttggcaatcataacatgagttgtattccacgttagagcgagtctaatagattaaatatagcaagactatgagctcatagcatggtaattggtgtatataaccatttttttcgttttcctccgtttggttgtacaataaacatttagctgatggcagttttgtctatacttacatttagccgatgattgtatacgtgtatacaacaagactataagagttatacttcatttatccttaagaagatactaagcgcattataatcataagatactcctgcactgccaggtagccacaaactgcctctttgcctcatcaaacccatatagcatgaaaaatctattgattgcttcagcatgacaacacaattttgaaagttgtcgttggctgatgcatctaaaaagacagtcatcgtctcaacaagttcaaacaacactcaaagaaaacgtataatgaaatcctaatatcaacaaacttcccttgccatacaagaattccaaattcacatggcagttcatcgattttataacagggatgactgcgatgcaaatttgccaccacatgaaggagcactctgagttgtcctgatcgaaggagggaaagaatatgtgaaattacacctgaaacacgtgtattacaaattctgttgggattggatcagaaacaatgtcagaagctccatttttctcacagaagagaagatcatgtggtttttccaatgcctgatgcattggatctgcagacatcaccacgacaaagtggacaaaccctgaaagaaaagggttatgttcatattagcaggatggcatatcttggtagctctaaaatataaaatgctaacctgacatctactcttatcacacatatatatgaagccagatgttttgagcaaattgagaaactaaattcagagaaaaactcatatggttctactacgtagctcttagctttattggagaaagtatatctaggttaggataccaaagtttaaaatatttaagccaagtatgtttcgtccttttattggctgtgtgcattttatgcagaggccgggggtgggcttagttgaaatgtatcatcttggtttatttgactgagtcttaataaagcttccattatctaaaaaaaaagtactacaaatgtggcaatcaagaactatttcgagtacacatcttgatgcaaagaaaaatatttaaaatatctatacaaccaatgatctcaactaagaatttataaacgtacatgtataaatctactttgctgaaaaattgaaatctttttgtattgtaattaacctatattactatactggcagaaccatgtcaaagagaaaatgagtattcgatcgcatggtgttcagttgaaaactcacttaacaggaagataacaaaattgcaaaagaagacatggggttgggaattattttttcgtttatgattggattttgtagtctaaaaagaattggcacccaattccccacacgcacccctgaaaaacacgaagcatgtaggtcttttcagtacataatgttgctttcttaactgtcatttactcaagttatgttagaacacttatcaaggaacagctatagagctctgacataaagaggtaacaatagcatgttgaccgcagttctgttcatttacttatgcaaattataaattatttagattaatccatcatacctgtgtatctctttcaaccatttatctacgcatgttagatgaaattcatgattgcatggaagaatacggacacagtctccctcggcatattcaacaaggcaaatgtagcatctgcatagcaaggaaaagatgagaagttgcaaaatgacacacttttctttagatttattcaacgatagtactaaataattctacagtagaaaaatttacagacgcaacagcctaagctggaaatgaactagcagctcaaatgccctatgaagagaatagcaattctgttatattgcgagaagccaagaattagcatccatgggccctttcttatactcagcttaaaatttggaatttcggaccacgcatgatacatcacaacatctagtcaaagtatcaaaacttttgagtactaacaccagttctatttagtttggatgagtaaaaaagtagatgtgaagaaatgtctcataaactacattcatggtaccatagttttatagaattttataaataaataaaagcaaatttcagtggaaaaaggttgcatccatagaccatgcacttaaatgttgacttaaaaatggcatgtgtttgtggctagatagagcgttgatagcaactcaataccgctcatgtcttcatccaagcacttgatgggtgatcaaatagcacaaataatcttatgcctatgcaattaaaagacataagatcttaatcactctagacattcacagttttttacttgcctctgcttcacttgtcctcaagatttagttttagactctgaactttgtgggcaaataataatggctataaattgagcatgggtagaagttcaaatattgaactaaaaatgttaaataatttctatacaagctcagtggcttactgtgcagcctcctcagtttggtgttttaatgatctcctgtatacttttacaggaagacgctcgacaacctcctttggagcaggaacggacccaattgaagaaaacgatggccttgaggataaggcagcagactgttggtggatctcatccagaacctgatgtgtataaccatatggaattatggatgcaatttaacatttttctccagtaaaagaaagcggcaataactacaaacaattgtactacttacctcaaaaagtgcttctgctaacataacgattcttgatatgctagctcttgtgtttgtttcttcatcagaatttcctggtcgactgctcgttctgcaattacaatttcccgttctatgctgaccagatagtatgcatgatctctcatgtcctgatagtcctgatagattttcatacctgctgcccaatctttggagagctcggacctgttaagaaagcaaacacattagtatgtatagctgaaaactaaaggctcaaaatagttgaaacacagatcacctgagatcgtatcctcctcctctcaagaaaagctgatctgcgctccagtagatcccgattattggcctctcttagagttgcagagtcggttgaagaatccaattgcagttcagaatttctctctgaattagtcctttgcatgattgctgaattttgcctggcactagcatttcctgatggccatattgccctatcgtaaagaagtgaaggggtgaataacccatctgagaatggagtcctcctaagaactctgtcacgaagacgtccaacactcaacgttcggctgaatcgaacactgccttcaaaaggttcctgaggtcccatccttctgttggaatatctcaagttagcattgtcggattctagcaaatttctcctagcctgatgggctgctctagcttgtgcggttacactatctctaagcatatccagagtcgaatcaatcccagcagttgatgcaccaccttgctgggagatgtttgcatcagaagaattgtccacatttccatggcctccatcaggattagctgaagtggagaggtccgatgagagaatggagcaggctaccgatgatcccaagctgacagctctactcaacccgaagttgacaccaaaacgtggccgtgaactgtcagaatgatttggtgactggttgacctccaccctgttgttgacggcagtggcattctgcaatacatcaacatcctgatccctgtttatatgtgatgaaggcaatgttgccccttcacctggatgagatttagggattgtgggagcatcctcttctgatttgtccatttgagcgattgaaggcaggcttccattctcctctcccttgctagactggaaacacacaaatgcatcattctgttattagcagggcatctaattcataaaaccacatattgcttacatatgaacagacttgtctgatcccaacaaatttaatcaatttcattatacactgattcatactatgagtatggattaggaaactctcactattcatcaagctccactcactgtcaaagccactgtagccaaatcatgcagcactcagtgaaatcgcattgggcaatctcccatccccacccaagtactaactcgaatgctctgcagcgaaaacggtggaaaccacaaactccccccaaccacgactcgacatgaaaaacaaggcaatcgctcaacaaacacgagatctagccccagtccatcgatggaaatgcacgcatacgcacaccacttcatcatcacacgacgtttgcacaggcagcattcccggctcagtcaaaggaagcgcgggacggcggtgtcctccttacctcgaacggccgccgcggcggccgtggcggtggcggtggcgaagacgccgaggaagcgtcgtcgcgcgacggcgtgccgtggccgcggaagcaggaggaggaggagctcggcagccgctgcagcaggcctctccccctccccctccccctccgctgccccttcccattccccttactcgcctcgtcgccgccggacgccgacgccgacgccgacgccgacgacgaagatgacgccgacgaggcgccggccttgctgcttccagatcccatctcgcgccaccacaccaccaccaccaccaaccccactcccacctctactacagatgagcggatcggggcaggccgcgcgccatcaccatcggcattgctcggatttcacgcctcgctcgcgcgtgcgcgcatggatggccgcgaaagggaagctagtaggagtagctccgctccgcctcgctcctgctgctagcctagcaaccactctctccttccttcctagcgaggcgaggcgaggcttgcgaggcagtcagagagagagagagagagaggagaagagagggttcggtaaaattaactaatgcctctctctcttcgatttgattggattggatagttaccaataatggcgtcctcgtggacttcagccttacgatgagtgtgcaataatgcactctcctctctctccgagacaactcctcgcttcctttcaccgagaatttccatttttctactctcaaatttactctcttttttatgcacacccttactacatttgaggttaatcagatccatatcattgtgattttgaacgattgaaaaaatatctttattattcgttaaactagttgagtgccatcatcggtatacatctgaaatttgaatcatgcaattacattgccttgaattgccatcgagcttcttttttttatctctaacgtatcatcctattcatacgtcttaggtcattcaggcaggggcaaacgtgtccatataaaaatacggtagagaaaaaaatgagctcgctgacgattgaagacaacataatggcacaattcaaatttcaaaggaataccaaatggttttttttttcagtcaatcaaatttgcaatggtacgatcgaattaaccctaaattttacagctaccgcactacgaaaatgttcagtttctcatgagatacgtatactacggttcttatgagcgtgaatcacaatcttgattcaataaggaattaaggatcgtttcatgcactgttcacgtcagtataaatccaagaggatgctggtaagggcagcggtacatagtatactccctctgttctataaaaaaaacgaatctaaaatcggatgtaacatatctacgttcagattcgtagtactagtatatgtcgtatccggtattagattgattttttatggaacggaggaagtactagtacagtgtactcccttcatcccctaatacgagggattttgatattttatttgcactatttgatcattcgtcttactcaaaaaaaattgaaattattatttattttatctgtgacttactttattacccaaaatactttaagcataacttttaaatttttatatttgcacaaattttttaaataagataaatggtcaaacagtacaaataacaagttaaaatcccttatattatattaggagacggagtgactagtacagtacgctcgtagtagcaggagtacactcgtaagagtggtacagtactatgcttgcgctggtaataggattgtgggaaaacgtaatacaagagtcccgtcctgtaaactgtgtactactctctctgtttacaaaccctacttttcgtgtgcaactttaactgtacgtcttatatgaaattttttataattcgtatttttattattgttagatgataaaacatgattaatattttatgggtgacttgtctttttaatttttttttataatttttttaaataagacggacggtcaaatattaggcacggaaaccaagttttttttagggaaggagtacaatgtagtatagtaggtgatgtgagtcgagacgagaggataattgatggtggcagatgcgcggccggggcggggatggtgggggccacccgcaacacaaaatccagcggagcagtcagctgcctggggggcaggcggtgctgtagcttcgctcgtcgtgccgatcgaaaaactcctccgcccccaccccgcgcgacttgtccgcatgtggaggcacgaggcacaggatggcagacgagaccgagaccgagaccgccctactagccgagagagagtccgagaccgagaccgcgaccgcacaacggagcggagcgcggcgatacatcgcccacgttccccgtccgcttttgccgcccgcccgcgcgcacacgcaccacgcgacgcgcggcgcggcagcaacccggccaacccgccgatgcctcgggtgggtgggtgggtgggcgtgtggttggtgtccgcggccgcgcggcggatgggtggatccgggcggggggcgtggggtctctcgcggcgggggcgccggtttttgatttcgaattgtcgttgtgggtgtctcgtctgccgtctgccgtctgcgtccgtgtttcgttaggcactgtggcgcgcggtacggacacctctggtggtggtggttttcggtttgaccggatcgtgccggcgtagtctgatgacagcagaacggctagcttgttttgttgggttcggccgctttaattagccttgatgctgtattttcaaaacttttgaattgtttaattattcgtagattatccatgcaatttaatttaatatttcagcgtttaaatttgagtgatttgcatttaggctatcttttactacctccatcccaaaataagtgcagccatgagttttcacgcctaactttgatcgtccgtcttatttaaaatttttttataattagcgtttttgttattatgagatgataaaacatgaatagtattttgctcgtgacttatgtttttaattttttttcaaaaagttttcaaataagacgaacggtaaaagttgggcgtggaaaaccatggctacatttattttgggacggagaaagtattgactaagggattgtttgttgcagcttaagattattgtaatctagattattaaatcagattactctaaactggattataataagctaacataaaataagctacgagttgtttgtttctctggattattgaaggcatcttagggtagtgggtttttagccacccaataatctggaaaaagctcctccaaggagattattagattatagtaatctggcttatagattataataatctatcataataatctatttgtctgtttcagcttactcatagtaatccatattataataatcctaagctgaatcaaacagggcctaaatttcactttaggccattttcacccaattttaaattgccagccgcctctagctcaatcaagaacaagttgatcatcagttgacagttgtggtttgtgggtccgagagatattgtggttcgtcgtaattcgtcctccaactacgtgctaagccccacgtcgttgtcgttcacgttcccaagtactacttggttctcgagctcagccccaccgcaccatctaaagatcgagtttcgccccatcatcgattccctcgatttcccactagatcttgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgcgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaaatagcaatggctaaactttaatctaacaaaacccaagaaaccctgaaggggtacctaactatataaataggggtgggaggacgacctaggggtgcctagggtcgtgctccacctggctggggcgcaccccacatgggccccacctgggccggggtcccagacgaagttacaagcccataggcccattataggtgacgcagcaccttgttgcttcaattgcggctcaataagatggaatttcgcaatgaggctggatccattggaaagaggactccaagagctttccatcaagtactcacgggccgaaaacggaggtcgtatgcagattcggcagccgtttgaagtcagcagtgtagtaggtggccgaatcggattccagcacttggaggacttgatcttgatatcttcttgttcatccatgatgtgagcaatggttgcatctgtggtagccatggtcacatcatcctccccttcttcacggaaaaccgtcctcggtttttccatatggtgctctttgcgtagtccatttacaacaacctgtttcttccagtcaaaacaaggcaaactcgagacaatttggttagcaataacatttcgctctagcttgcatgttttatccacatgtataggaggttctaaatctgaacatatgtaaactctatgcaccaaatatattcctctatcatcagattcgccaaatatatgaaaaatagcagtagttggacaaggcaaatcagacttagcaaataatttcttcttcaaattatcgagctcacaaaaatcatcaaactgaacatagcccaaagtatttaaagaagatagcaattcacgttcctgtacttcattagcaatatgaacaacatgcttaaaatcagcacataaagaaacactagaaatagcatgttcattcactagttgtggaatggatataataagtgaagcattatcacacaactcttctttatcacaaagaacagcgagtaaatcaacttgtgacaaaggaattccagcagttggttccactaatggttgctctgctatagcataaaaagtggacgaattcaattcattaacaacacactcacctttattaatttcagcaccattaagtttacctttgatgccctcttcagataatggaggtgcctcgactttgagtgtgatcaatgggactggcggctctttcatgtctctctcctccttttcatgattatgcacttcctgcaaatggttagtaatagaagacaaaaacatagcatgttgcttcttcatgtcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatatctaaaatatcgtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagtttagctcaaacataacagtattttctcttttctttctttcttctttcttcttttcttttttttccttttcttttctgttttttttttgtgtggctttttttttctttttttttgcacctttctgcctttttttcacttttttcttgattttttttaacaaaaactgactcaaggaccttaatgtaagattacagggactcaaacataaatataaaatttacagggactcaaatgtaaaagtctaaacccaaaattaaaattatacaaaaaatggaatgctgaatttatgccggttccgtttttccaaacagatctcgaaaccgacaccaaacaaaaattcgccaaggtgtttgacacaactcggaacggtggaagagagggagggagtcggactcggccaaaggggcgagtgggactcggccaggaggtggagtggatggcagccgaatttggtgtatgggataaaaagggaactgatttttaaccaatccaatctactatatctttccaaaacaatcttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccgtggcagcgagccgattccgttttcgtaggtcccgacaacaacagagacacggtggcagcaacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccctacgagacgttgtgttgcgc

SEQ ID NO: 17592 - DNA, 11793 bp, Oryza sativa
ccccacatgggccccacctgggccggggtcccagacgaagttacaagcccataggcccattataggtgacgcatcaccttgttgcttcaattgcagctcaataagatggaatttcgcaatgaggctggatccattggaaagaggactccaagagctttccatcaagtactcacgggccgaaaacggaggtcgtatgcagattcggcagccgtttgaagtcagcagtgtagtaggtggccgaatcggattccagcacttggaggacttgatcttgatatcttcttgttcatccatgatgtgagcaatggttgcatctgtggtagccatggtcacatcagatctgaagttaatgagttgattgagcatatattactctttgggtttggaagtaatttgttgattaaatgcaccagatggatgtgttggatctgaagatactagttcatttgttcaaaccaatttattcagtttttttctatgatttgctcacatgaaggtcataattgaggatatttcactctatttttatcacctactcaaccaaaaattaatattttagtgaccattgtgtccgatagcaaatagccgcattttaagagtgtcttttcccaaagattgagttctgccatgtctagaaactaaatccacaaagtcaatatttattgtgacaaatttggccataacataaccatcatttagtaaagaacaagattgatgatccggctatcaaatgacgtggattaatatctaacaattaatacacccccaccttaaataaaaaaatattacacccacctctcgaatatcgggtcattttgattttgagatatgtatttccatgtctaaggttaagtattagctaagttgtggctagccatattttttttgcaaaattagattgtttgtttcgcaactaaggtgtgacaaaatcaatccgtttgttgtttggattgccacaaaaaatgtttggaagtaagttgtggtagttgtttgaattgctaccacacgttagtaaaaacatcttgataccatagtgccttctaacgaaacaatcacatttcatgtaacagaccaccatccagaaccgtgcagcccaacctacattggacgagcggacccacttacacataccaccccacttacatttttgttttcatttcgtgtaaaagggttaacccatgagtaatatggttggaggggctagcccttataagtaggctttgcccttgctaaactagtaatgtggttctaaacatgtacacacagctctcatgggtaacacatgtcagatcctaattgaaatatggtactaaagatatacacacaaatcatggataacacaggacaaatcctaattgggttagaatgtcacatcccccacccaaagaaaagacctgatgtctctatcagtccaacttacccgcatatctaaatgtccgagaacacaccccctcttagtgtacgtacaacacactcttcaaaaccgcgcagcccagcccatctgatgagcaggctcacttacaccttcgttcttgtttcatataaaaggattaacccgagagtgatatggttagagggacaagcccttgtaagtttgttcaactcttgctaagctagcaatataaacatgcgcacacatctttcatggtcgcacatgccaaatcctaattgagccaggatgtcacattccagcaacaagatacatatgtttgaataatattacaagcacaatagactttatattcattgaaatagtaccattccaaaaggttggagtctagtgcaagatattcaaatattagtttagtggaggaattacattatagtaacacccagtcaagttacaaaaccaacaaccatctaactacacgttttagtcgttctccacgactacacagccaaaatgagcatacaaccaactagaatatggtctagacatcattcatcaacccacatagcgaaaatgagcaaactactaaaaaatgttccccaaataatgactttcatatcttcaccaatttccaatggagaatcagtaataggatggctttctaaacgctatgtatttccttttgtttagttggtgagttttacaacgttttctcgtcatgtttctttattatgtacatttgcatttgattcagttaagaacattgtaataggtgactatagcttctattgaagtaaaggtcaaactgtccactatctaaaaggaaaaacatccactttcatgagctaaacttcacgggttagtacattctttctcataaaagaacataaattcccaagcactcagtgtatcaacactcacattacacattagccacacttaccgtttgttcttttcgaaaaacacactcactaaaaaaaggaccctttgatcaagtgtcactgtgattgcctctagtatgtgccacaaaattgcacaaggattagtaagctatgggagggaaggatgatcagtaacaaacatagaacttatgggagaagaaaataacaacggtgaaccctggacacaatatcgcgaaaaggtagcagccataaatataggtggaagagaatggcctttgcggtggtgaactcacatgttgagtgagtgatattgtggcagtgagatttatttggtagcattggcacatcatgagcaatatgcccgggaaaagcacgtcacactttttagctaatacgacctaatgccctgtttagttcccaaaacaaaaattttcacgctgtcaaatcgaatgtttggacacagacatgaagtattaaatataggaaaaaaaaccaattacacaaattgcgtgtaaattgcgagacgaatctttcaagcccaattgcgccatgatttgacaatgtggtgctatagtaaacatttgctaatgacggattaattaggcttaataaattcgtctcacagtttcctggcggaatatgtaatttgttttgttattagactatgtttaatatttcaaatgtgtgtccgtatatccgatgtgacaaccaaacccaattttttttcccaactaacaaggcccaagatcacccagatccagcgttggaaccaaagcagagccaccataggaaggtgtctgggctccactctccactgcatgcaactacttgtgtagtacttaatacttcatactccctctatcccataatataaggcatggtcaaaactgtcacgatctccaaaactagtctttagcttctaatttctcatatataaggtttgtagcaacaacattataatcatatgaaagtaaattaaaatctcaatctaatgatataatttttaacaaataaaatttatttcatattacactaagtgttggtcaaatgttttaaatgttgaatcttgaaatacatgtgcgccttatattatgggatggagggagtaattttttttacctcattagctaatcaagctcatatacaagttaactaagaccatactagcaagcaaactagcaaagcaattaagccttgctaaatcacatattcagatgtgttcgtaccaatagtaaataatttgtaaagttatactatgaattaggctaggcttagttagtttctgcatagggactgaggccttatttagatcccaaaaagttttggccaaaaacatcacatcaaatatttggacacatgcatgggacattaaatgtgggaaaaaaactaattacacagtttacatgtaaattgcaagacgaatcttttgagcataattacgctatgatttgacaatgtgatgctacagtaaatatttgctaatgacggattaattaggcttaataaattcgtctcgtagtttacatgcggaatctgtaatttgttttgttattagtttatatttaatactttaaatatgtatccgtatacttcaaaaactttacgcccaaagaactaaacacaccatgaacttttaagcggcacgaaaaccggaacaagcaattaacatatgactaattagttataattatcataactttgaaaaatgggtccatttgaatttttaaaggaacttttatataaaacttttttttaaaaaaatacatcgtttaacagttggggaacgtgctaatggaaaacaggaaagtcgaaatttagaggagtttagaacgggtcttactgcaagttttatagtaagagtagttgtcacatctaattttatccctataagataggaggtgatataaacaacacaccacatctacactacctccagcatactaacccaaataattttattttatttgtttgtctaatcccctctttctttcatctccttggggtttgtgtcattgtggggaggttgccccttgcatgaggggtgactcaccttctctttcttcacttattttttccacctcatatctaatcatatatagtatttttaggggcaacatattaagcattagagtacttgctcttaggctgtgttcgggaggtgaggttaagaacaaagcggcacattttcttatgattaattaagtaattactttttttaaaaaaatggattaatattattttttaaaacaagaaactttttgtaaaaaaaaattatttagcaatttaaaaaatatgtttgtggaatacgagagagatgagttggaaacccaaacggtcgaacacagccagtggaactggttatccattattaaggtttctcgagtttaagaaaaagaacattaggatccaccattgcccatgtcaaaatccaaaacaaaaagtgataccctttgacataacaaagttatgtgtttgtctggatatacttatactgtaaattaaactttcggctcaaaatctcatacgttgtatactacaaaacaaaatcattgacaaagcttaatgtaaatcgaaacaatcgtgtcctaaattactaacatcacagtttaactgagtgataaatagataatagtcaaagggaaaagggaaattatttgtatggatgagttaaatactactccctccatttctaaatatttgacacagttaaattttaagcacatgtttgactattcgtcttattaaaaacttctgtaaaatatgtaaaacaatatgtctacatataagtatatttaacaatgaattagataatagaaaaagaattaataattacttaaattttttaataagacaaacggtcaacatatttgaaaaagtcaacgatgtcaaatatttagtaacggagggaatattacttatgtataaaaagttttttaaaaatcacccttttgaaaacgcagcatgaataattcattacctgtttataatgtgtcctgactgactcgataacttatggtggtagcaagcacattccaatccgactagagttaaaagtgccgacgaaaacataatttggctgaaatcccttttcttatcccatccgtggccatctctgaaaaggaaaaggaaaaaaaaagaaaagaaaagggtattacttcaaatatactgtacaccggcgcttctcaccgacagatcgggcccagttatcaggtttgaatcaaaacgcttgagcggtggagccacagccgtacagccgtcggcggcggcggcggcggcgcgaccatctcctcgcggccagatgcgcgtgttccggcgccggagagcccaacgaatccgccgatgctaaagctccaagcttccctccctctcttccgcctccgtccccgccccagctcccctcctccctgcggcccccgtctccccttcgtcccgtaagcacacgctgatccccgattccaaaccccttccccccctttctactgttctaatggatcgtgacaccgacgagtcagaatttgcaagcggcggatgagcacccaggcgcagcccagtttcgcccctctccccacggcgcaatccgaatccgatgcaggttgtgttttttcttttcttggtcaatcttaagaagcgagtaatacgattttgattggtggttgattgctagtattacttgcaaatcgcgcaggcccagggtaatttgtattaaaactgttttagtgtttgggttacaggggcagctgggtaccagttccggctggtttcctacaacatcttggcccaggtaggctggcaatatgctgttttgttctgttgagctgcttatggttcggtattttctttggtgacgatgagtggattacagtattcacagaggaaagaaaactagctgcatctaactatttgatctgtgttgcaggtttatgtgaagagtgcgtttttcccgcattctccatctgcctgtctcaagtaagctcttgactgacaagcttcttcctagaattcttttgggtttcaatattttcttgcgaccactttagtgattctactaagcattagagcagtggcaacacactgcggtgaatgccaaataatttactatgaaagaaagacattacataaatactatgttttgtgtgcattgcacattggttcccaactagcagcaatgagcgcagccttagtagcattcaggttgtacgaatagatttatttgtcaacagtaagctttacgatatgatgtttgtacatttatattttcggacaaacttgagttccattctcagttctcaccatgagtagacccagcccaagaacaaagtataaaactatcaaaggattggtgcatcagtgtgctagtttcgttttgtgactgtaaacaattttccatttctgttctagtccctgctcttcaatcattcatttgtggactgtatgcttcccctcatgtttgagaaacaggtggaaaactcggtctaaagctgttctatcagaactcaagagcttcgaagctgacctcatgtgcatacaggttggacagacttatgactttttaagcaactcatttttttcatgtggtcatgtacttgtcattgataaatatagaatgtgaacgtttttaaatcatattatatccttatttggttctatatatggtttatgtaacattccccaagtttgtatttagtggattgaaaaataccctccaagaaaaaactgcaacattgattggatcctaggataaagggagcattaatcccaagttctcaacgtgacagattggaacctgatacacaaggttcctagtgccaaaacacaacacaatggtggatagtagaaagttttggctattactgtttctcaaaaaaattatgtagtcttcctccattatgcccaacacaaattaattagtgttctactcattcagaaataaatattgggagggttacatattacatatgattgtattgtttcaatatttagtcatgacctatattaatgtgtacttttgacccttttttttcttctttggaatatttttgtctgcttttttcgttctttggaacatttttgtctgcttatttttaatatgtggtttgctcaggagttggatgagtatgataccttctacaagaaaaacatggagaattctggatattcaagtatttacattcaacgatctggggacaaacgggatggatgtggcatattctataaaccaaaaaggtatccatattgtttcaaataagtgatgattaacaatgagaagacaagaatggaaattatagtatgcatgaatgtttcgattgacttgcaaattaacttctcaatatcccccttttgggctattcttacttttacagcatggaactggtccagaaggaagtactacattacaatgatttagtggaaaaatatgttcatactgatcatgtaaatagtgatacatcaaataattcttcaccaacagaaggtaatggatcagctgctcaacttgatattatcctgtgaatcataatgacttctttcattggaggcgacaaaaggtaaagtagtgagccaggctaaacaaactacttacaagttacaacatacaaactattctgtcatatcttgaaaacaaagaaagtagacaaatattcaaactccacatccaaactcatgaagtacaaattctttgggcctccactattatgattctacctttggacctttatcattaatcatattctagctaggacatagatttgtccaattgcattccgtacttattttatgtctgctgtatctgtggctagtatgatgctctacctaagttaattgggttaattcagtattatgctctttcagaagcaagcaagaaggtggataataacaagcatggagatccaaatgatccacgtttcagattgaaacgtgactgtgttggtttacttgccgctttcaagcttaatgatccttgtgatcatattttaattatggcgaacacacatatttattggcaagtaaaatggccagagttctctattattctcgttttgaagatgttttttaagccatctgtctgttttattttgtatatctgtattggatcccctgttcatactattctgattttgtagggatcctgaatggattgatgtaaaattggctcaagcaaagtatattctttcaagagttactcagtttgagaaacttatctcgaataaatttaactgtaaaccttcagtcatgattgctggtgacttcaactcaactcctggtgacaaggtatggtctgcgtctgctacattttgttctttcaagcttaacagacttccgaaaccatcacatggtgttttgtgtttacaaatggctatgaacatggtgtttttttgaactttactctcagtacaatattctggatagacgtaggctgatgtcaatatcaaatactgtgaacttgtatgcaaacgactcatcaaaccatagtgggtgatgtaacttccgatatgcacattctgcattcttctaggttcatgctttactgaacgatattcaaaacttcaggccctccaattaggaaaaatattacctgaccttaattcccagctccgccgaaatttcttggttgttccacctctataatatgtcactaatcatttgcaggtatacaactacctcgtatcagccaactccgattctacggacgaagctccgatcaaattacgcagcctttatgctgcgaatggaggggagccagagttcaccaactgcactcctggttttacaggaacactggactacatattcttgtcggacggcagttcagtaaaacctaccagtctacttcgtataccacgaggggattctgccgaagtccaaggagggctacccaactttcaccatcctagcgatcatttgccaatcggtgccgattttcaggtactcggcagcgaaggctgattgcattttgcacggcagcaacaaatgtcccctgggatcgttccccgtgatttgtttggatttattgtagaaacagtagcaaatttattaatatcaaccagaatttttgttacatggtctacacattggagggtatttgttattattatctttaaagtttcactaccaggatttcataggactaaagtttgtagctagaccttaagttccttatggagttatggtagtgaagggctcagatagcagaccagatggaggatggatcttgcaccatatcatttcttctggcaacactcgtcaacttgggaatcataaagaaatgtgctaattttagttagtcgtgtggacacaaaggtaggagccaataacacttttaagatgcacaaaacatttatattgtttcatctacaaaaaacagattagcatacacaaaaagaatactagttacatgaaacaagacttgatctatagaagaatggtaacacaaatataggtacaaatatgccatctacactgaacatgattctcgacaaacactgaaaacctctcgaggaacctagtcttttaaattgtgtccaccagctatgttctgattatgaaaccgaactatcggcaaatccatatgatcccaaagatgactgtaaagtataacgagcaccagtacaacctcatcgaatcctataggtgaattctattcttctttcttctccttttctctcctctcttttatcaatgaggagaaaaagagtggtagcattgtgcatgcagcctcaatcaacagacaagtcggcagcgctgagaaatcacctccagatactcccatgaattcagcaagtgcaaccccaagataaccgctgatgatagttgcgagggcaagtgcagacatgacaaaagccataagtgatccctcacacccagaagggcaaagttttgcaacaagaacactgaagggcagcaccttgaacaacataagaccctccaacaaccctgagaaaacaattgtgtacatggaatccggtattccgaagtttctgtatattccctgaacaaatagtacatctgacagcattacgagtgctgtaagaaactgcagaactgataaaaccttctgtgcaggtgttgttttgaagtacttgttgtatgccacactccaagctaatagagttacttgtccaaaaaccttggacaaaccgataactgatgagtcaagtcttaacacttcagtctgatagaagaacatggtcccaagtagaaatggtatggcagcataggacaatgaaaaccaaatgactgaccaaaatatttcaggcatacacagcgcatatgacagctctttgatttgcttacggacgctggagacagctgatagattagtatctgcctttgggagttggagggagctttcaggtatagccacagtagtgcagaactggagcacgagaaggattgcaaaaaacagaaacatgatttttggagaaaagtaactgagtgcaatgccaccaacaagatttcctaaagcgccagcagatgaaccaaacatccaagcaaaggattgaagctgacctgaccctgaggacaaggttgcttgcttcccagcttctgctacaatggcatcattggcaacctcacatatggatgcaccaaagttgctcaagaggagaaaaatggtaagaactggaagagaaatagctggccagagggcaattgctaaccatgaaattgcctgcaagagagctgcacagatagcaataacaagtcaggttagtatcatagtctaatacaagcgcaaaagaagaaaaaggcattgcaatgcacagtaagcatatcccaattttgtatacttcattttgtaaattatagcaacgtccttaggcatatgatcttgtcaattatgtccatccctatttggttcagtcatttacattcaactgttcattgcttaacatgccacttaggtccctgaacttccatagcgggcctatccttatgtcatatttccggttagcaaacttcttaacgcaagctagagtttaaaggcctcactgaggttaaactaacttgatggcattcaaaaagtttgtgataaaaacacagaatttgcacatataaaatcccaagttatgtgatgttggagtgagatggttcactatccattcatccttgaagaatttcatcatgacattcctctgtgcttgtttttcaacacagctttaattaaagtggaccgaaagggccacacccaaagtcctaaagtagatgaaatattcatgccgtgcgtgagctggttggcaagggattacttgcttgttgctttgcgaatgtgtgatactaacaggaggacaaatttggtggagcattagataaaagttgttgctgtcaaaggttaatacgggaaaagatgactgacagatactacaaattatgcacaaaaatgaaaagtaaaccgaaacaaagggaaagggtgagaagaatcaagaggacaaagtccgtgagcatcagagcatatcctttgcggcgatgccattgtcgccagctgccacaggattaggtgatgcgcct

SEQ ID NO: 17593 - DNA, 1829 bp, Oryza sativa
aagttgagatgtgagaggaattctggatctgggacgggaaattcagggggggaagggaggagaggaacgagtgggagtgggagtgggagcatatacataccgccgatggcgacgtaggggaggcggcggtggccgcggatggggacggcgtcggagaggaggccgagaagcggcttggcgaccatggggaggttggcggacgcctggaggatctgcagcgaggaggcggcgacgcccatgccgtccttgaggaagaagttgacgcccagccatgggaacagccggaacccctgcacccagaaccccaccgcgatcacccaccgccgcgtcgcctccaccctcctctccccctccatcttcctctccttctccatcactcctcactcactcacccacccacaccacctccgccgccgccgccgccgccgccgccgccgcccaaatcttctgatccgccgcctcttcctccccctctcccgctccccgatccaagaagagagtggggcgccgagccggtgatccgttcttgatcagggagggggacacgtaggaagggggacgagagggcgcgggggtgtgaagtgttaactggccggattgttttagtgggcacagcgcgacgcgaaggcgatggaacgaggcgggggcacacgcggcgacagctcggcgtgcgggtaggcgcgtggtggagatgggaggagaagaggagctcgtcggcgcgggctggcctaagccatgggcggatgtgactgggctttttggtcaggtgcggtgtcgtgctggtgctggccacatcaccacatcggtggtcggccatctgggctgggttttcagtgggcccaccgctttgtccaataattcaattgggccaaggctgtcagagaggccgactaataaattctgttcgaaattgagcctaatttatatcttttgaatttaggcccaacttatatttctttggaatgaataagcccaactaatcaataatattattttcgtggaataagtccactttgtctcccctaaaagtgacctaaatctaatccatgatcataaatcgcaaaaccggatatctcggcccccgaactattaaaaccggtgtaatttgactccctttgtggttttgagggcggtttcgctgacgtggtgcttaggtggcatttgaattaaaaacgtatatgtgggacccgtttgtcattcacacacataaaaaaattgtggggccacccacatgtcctgctctctctttcttcttcctcccctcttcctcccttctctctttctttctctttctcttctccccccttcggtcggccacggggagcacgggctggagtggcagtggcgggggctagagtggtggtggccggcgagagctgaagcgacggtagcggcggaactgtagcagcttgctctggctgacaaccaattgaccgacaggattccgccgaagatggtagagatagggaggaaccctgctccgactttcgagaagaaccggagggatgttagcgtgctcgcacgcctcccccgcgcaccccgccgctgaagggggtagcttccacgccacacactccagcgccctccccctagccctcccgcctgtcaccgccgccgccgcttcggctcccacccactgtcgccgtccctgcccgtcgattgctccacgagagagaaggtgaagagaaaagggggagacatcagctaagataccgattccacaaaatcccccttggccgtgacccgttcaaggattcatagcttctcttacgcgtcgtcttgctgtcagtccagcgccggtgaagggtacatgacttacagtcatggcg

SEQ ID NO: 17594 - DNA, 2925 bp, Oryza sativa
  unsure (1)..(2925): unsure at all n locations
gatggaacagcgccggcggcgttgatgttggggtactaccacgactcgccggagctagtcgtcgtcggctcaggttgctcgaggctcgtggagacgaactcgttcattgtgcaggacatcaaggtgatcatcctcccgtagctcggttctgcacgagctcagtcgaagagtgttttaatgtgtgcactcgctcttgcaggcgaggacggatggagggtcgccggagaatgggttggtgctctacgggatgccggtcgctccgcctctcggcatcccagccgcttggtcggaggctcgccgcgccgtcgtaccagccgattcccacatgtcattttttttgtttgaatcacatatgggttccacaaataattttttttaattctaagccacgtaagcgccacgtgggacgaagactatgtcaacattgccacgtcagcgccacatcagcaaaatcgccttccaaaaccacgaagggaatcaaattgcactggttttaatagttcggagagtcaccctatctgattttacggttgagggttatggattagattcgagtcacttataaggaagttaaagttgacctattcctatggtgcttgaaacctagcaaaagaaaaaaaaagtgtgatatctaatcgacggctgattgctcgatcggacggtggagaatacgtctcgtgggtggagtcggctagggcgcagcgttcgcagttggaatcctccacccaaagcagaagcctccgccgccgcagcgccgctactcttgcatcgcctccgccgtagccgcgcgcgcccttcccgtcgccgcttccacctcgatctccgccggagagggcgtccgccgccatgtctcagaacaacccctcccagctcctcccctcaggtgcgcggaagaagcttcgctttagtttcttataaatctcgcatcctagcttgctaactttgttccagatagattttgttttttggggttcgagttcttgattcagttcttgcgggctttggtttgtgcagagctgattgaccgctgcatcgggtccaagatttgggtgattatgaagggtgacaaggagctcgtcggcactctctgtgggttcgatgtgtacgtcaacatggtgctcgaggacgttactgagtagtatgtgaaaaatcttccaattctcaaccctatttatttttctactttccgcgccaggtttttttcttgtagggtaattttggtgtcacagtcgtagggtaatttcggtttcttctgattagattcttagattagtttagctcagtttctcacatttgtgtctcagtgtgctgatattggaattagctaaaatatttagaaaacattgtttgattttctgagaactgaagtacagaaatattgcccaccttatgccagattgctcctaccttgttgctttgttggttactttcctccatgtcatcaggcagatttcgtataacatgagtttgtattatactaccaatcatcatagttggtatagtgcaagctatttttgatcctttcagtactcatgtcatgattgttaacccattgtgtgcttcaatttaactcacacagacttggtttcatgaagttacataattataacatttgctgctcttatcagtaattcagtatacttaatataactgaagattttatttgttgtttagtacttaaggtgtaacgcaatcactagtctgtctgttctaagatcaactgatatgaacgcttgattccaaagaagctgcagcagtggaacacactgttttgtaggatttctgctgcagtaacatgttcatcgttgtagttagtattgtcttgtttgggaatattatttctcgcggaagggaagacaagctcttttcatcatgatttatatggttatttatttgtggtataggacagaatgatagttgatagctaggagggaattggtcatgtaaaaatgactaaagatatttagcagatggtggcagtaggtttccatgagtgttatactgatgcatcatgtattttgtgctagctcttcacaattgttgcattaagtttatactagtcctcccaggtgttgatgtattactttgttttccccgatattacaatgttctattatacctgaattagttctagaaatattcatattcagtatcttagtagtttgtagaatgcacatgtggatgttgtaactatgttcttaaaaagagaggtatttcctaacaacaaaaaatatcacaaacatatactgcaacataatgatggttgttgagccatcttgcagaaggggctgaagtgagcgtgttttagagtttgtgtcatctgattatataccatgactgaaatctatatgatctgttgatgtgcaatgtttcactagtcccctaataaaatgctggacctaatggtggaatttattcctattagctgaatatgaagttaccaccatcacccttgccaaactaatgtatcatctaggaaatcacttagcaaaaccatactgatgtttattagtttttttcacttgcacatttagcatatgtatatgttcaatatgaaattatagtctaatgtttgttgtttcatgatcctctgattgttttatagtgaatacactgctgaaggccgtcgcataacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17595 - DNA, 630 bp, Oryza sativa
ggcctccgccgtcgcctccgagcccctttaaaaggatccccgtgctcttctcttctcgccgtgtcgcgtcccaaatcgactctaaaatctatcctcgaaattgtgcaaagaataattaaaattccatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaataaacaaagttgaaaaggtttaaaaaaaaaagaaaatcctaaaagaagttctttttccccccccccttccctcttgggccggctcggcccacttctccctccctctctctctctcctcccccgcggcccatcggcctccccgcgcgcgcgcgcgccgctgacaggcgggcccgcccgccactctcgctgacgggtgggacccacctgtcatcgccttcctcccgccgcgcccgtgccctagcgccgccgccgccgcggattgtgccgcatcccgccgtccccgcgcgcattaaagagaggggaatcactccccgtgattccctctcccgtttcccccgttttcccctctctctctccctcgg

SEQ ID NO: 17596 - DNA, 4043 bp, Oryza sativa
tgtactcccttgcaattattctgcatttgtgggtgtgtcttgttgagtacggtggttgtactcagtcttgctcaattttttccccaagcccagatgaggagttccttgaagatgaaggctttggtgtctagctcgtgcctgccgtcaagcgcctgtggtcgtcgccctagtcttccgctgtttctcgttgtctttgagtgtgctgggccttcgttgcccgtgtaataattttatttacgcttccgcttgttaaactctgaattgtatcaacttttggtgtaccttgcctcctgggacaaggaataatacacgcacgtcaggaatgcctgttgggtgatttccggtcgtgacaagttggtatcagagcctcccttgaccctaggacgagccgtagatcccaagccttagctatattttcaaaaataaaaatcctctgttatttgtgaaaacccgctattctctctttgtcttgctgcttcacttatcatcaaaatctgatcttttaaatgttgcttttcttttgtttttgtttgtagatggccggcagcgttacccgtcgtggtttgcacatgactggcttcgtcttggagctgcgaggcatgtgcgtggtcttggggtatccacatggagtggattaccaggccaggccgctcccggatcaggagggtgaggatgcagagcctcacgctggttgggaggtcactgcagtgatcctctccggctctcccgagcggacttcgctggcagtcaccgcgggtggagattccttccccgccgcttgccagaacgccgctctcctcgccatcggcacccttcaccagcgctacccggacgagttgcagcactcgccctaccgctaccacccccgtcgcggaggagccagcgaccacgccaccttccgagacgccagctcggaggatgacgctaccgtcgtgcatctggcacgcatggtggaggcgtacgacgcggctcgtatcgacttccaccagatggtgcgtcgtggcatggtggagaacaacctgaagatcctggagctgcgtcaggagaacctgcagctcaagaaggacctcgacgcgttggaggcgcagctgcatcagctcaagatcgcccagggagagatcagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagttgtgtggggcatggttacaccggtgtgtggtgtaactatgtcggagcctgtcttattttatttgcctaagcaacttgaacattaatgaaccaatttaatagcagtaataaattcaagaattatggtagtcgtgggtggttagttttaattgttagctccttctctgtttgctggttctgtgtggggtttttcagatggtgacgaccaggagaaatgctgctaccggtgatggcaaccaacccgaaggcagcaaccacaaccaccagggcaacccacctccacctccacctccgcctccaccaccaccgccagacaccaacgccattctcacccaaatcctcgcccagcaagccaacatgatgaccgctttcctccaccacctccaaaacccgccacaacagaatgctccaccaccacctccccaacactctaaactcgccgagttcctccgcatccgtccacccaccttctctagctccaacaaccccgtggatgctttggattggttgcatgccgtgggaaagaagctagacacggtgcagtgcagcgacgaagagaaagtcatcttcgccgcccaccagctgcagggacccgcatctctctggtgggaccacttccaggctacgcagccagaggggcagccgattacttgggctcgcttcaccgccgctttccggagaacccatgtgcccgccggagtcgtggctcttaagaagagggagttccgggagttgaagcaaggcaaccgctccgtgatggagtatttgcatgagttcaacaatctggcccggtacgctccggaggatgtgcgggcagacgaggagaagcaggagaagttcttggcaggaatggaccctgagctgtccgttcgtctagtctctggggactatcctgatttccaacgtctggtggataagagcatccgcttggaagccaagcacaaggagctggaatcgcacaagcgccgcttggcgaacttccgcaatcaacagggtgctaaccagagggtccgctacaccaatccctacccagggggatcctcctcgcagcagcagcagcagcagcagcaacctcgctccgcgcctcgaccacaattcgtggtgcgcgtcccacagccgcagcagcagcagaatcaacaagggactcgtgcgccccgtcctcctacgccagctgtgcagcccgctcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtcattcggggccgtgtgaatcacgtgacggccgaggacgtgctgacaactcccgacgtcatcgttggtacgttcctcgttcattccatccctgctacaattttgtttgactctggagcttcccactcatttatatctgtgtcattcgtggggagaaatcagttgggggtagaaaggcttagaaaccctctgctcatcaccacccctggaggggttatgacagcaaagtattatagccctgccgtccctatagaaattcaagggattccttttccctcggatctgattctgctagacaccagaatttggatgtgatttcttggtgatcgaattggtgtggcgtcaatctccaaggtagtagatggattggcgcgcagacgctactgtcacctctgtgaccgagcgacctagaacagaccggtctgtttttctttgcacctccaacctctgtcagaagttcagaactgcatcagataggtctgtcagaaatccccgtagtcagagagttcggagacgtgtttccggaagaactacctggtatgccgcccaagcgagagattgagttccggatagatcttgctccagaaccactcctctgtacaagcgaccctaccgtatggcagcaaacgaactggccgaagtaaagaaacagttggaagagttgaaagaaaaggggtatatacgtccgagtacttccccgtggggtgctcctgtgatttttgtagagaagaaagacaagacgaagaggatgtgcgtcgactacagagctctcaatgaagtcaccatcaaaaacaagtaccctcttccccggatcgatgatctgttcgatcagcttaaaggtgccactgtattctccaagattgatcttcgttccggatatcaccaattacgtattcgtgaagaagatattccgaagaccgcattcactacgcgatatggactgtatgaattcacggtgatgtcgttcggtttgaccaatgcgcctgccttcttcatgaacttgatgaacaaagtgttcatggaatacttggataagttcgttgtggttttcatcgatgacattctgatatactcacaatcagaggaagaccatcagcgccatctccgtctggtgttgggaaagttgcgggaacatcaattgtatgccaagctcagcaagtgtgagttctggttgtccgaagtcaaattcttggggcacgtgatatctgctaaaggagttgctgtggaccccgaaacagtgaccgccgtcaccgattggaagcaacccaagacagttactcaagtccgcagtttcttaggtttggcaggatattcccggagat

SEQ ID NO: 17597 - DNA, 7128 bp, Oryza sativa
tggttttcaactatagactttgggaaatattcatatcacctggatactctggaatgttggtttattgtggaattggcttcacaccgccccctctattcaaaatcccctaaattggttttaggctgggctcggggtgcatggttttgatagtagcacctcggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcatatggcagagggttggtgccctgctgctaggggctcagtcctgcctgcctgtcccgggggttccggccgtaggcaggattgggtcggtactcttgtctaaggctaggatgggttggaaactatgtcacgtctttcgtctgtataccgtggtggtatgtggcacgtggttacccgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatatggaatggttggcctgggttggcttaggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaacccctttatggtataattcccttgtactcccttgcatttattctgcatttgtgggtgtgtcttgttgagtacggtggttgtactcagtcttgctcaattttccccaagcccagatgaggagttcctggaagatgaaggctttggtgtctagctcgtgcctgccgtcaagcgcctgtggtcgtcgccctagtcttccgctgtttctcgtttgtctttgtgtgttgggcctccgctgcccgtgtaataattttatatacgcttccgcttgttaaactctgaattgtatcaacttttggtgtaccttgcctcctgggacaaggaataatgcacgcacgtcaggaacgcctgttgggtgttttccggtcgtgacaagttggtatcagagcctcctttgaccctaggacgagccgtagatcccaagccttagcaatattttcaaaaataaaaatcctttgttacttgtgaaaattgtctagtctctctctgtcttgctgcttcatttatcgtcaaaatctgatcttttaaatgttgtttctctttttgtttttgtttgtagatggccggcagcgttacccgtcgtggtttggacatgactggcttcgtcttggagctgcgaggcatgtgcgtggtcttggggtatccacacggagtggactaccaggccaggccgcttccgaagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggaggatgacgccaccgtcgtgcatctggcacgcatggtggaggcgtacgacgcggctcgtatcgacttccaccagatggtgcgtcgtggcatggtggagaacaacctgaagatcctggagctgcgtcaggagaacctgcagctcaagaaggacctcgacgcgttggaggcgcagctgcatcagctcaagatcgcccagggagagatcagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtcttcttgagttgtgtggggcatggttacaccggtgtgtggtgtaactatgtcggagcctgtcttattttatttgcctaagcaacttgaaccttaatgaaccaatttaatagcagtgataaatttaagaataatagtagtcgtgggtggttagtttaatcgtcagctcttcttctctgtttgctggttctatgtggggttttcagatggtgacgaccaggagaaatgttaacaccggtgaaggcaaccaacccgagggcagcaaccccaaccaccaaggcaatccacctccaccaccaccacctgacaccaacgccattctcacccagatcctcgcccaacaagccaatatgatgaatgctttcctccaccacctccaaaatccaccacaacagaatgctccaccaccacccccacaacactctaaactcgccgaattcctccgcatccgcccacccaccttctctagctccaacaatcccgtagatgcgttggattggttgcatgccgtggggaagaagctagacacggtgcagtgcagtgacgaagagaaagtcatcttcgccgcccaccagctgcaagggcccgcatctctatggtgggaccatttccaggctacgcagccagagggacagccgattacttgggctcgcttcaccgccgctttccggagaacccatgtgcccgccggagtcgtggctctcaagaaaagggaatttcgagagttgaagcaaggcaaccgctccgtgatggagtatttgcatgagttcaacaatctggcccggtacgctccggaggatgtgcgggaagacgaggagaagcaggagaagttcttggcaggaatggaccctgagctgtccgtccgcttagtctctggggactatccggattttcaacgactggtggacaagagcatccgcttggaagccaagcacaaggagctggaatcgcacaagcgccgcttggcgaacttccgtaatcagcagggtgctaaccagagggtccgctacaccaatccctacccagggggatcctcctcgcaacagcagcagcagcagcaacctcgttccgcgcctcgacctcaattcgtggtgcgcgtcccacagccgcagcagcaacagaatcagcaagggacccgtgcaccccgtcctcctacgccaactgtgcagcccgttcaaggccgcagggacgctcaaggtcagcagcgtctgtgcttcaactgcttcgagcccgggcactttgcggataaatgcccaaagccaaggcgtcagcaaggccaagcgcctccccgctccaacaacggtggcaaggacgtcatccgtggtcgtgtgaatcacgtgacggccgaggacgtgctgacaaccccagacgtcatcgttggtacgttcctcgttcattccatccccgctacaattttgtttgactctggagcttcccactcgtttatatctgtgccattcgtggggagaaatcagttgggggtagaaaggcttagaaaccctctgctcatcaccacccctggcggggttatgacagcaaagtattatagccctgccgttcctatagaaattcagggaattccttttccctcggatctgattctgctagacaccaagaacttggatgtgattcttgggatgaattggttggctcaattccaaggagtagtggattgcgcgagacgcactgtcactctgtaccgaggaccagaacagccggttgttttctttgcacctccaacctctgtcagaagttcagaactgcatcagataggtctgtcagaaatccccatagtcagagagttcggagacgtgtttccggaagaactacctggtatgccgcccaagcgagagattgagttccgaatagatcttgctccaggaaccactcctctgcacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcagcttaaaggtgccactgtattctccaagattgatcttcgttccggatatcaccaattacgtattcgggaagaagatattccgaagaccgcattcaccacgcgatacgggctgtatgaattcacggtgatgtcgttcggcttgaccaatgctcctgccttcttcatgaacttaatgaacaaagtgttcatggaatacttggacaagtttgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttagggcacgtgatatctgctaaaggagttgctgtggaccccgaaacagtgaccgccgtcaccgattggaagcaacccaagacagtcactcaagtccgcagtttcttaggtttggcaggatactaccggagattcatcgagaacttctccaagatcgctcgacccatgacgcagttgttgaagaaagaagagaaatttgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcctcacgccagctacgacctcatgaaggcaactaccctacacatgacttggagttagcagcggtggttcatgctctaaaaatctggcggcactatctcattgggaaccgctgtgaaatatatactgatcacaagagcttgaaatacatcttcactcagtcggacctgaatcttcggcaaaggagatggttagaactcatcaaagactatgatgtgggaattcactatcatcctggtaaggctaacgtggttgccgacgctctaagtcggaagagccattgcaatactcttaacgtccgtagcattccgcccgagcttaatcaacagatggaagccctgaacctaagcatagttggtcgcggattcttggctgcgttggaagccaagcctaccttgctcgatcaaatccgcgaggctcagaggaacgatcctgacatgcatggactcctcaagaatatgaaacagggtaaagccgctggtttcacagaggatgaacacggaactctatggaacggaaagcgggtgtgcgttcccgataacagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaaggcagaacaccaacgaccggccggacttctccaacctctccaagtgccagaatggaagtgggatgaaattgggatggatttcatcaccggacttccaaaaacccaaggtggatatgattctatatgggtaattgtggatcgactaacaaaggtagctcgatttattcctgtgaagaccacttatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcagatcctagaagatatgctccgcgcatgtgtactagatttcgggaagacctgggataagagtctcccctatgccgagttctcctacaataacagctatcaagccagcatacaaatggcaccatatgaagcgtcgtacgggcgcaaatgccggacaccgctattgtgggaccaagttggagaaagccaagtgttcgggactgatatcctgagagaagctgaagctaaagtcagaatcattcgggataatctaaaggtggcacagtctcggtagaaaagttatgcagataaccgtcgccgtgatctggaattcgcagtggatgactttgtgtatcttcgggtcacgccattgcgaggtgtgcacaggtttcagacaaaagggaagctcgcacctcggtatgtgggtcccttccgtatcatcgctcgacgcggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaggccagtgaaaatcctggacaccatggagcgcaggaccaggaaccgagtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaatctatcctcgaaattgtgcaaagaataattaaagttccatgtgaaagcctgggggatccactaggctagatcaacaccccgcggtgg

SEQ ID NO: 17598 - DNA, 2174 bp, Oryza sativa
tgctcatgcaggacggccatgtggtagcctatgcctcacgccagctacgacctcatgaaggcaactaccctacacatgacttggagttagcagcggtggttcatgctctaaaaatctggcggcactatctcattgggaaccgctgtgaaatatatactgatcataagagtttgaaatacatcttcactcagtcagatctgaaccttcggcaaaggagatggttagaactcatcaaggattatgatgtgggaatacactatcatcctggtaaggccaacgtggttgccgacgctctaagtcggaagagccactgcaacactctcaacgtccgtagcattccgcccgagcttagtcaacagatggaagccctgaacctaaacatagttggtcgcggattcttggctgcgttagaagcaaagcccaccttgctcgatcaaatccgcgaggctcagaagaatgatccggacatgcatggactcctcaagaatatgaaacagggtaaagccgctggtttcacagaggatgaacacggaaccttatggaacggaaagcgggtatgcgttccagatagcagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaaggcagaacaccaacgaccggccggacttctccaacctctccaagtaccggaatggaaatgggatgaaattgggatggatttcatcaccggacttccaaaaacccaaggtggatatgattctatatgggtaatagtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcatatcacccgcagacagatggacagaccgagcgtctaaatcagatcctagaagatatgcttcgcgtatgtgtcctagatttcgggaagacttgggataagagtctcccctatgccgagttttcctacaataacagctaccaagccagcatacaaatggcaccctatgaagcgttgtacgggcgcaaatgccggacaccgctattgtgggaccaagttggagaaagccaagtgttcgggactgatatcctgagagaagccgaagctaaagtcagaatcattcgggataatctaaaggtggcacagtctcggcagaaaagttatgcagataaccgtcgtcgtgatctggaattcgcagtggatgattttgtgtaccttcgggtcacgccattgcgaggtgtacacaggtttcagacaaaagggaagctcgcacctcggtatgtgggtcccttccgtatcatcgctcgacgcggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaggccagtgaaaatcctggacaccatggagcgcaggaccaggaaccgagtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaatctatcctcgaaattgtgcaaagaataattaaaattccatgtgaaagcctccaacaattaaaatgtgcaaagataaaagtcaaatgaggcttggaggatttttgtatatttcctaaaagcctaaaatgcttaaacaaattttagtggaattttcagaggacaaataataattgaaaagaaataaacaaagttgaaaaggtttaaaaaaaaagaaaatcctaaaagaagttctttttcccccccccccctc

SEQ ID NO: 17599 - DNA, 741 bp, Oryza sativa
caaatatctcttttctcaatttttcattgtcatattattacttgataaaaccatgaggtacaaactccccctcaaaccatgccaaaaggatgaattattcccaattcatcacgaagaaaagcaaaacgatttaaatccaaaggtttagtgaaaatatcagcaagttgcaactttatgtccaaaaattgcaattcaacatctcccttctcaacatgatccctcaaaaagtgaaagcgaatatcaatgcgctatgtgcgtgagtgtcgaacaggattcttagcaatgttaatagcactagtattatcacaaaagagaggcactttctcaagagtaagaccataatctttcaaagtagataaaagccaaataatctgtgaacaacaactagcagcaacaatatattcagattcagcagttgattgagcaacactagattgtttcctagaagaccatgcaatcaatgatgtaccaagaaaatgacatgttctactagtacttttcctatcaattctacaaccaccaaaatcagcatcggaatatccacttaagcatatagaagatgaagtagaataccaaattccaaattccaaactcaagtgtatgattcaaatacctcattatacgcttgaccgcttgacgatgtgaagcacgaggagaagcttgaaagcgtgcacacaaacacacagcaaattgtatgtctggcctagaagcagatagcatacaacaaagatccaatcatac

SEQ ID NO: 17600 - DNA, 1249 bp, Oryza sativa
tccttctgatgctgtttgaagcgaatacggtcttctgcttggtatcgccctcctgaggttgattgccctttgctcggcctggagtaggtcggggagagacacaacttcttccatcgacgacaattctttgctaaggccgtcggtgcagagaatggttggtgctgaaggtattattgctatgtccatcgacccccgacttcatccatctccaatccgtgtacttttgtttatgactagactgagccacaaactaagccttacccactagacatgtggaagtacggtagtgctttgcaacagaggcccgaagaccggtccttaaacggccgaggtgctactatcaaaaccatgcaccccgagcccagcctaaaaccaatttaggggattttgaatagagggggcggtgtgaagccaattccacaataaaccaacaattccagagtatccaggtgatatgaatatttcccaaagtctatagttgtaaaaccacctaaggttacctaattagattgcgaagcatctacctaaaattgtactagggataccatgagtagagtgtccactagttgaggttttgtttgtctagggtgaacaaggtagtaataataacaataacaataataatatggtcataacaaaggtaaataggcatggctaagtaaaacagtgataacgcgggaatttaaataaagcgataatgcaataatttaaatcaacataattttataaaatgggattcaatatgatcaagatgatgtgtcttgccttgctcgttttcccaatcgacggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaattaaaaatcccatttattgcgtcagccgagggaggggacgcgcggaccgggtccatgggggtgggggcccacgcgtcagccgctcggtccacggtggaccgggcgcacgcggctggcggcggtcggcgccgtgggtcccgcgcgtcagcctcacccgcgggcgcgggcggctggcggccgggcccacttggcagccgcgagggcgcgc

SEQ ID NO: 17601 - DNA, 8327 bp, Oryza sativa
caaagtatttaatgaaattttatctggcccaattttatattggaatttattaattaaacttagatcttctcttcaagacttttaaaattatttctagaaattccaattaaacaacaatttatatattttgaattttcagggtgtgacagtcgccttcaaacttaaaatctgagaaacttcttgtgtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgccaagagacatgtggattcgccggggtggtgtcggggaggacctctgggcttcctggcacagtatggtctgggacctaatctggtgttggtctaggacccctctcgttggcatatggtgaacctgtgttggctttcgaaatgccttgtcatgaaagccttaaggtctctagtcgtggccgttctgcacgggctggatgatccgggttagtaatgtcgtgtgggtaaagtgtacccccctctgcagaggttattaaaactgttcgaatagccgtgcccacggtcatgggcggatgtgaggtgattcctagcgtagtttttgtttgactactgccttgtgaaatttgctgttgtggaatgggtttgatgtttggaaaatctgcggctgatgggatcagccaggcctgggtggccgtttgaaagctgttggccgggtgccaatcttgatcaattcaaaagattgaatcattgcacatactccgaccggacgagacgcactgtctcatccgtgtcgtttgagaagcactcccttagttgtttcagaaaagagtttaaataaaatcaatcgcaaaaacaacggtctttctttgaagcttgcattaaacacttatttcccatggcttgctgagtactcctgtactcacccttgctctatataaataatccccccccagttgctgaagaagatgaagcggatcccgctgacgaggagttcttccaggagcaaaccggctacgatgagttttagggtttcggcctagttcccaagtcgcgcctgtgatgtttggtccaagtcttggcttccgcttcccttttgtaatgcagttgtgagctcgagatctgtccgcagcccaacatgactgtactcctactctataataaagagacctctgttgctgtgatattccgtcttcctgtgataccagcactgtttcctgggactggtatcggttaacaggttaatttggagcgtcacgggctagttccgctcgggactagttcggggcgtgacaagagatggtatcagagcacaggcttggccctagggcgaaacccaacgtttaggacgaccctaaggatactaagttcaaaactacttgcgaaaagctaaggcttcttttggtttccttattttcaatagtttgttgctaaaatggttactgatcttctctccctctttcaaaattgtagatggcagtgaacgccagcttcagttcccacggttttggtgagggtcaccacgtcgctcagcttcgtgacctcgcccgcttccttggcttctcgtgtcccgagtacacggggtactccgtggaccgtgttccccctcgctgtgagctctctgtgtacctttatcctcgtggaggtatacacggagctggcctttgcccacaccacttcactgtggccaggcccaccctccagatcgtgtaccaggacctctcctggactgcgctacgtcgcttggcccacgactacagccaccgtctcgggggctctgccttccggcagtttccacgccttccttctggccacgcagatgctaggtacccttgtccgtacagcgagtctcagccagtgctgactcgcatggttgagctttcggaggctcaggccactcagcacgacctactccttgaggcttaccgctcccttgcccgccgctacaccgctctggaggcccgttaggccgaggagggtgtcacctcagttgacactgtctcttgggactcaggctgcctctgccacgccagccacttgtcctcccacagctctcgcggctcagctcgcactcctagtggcgcgcgctcccccagctcgcgtgcgccgtactcaccagtgtactccccctacagacacccagttagcccatcctacacccccggacacaccccagttgcttcctcccgccgtggcccacgctttatccgcactgcgcggaagcgtgttgttggttcttccaccatgttccgcttcgactacccaactcccccaccgccagcggcccgtgccgctgccggccctcgacaggttccgccggtcccttcgcgtcagccgatcgacgtttcttcgactaaggagccgactacaggaggcagccaggtagacgaggagtggaggaggcagtcttcagcagccgcccgtgtgctaggccctttttttccgccgccaactcttttggagtcgtggcgaggtagggcgtgcgtgtgtttgatgtgggtgttgtttggtagtctggttctcctaggtggtgtgcgtacagtcaagctcggcgtagctctgtgacttgtccacacccgttgtattaggtgtttttatgatttggagaatccagtttatgcctagtgtgtgctatctgagttgttatttactttgctgcttgccctcctaagtgcttatctgattcttacctcgccctcttcggggagtttagatggctaaccgcccccgccgtgctgctcatgcaccagcccgcttcggttttgaggaaggtagagttgggccagaagcaaatcatgagtcggctaatgagcagtctcaccatagcaaccgttcacaccatactgcttcccgcaatgcagaaattgagcaaccccaccgcagcgatcgctcgcatcacacagcttcccgtattgcagaagtggaatagtctcaccgctcttaccgcactgccagtcacaattctggagaagaacgcatcccttccccacctcgtgtggaaaacaacatgcagcacttaatagcagtacagacacaaatcttgcaaggattagccgcagccatagccggttttcatcataatgcgcatggaaatggccaccctcacatgagcaacaatagatccaagctgacagactttctgaggtctcgttcgccagagttctctcagactgtcgagcccattgaggctgacgattggctgaaggatgttgatagaaaactcaacttagtgtagtgtactcctgttgagaagacgctctacgcctctcaccagctaagaggacctgctgcagattggtgtgagaattactgcaatgcacaccctgaacccactaacattgcttgggatgagtttgctacggctttccgtgcaactcatgtgcctgaaagcaccattgatatgaagaaagaggaatttaacaggcttaagcaaggcaacaacagtgtcaatgagtacctaagtcagttcaacaagttggctcggtacgcccctgaggaagtggacacagacaagaagaagatcaggaagttcttgaaagggatcgcggttggaatgagactccagttgcttgctcctgacttccccacttttcaacatatgatcaaaaaggcacttctacttaaggatgccagaaaagaggctaccgaagaatacaagaaacgcaagtctaaccatcagggaaattcttcccgagacgcacctcgccctcgctatggtcaacccatgcaatatcaccaatcggtcactcaggctaaccgccagccaagctacgcccctcgtcctcagatgaaccgtccggcacctcagccacagcagcgtgcccctagtggcaatactgcgccaaacagtgttacctctttcaagtcactgctaggaccgtcagcaattcagtgtttccggtgcaaccagatgggtcactatgccagacagtaccctcaaaatcctaccaacaccaactcagggcatgctaatggcagcactgccagaactcctactccagcggcagctcagtctcctcctagctctcaggcaagcggacaaggttctcgtgcttccaacaattttggtcgaggccgggtgaaccacattcaagctgagaccgctcagaacgctccagacgtcgtgatgggtatgttctctgtcaactccgtacccgcaatagttctgtttgattcaggagcttcccattctttcatatcacaagcttttgtgaaaagaaatggttggaaaacccaaaatttacgtgtaccaatgatagtacattcccctgggaggaatataagggcaactcaaatatgcccggaagttaaccttagaattgaggaagttgacttcctagccaaaccgatagtcctagactcgcaaagcttggacatcatcctagggatggattggttggctaagaacaaaggacaaatagattgtgccgaaaagtccatcaccttgcaaggacctggaggaaagcaagtccgctttacctctaacacccctaccgcaagtcggtctaacctaacctgtttacaagtcacctccttggagtcggtgcccatagtctgtgaatatcccgacgtatttccagaagaattaacgagtatgccaccagaccgagagattgagttcgccatagaactggcaccaggcaccgcaccaattgcaaaaagaccctaccgaatggcagctaatgagttagcagaagtcaaaagacaaatcgaagaattggagagtaaaggttatgtgcgacctagctcatccccttggggagccccagtgcttctggttaagaaaaaggatggctctgagagaatggtaatcgactatagagccctgaatgaagtaactataaagaacaagtacccattgccacggatcgacgatctgttcgatcaacttaaagggtcaagagttttctctaaaattgacttgagatcaggttaccaccaattgaaaatcagatctgaagatatcccaaagaccgctttctcaacgcgttatggtctatatgagttcacggtgatgtccttcggactcaccaatgctccagcattcttcatgaacttaatgaacaaaatcttcatggaatacctggaccagtttgtcgtggtgttcatcgatgacatcctgatatactccaagaatgaggaagaacatgctgaacacctgaggctgataatggaaaagctcagggatcatcaactattcgctaaattctcgaaatgcgaattctggttagaccgagtagcatttcttggacacgtgatctcctccagcggtgtcgaagtagatcccagcaaggttgaggctgtacttgcttggaacccgcccaagaatgtgtcagagatccgcagcttccttggcttagctggatattatcgaagattcattgaaggattctctaagctagccagacctatgaccgagttgttaaagaaggaaaagaaatttcaatggtctacagcctgtgaagacagctttcaagaaataaagaaaaggttgaccactgccccagttctcaccttgccagatatccgaaaagatttcgagatcttctgtgatgcatcaagacaaggcttaggatgtgtcctaatgcaagaacaaaaggttgtggcttatgcatccaggcagctcaggcctcatgaagtcaactatcccacccatgatctcgagttggcagccgtggttcatgctcttaagatctggaggcactatttaatcgggaacagatgtgaagtatacaccgatcacaaaagtcttaagtatatcttcacacagaccgagttaaatatgaggcagagaagatagttggaactaatcaaggattacgatcttggaattcattaccatcccggtaaagctaatgtggtcgctgatgcgctaagtcgcaagacctattgcaatgtagctcaaatatggcctgaccaagatcgcttgtgcagagaattggagaagttaaggctgaccgtggtacagtcaggtgtccctgccagcttgacagtgcagcctaccctagaatcgcaaatccgggaagctcagaaagatgaaaaagggataaaagaattaataaaaagaatacagaagaagaagggcaccgatttctccatagatgatcaaggcacagtttggtgtggtccacgcatctgtgtaccggccaagaaggagttaagagatctcatcctaaaggaagctcatgagtccgcctactccattcatccaggaagtacgaagatgtaccaggatatcaaggcatacttctggtgggctggaatgaagcgagatgtcgcagaatacgtagccctgtgtgacatttgccaaagagtcaaggcagagcatcagaggccagcgggtctgctgcaacccctaccgattcccgagtggaaatgggaagagatcggaatggatttcatcactggtttgccaagaacccctagcgggtacgactttatctgggtaatcgtggatcgactcacgaaatcagctcatttcgtgccagtgaaaaccacctttgatggaaagaaactagcagaactctacatgacccatgtcatatgtagatttggctatcccaagaagattgtgtcagaccgaggcactcagttcacctcaaggttctggaagcagttgcatgaagctctcggaaccgatctaaattttagtacagcttaccatccgcagaccgatggtcagacagaaagggtaaaccaaatcctagaagacatgctacgtgcgtgtgccctggatttcgaaagcacttgggatcattgtttgccttatgctgagttctcatacaacaacagttatcaggccagcattcagatgtcgccgaatgaggcaatgttcggaagaaagtgccgcactaccttgtgctggaatgaggtgggcgaagcactggtattcggtcctgacatgctcaaggcagcagaagaacaagttaagctgatccgagaacgtttaaagacagcgcagaaccgtcaaaagaattacgctgacaatcggagatcatgtgtacctgcgggtatcgcctctccgtggtatgaggaggtttgggatgtctggcaagttagcaccccgctacatcggcccctacctcacaaccgccagacgtggcgaagtggcttatcagtttgagttacctgaaggtctcacagatgtgcacaacgtgttccacgtatcccagttaaagaaatgtctttgagttccagaagaacaagttcccctgggtaatatcgagctagaaaagaatctgacctacaaggaaagaccgatcaaggttcttgaagaggtagaacgtcagacccgaaggaagactatcaagttctacaaggtccaatggagcaatcattctgaagatgaggcaacctgggagcgagaagatcttctccacgctgagttcccggagctgctcccttaggtactgaatctcggggtcgagattcttgttaggggggttggtctgtagcgcctgttctgtcgtggcgcctagcgggaaaactatctcttaaaaaccttatttgcgaaatccgtttctttgcttgttgtctagtgtccgtgccatctcagatctcaaatccccgatctatcgtcgaattcaatcccgaatccaaatccttcccaaatcaaatccctctgcaaaagtctattttgcctccctcgggtttgatgggccgaactcctctcggcccatctccccctccctccccggctctctctctctctctctccctctcccccgctctgcccgtgcgctgcgcacgcgtgcgtgtgagccgcgccgagccgagcgccctccgccctcgctgccgcttctcgccgcgccgcccgttgcttcccgcgcgcgcgcgccatggtggccgaccgcctggtcgccgccaccgtcagcgcctgcccgcgctagccgcccgtgtcgtcgctccgctccaaaccgccccgccgtcatcgccgtcatcatcgactcggccccgtctctccccgcgctagcctccaagggacggaggcagagctcctcctccctctgccgcgtcgccccatcccctcctccttttcccaaagtggcaaggggcaagccccctttcttccttcctttttccttttcccctcgccgccggcgtcatccgcctctgtcgccgttttggccgcgagcgccgagcgccagctcgcgccttgaccgcccaaggtcggtttccaaccgacatcatcgt

SEQ ID NO: 17602 - DNA, 2945 bp, Oryza sativa
  unsure (1)..(2945): unsure at all n locations
tagcatgtgtagccccccagtagctagccggcgccgccctgactgctgccgtcgctcgccgtgtgctcgccgccgtcaccgcccgagctcggaagcgcctctcgtcgccggcctccctcgatgcgattcctcctaatccggcgcaaggggtggattcccgtagccgcgtagatgctctcaccgccgagaatcggcccctcgtgacctcgtcgccgtttcccccttttctctccaccggttgccgccgccgcaatccgccgccgtcgagcatcccccggcgaatccgagccattggctcgtctccccttgtcctgcgcaacatcccggtgtgctcgccttcgcctgtatcgccatggtttgctccgccgcttgccgctgtcgaccgccgtccgttccagccggcgtcgtcgtctacctcccgccggcccgcgtggcagccacgtaggcgccacgtcggcgccacctcagccgcgaccgggtcaagtagaccccggtccgccgcttccctccgcaccgcgtcctccgcgaaccgcgcgcatgcgccgcgcctccctccccaaaccctagcacgccccgcgtgcacctcgctcacggtgagccgagtcgtcgacaagcgggtcccacccgggaccacgcgggatggacccgacccactggctctctctctcccctccccgcccgagccgccccattctctcgggccgcgccctcaaatctcgagatgtatctaatggcacgcttagaggtcaataataaggctttattttcgccatttgctgagttgtcccgtttcgcgtgtagtttcggagcccgaagacccgcagtgcgaggatttcgaggatcaagctcaagatctcgagcgaggcaagccacctttgaacatcttgagcctatatttgaacttaattatattgcttgaaaaatattatgcattgataggatcgcacttaatctgcttgtcccgtctgcaaggcagattggcggacctacctaatttgttgcatttgacccttccattgtaattattataccatgttcccttgtatccacctagttgcgcctcggtaatcgtgcactcggcacgggtatcgacggtcgccttcaaacttaaaatctgagaaacttcttgtgtaaaacttgggttttacaaaagacttggaaaacccgacacctgggtcggtgcttgcgaactaaatgaatttccaaaatcgcggaccgaggaacgtaccgggtgtacggtttcccgctcttgcacttaaggaccgtttccttggaatttcatccgaacataagacaagtacgaccacatgggtggaatgggacacccctggctgagtaactagcttatcgggggagccatgatgccaagagacatgtggattcgccggggtggtgtcggggaggacctctgggcttcctggcacagtatggtctgggacctaatctggtgttggtctaggacccctctcgttggcatatggtgaacctgtgttggctttcgaaatgccttgtcatgaaagccttaaggtctctagtcgtggccgttctgcacgggctggatgatccgggttagtaatgtcgtgtgggtaaagtgtacccccctctgcagaggttattaaaactgttcgaatagccgtgcccacggtcatgggcggatgtgaggtgattcctagcgtagtttttgtttgactactgccttgtgaaatttgctgttgtggaatgggtttgatgtttggaaaatctgcggctgatgggatcagccaggcctgggtggccgtttgaaagctgttggccgggtgccaatcttgatcaattcaaaagattgaatcattgcacatactccgaccggacgagacgcactgtctcatccgtgtcgtttgagaagcactcccttagttgtttcagaaaagagtttaaataaaatcaatcgcaaaaacaacagcctttctttgaagcctgcattaaacacttatttcccatggcttgctgagtactcctgtactcacccttgctctatataaataatccccccccccagttgctgaagaagatgaagcggatcccgctgatgaggagttcttccaggagcaagccggctacgataagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattccgtcttcctatgataccagcactgtttcctgggactggtatcggttaacaggttaatttggagcgtcacgggctagttccgcccgggactagttcggggcgtgacaagcactccttacaaaattttgactaaagtcgaaaccctaactcaaaactcaactcaattgctctctaaaaacgatactggaaagccttacgctccccctctatttatacccgaggtaagcagcttaaagccacgaaccaaactcatactaagagtcctaaacaccttaggaaaccctctagtacaagaaagaaactttacataaccaatcgtaccaaatttggactccttccaaattcgactccgcatcccacacgcacacaatacctccatcgtatgccatatagaatctccatcaaccacgtgcatcaactctagcctaagtatcccgcatgatctctgaccaccacggacgtcgtcttatccccaagccgactcccggtccatcaccgcaaatactcttccgaggcatcgagtcacctacacatgaaataaacaaagaaaccatattccgagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17603 - DNA, 1937 bp, Oryza sativa
taccctcgaaatcgacggagatcggtctgaccgagattgatctggatcgaagcgtagccgccggtctgaccggtgttgaatctctggtctgaccgccgaaatcacctgccgcgcctgctgccgtcgctggtctgaccgcccgtatgccaccggtctgaccgccgcttgccgccggtctgaccgcctgtatatcgccggttagaccgtcgaaacccggtgaaacacaaatcgaagaactcttaaagtagatgacgactttattgattctctctgtgtttacaaagtgcaccaacagcactccttataaaatttcgactaaactcgaaaccctaactcaaaactcaactcaattgctctccaaaaacgataccggaaagcctcacgctctccctctatttatacccgaggtaggcagcctaaagccacgaaccaaactcatactaagagtcctaaacaccttaggaaaccctctagtacaagaaagaaactttacataaccaatcgtaccaaatttggactccttccaaattcgactccgcatcccatacacatacaatacctccatcgtatgccatatagaatctccatcaaccacgtgcatcaactctagcctaggtatctcgcatgatctctgaccaccacggacgtcgtcttgtccccaagccgactcccggtccatcaccgcaaatactctcccgaggcatcgagtcacctacacattaaataaacaaagaaaccatattccgagaccaagctttctccaacttgactcattagtagcaaacaacagtattatatacgtaaggtatccatctagaagtcataatcacgaaataatcacggatatccaaacaaacaacccgaaaccgaaactgacacagagtcagccggtcagaccgcgggctgcgccggtccgaccgctcgatcaccgccggtctgaccggcatacacagtccagtttgaccggtcacataaaatgatagaatcctgcgatcacctgtgaattcaatcatctccaaaaccacttcatgaataaattccaaataacaaaaccaataatctccgatgcccaattgttcatcacagaataataatcaaaaacacctttgattttacaatctcctccttgatgaacacattggcaaacccatcaaaaatgttttggtgttcggaaaaataaaaacaaaagtggtaaaaagcacacttcgtacaaacgtatacatcgtgctcgaaaaatccaaaagaaaacttctcccccttttcaaaagaaagaaattctcaattgaaccaaaaacatgctcttctcaacaactctcctaaaattcaccttgcttctccaacaatccaaaaattttcatattacttatcccccttttgacaatgatttcatcatgcatagaaattatgttcattaatgttcaagagcttagcatatatatagcatatcaagtcatgtgttgcaataaaaagaagatgaacccatctataatataacatgcatgcattaaagtataaccatgaatcaaagattttacaattaagcttgaatcaacaatcaaaattcatgatttcatacgatttataataaacactaaacacatatacttattgcatttatcactctttctcaaataaactttagcacaaaataaccaagagaaaaatttttttcaactttttcttttcttgagcctttttgctcatatttttctcttttattccgggtacgtccctgtcgtcaagtctgtttctagggattcggcacccattattttgctcacatcgaatacgtcattgtcgtcaagactgtttccaaggattcggtattcattttttcatattttttattctcttttcacaataagcaattaaagctatttgaggaataacaagtcaataaagcatatatataaagcatttatagatcaaaccatatg

SEQ ID NO: 17604 - DNA, 2874 bp, Oryza sativa
tatcatccacataaatctgaacgaacagttgattatcaccatgcttaagaacaaaaagcattttgtcaacctttcccattgtaaaacctttcgtaagaaaaaagttcttaagcctatcataccatgccctaggagcttctttcaaaccatacaaagctttagacaatttaaaaacatggttgggaaaatcaggattttcaaaacctggtggttgtttgacataaactttctcctgtataaaaccatttagaaaagcacttttcacatccatttgatacaatttaaaaccttttgaagcagcaaaagacaacaaaagtctaattgcctcaactctagcaacaggagcaaaagtttcatcaaaatccaaaccctccacctgggtaaaaccttgagcaacaagtctagctttatttctcacaatcaaaccatcctcattttgtttatttttgaaaacccacttggttccaataatattaagtccagaaggtggttcaactaaagtccaaactttgtttctctcaaaattttcaagttcttcatgcatggcgataatccacgattcatcagttaatgcatgtggcacatctttgggttcaaaagaagcaacaaatgcagaatttgcacaaacatcatgagtcgttaccttagaccttattgtccgctcacctatattaccaataatttgttccggcggatgtcgtcgttgaatgtgtaaaggagcaacaacttctgaagttgatccacgttctgtatcagtactagttgaagttgaattctctggaggaccatctcgatcagcatcaacagtacccgaacccgatgaccctagccggtctgaccgctcctcatgagccggtctgaccgctcctcatgagccggtctgaccggaggtgtgccggcggtctgaccggcctggcgcccggtttgaccggccgagccgacctcgtcatcgttgttgtcgtcgctcttgtcttcaaaaatacgaccatcctccctctgaacctgtgacaatgtacctgcaatatcggatttagtacctggactagcctcatcaaaagaaacttcgcaagtctcaacgattttgttagtctccaaaataagtacacggtaaccacgagtatgagcagggtaaccaagaaacaatacatcggtagaacgtgcctcaaacttatccaaatttccagatttcaagacaaagcatttgcaaccaaaaacacgcaaatgtgaaactttgggtttatgtccaaaccgaagttcataagaagtttttccaagtttagatctcaagaaaactcgatttgaaatataacaagcagtgttaatcgcctcagcccaaaattttctaggagttttatactcatctagccatctcaaccaaaacacgatttttcctttcaacaacaccgttttgttgtggaacacgaggagaagaaaattcatgttcaagacctctttcattgcaaaactgttcaaaagaagcatttttaaactcaccaccattatcacttcgaattcttttcaaagaaccaggaaattcaagatccaatcgaagaaacaaaccacgaaagtgttgaaaagcttcgtccttagttgccataaagaaaacccaagaatatcgagaaaaatcatcaacaataaccaacacataccacttacctccaacagattgcatgtcgcgaccgggaaaattgcctttttccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaagactccacctaagacttcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagtaaacagcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcatcccaagccaacccaggccaaccattccacattttagttgttaagcaaattttaagaattaaaacactgacttgggtacattgctcggcttgcccacaaccgagggagaagacggcgcggccggacggtgctccggcgaggagggagaggcggctggaggcggccggcgcggaggaaagagaagggcgacggcgggaacgcgcctccggcggtcaccgcgcgaaacggagggcaggccggggtggaggaggtggcggcgacgctggaggaggcgacggcgcggccggccggcgcacggtcgaggcggcacaggcggctggaggcggccggcggcgtgggagagagaggagggcggcggggagatggctagggaccacggggaggctcgggagggggctaaaacgagagaacgggggatgaggatcccattttatatgagagaagagggagccggccacgggggaggtcggaacggcggcgggaatggcggccgacggccatggaaagcggtcggacttggcgcgtccgttcccggggattgaaggcacgaatcaagggggaatttgggggcaattgaagaggattcattggggattaaaacccccaattaatttggaatggccattgaatcaagcggattggag

SEQ ID NO: 17605 - DNA, 8280 bp, Oryza sativa
attccacattttagttcttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctacctacggccggaacccccgggacaggcaggcaggattgagctccctagcagcaggacaccagccctgtgccatgacatctcgactaccgggccgcagctcgtgtagccttcatttgtcctagagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtatccaaatgatatgagatttcccaaagtctaaagttataaaaccacctaatgttgcctaattatccagcgaagcatctacctaagttcatactagtggaaccataaatagagtacccactagttggggttttattttcctagggtgaacaaggtaataataacaatagcaacaataataaggtcataacaaaggtaaataggcatggctaaataaaacagtgataacgcgggaatttaaataaagcgataatgcattaatttaaatcaaaataattttataaactgggattcaatatgctcaaggatgatgtgacttgccttgctcagagagaacggccttccgaaccttcggcgacgaccacgaaccacgctttgggaacctccggaacgatgaaagctacgcgaagcacacaagcaaagctacaagcctataaagaagcaataacaatacataaaaacaaagcacagggttctttaggttataacaaacattaagagacttgaacggatcgattcggagttcgtatgaccaagatatgatcatccgaagtttaatgctgttatatggggatttgcggattattataattaagctttgcaactataaaacatgtgtaagcgctagcctggaaaagacaggaaggctgcgccgttgacatgcggaccccacatgtcaacctaaaggaccgcggtagaccgagtacacagaggcggtccccgggtcgacggaagcagaccccgtgtgtcaaccgaggcgagtggccgacaaacggactccattaaacaacacacggcctgcacacgtggaaaccacgcggctaccgagcgggcacactaacacggacactacacggtcaccacccgcacgcgtgaacgactaccgacaccggtacacgggtaccggggtcgacgaccgcacaactggtacggggcgacaccggaagaacaaggacggggcagcgagaggggagaccttaccaccactcgacgaggcgagggaacgacaacgacgaacgggcgcggcggaggcggccgggaactacggagacgaacggcgaggggacgacttcggcggcgatcctaggacgaaggcgagacgcggccggcacgaggcttgacgacgcggagccgtggacgaagacgaggacggggctgcagcggctcgcttgacgaacgcggacgacggacgagaacggctcgacggagggacgaacgccacgacgaccgggaacgacgagaggacgacgacgacgacgacgaccgggaccggcgaggaggcgacgaggacagccggcagcggctgcacggggacgaggacggcgtggaacacgccgcagcgatgatgatgacggaggcggcgccgcgagacgacgagccgggcgaccgacgggacgtcgatcggcgaggacgaacggtgacgaggaaacgatgatggcaggcagcagcggctgagcggaggaggggacggcgtggaacgcgctgctgcgatgttggagaaggtggtggtgcagcggggcgacgagccgacgaggaggaatgggtggccgaaaggacgccggcgacgaagaggatggagaggccggcgcggcgacggcgttctggcgaaaccgaggagcagccggggtggagggcggcgtcgcggagccgagggaggtggtggcgatgtcggccggctcacgggaaacgcgacagtggcggccggaggtggaacagtggcggcaacgccactgttttgccggcgaggacgcgtctctggtgctttccccgcgaaacggagggctgaccgagggagaggaggtggctgcgaggccgagggagaagacggcgcggccggacggtgctccggcgaggagggagaggcggctggaggcggccggcgcggaggaaagagaagggcgacggcgggaacgcgcctccggcggtcaccgcgcgaaacggagggcaggccggggtggaggaggtggcggcgacgctggaggaggcgacggcgcggccggccggcgcacggtcgaggcggcacaggcggcttgtcgcgtcccaaatcgactctaaaattcaccctcgaaattgtgcaaaagaataagtaaaattcaatgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaataaacaaagtggaaaaggtttataaaaagaaaatcctaaaagaagtctgcttttcccccccctttttccctcttgggccggctcggcccattccctccctctccctctctctctctctccttccccgcggcccatcggcctccccgcgcgcgcgcgccgctgacaggcgggcccgcccgccgctctcgctgacgggtggggcccacctgtcatcttcctcctcccgccgcgcccgccgccagcgcccgtgccctagcgccgccgccgccgcggattccgccgcatcccgccttccccgcgcgccataatgaggggggaattattccccgcgtttccctctcccgattccccctcttttccctctctctctccctcggattcgttcgaatcaagcccgtaatcctcgccggcgtattcaatggagccgagatccccgcgcccgtttcctctctctccggccgctctttccttcccccggcgctataaaaacgttgcccgaactccgctctttcgtttccgccgcttgccgctcgctctcgccgtcggaatcgtgctagcgccgtgctcctctctctccgccgtcgccgtcgaccttcggttagccgccgccgtcgctccgctcttcttcccggctcggcgacccctccttcggcatcgccgcatcgccgccgaccccgtccgccgctccgcttcgcccgccgaccgccggagcaccgtcgtcatcatcttcccgaaccgcgccgccgtcttcctccgctccggccgccgttctcgtcgtcgtcgttgtcccggggtgagccaaggaccgccgttcgccttccccctttcctcctctctctcgggtgccactccgccgcgccgttggtcgccggcggcgaccatcggggcgcgggtgcacgccgctcccgtcggccgcgccggcgaggccgcccttgggcgcgccctcgcggctgccaagtgggcccggccgtcagccgcccgcgcccgcgggtgcggctgacgcgcgggacccacggcgccgacagccgccagccgcgtgcgcccggtccaccgtggaccgagcggctgacgcgtgggccccacttcccgtggacccggtccgcgcgcccgcccctcggctgacgcaataatccgtgtttttaattgaaaattaaatgaagaaattcgcaaatattcatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcgtggaagtcgaagccgtcgagtgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattattaccttgttcgctctaggcaaacaaaacctcaactagtggactctctactcatgacaccactagtttaattttaggtagatgcttcgcaatctaattaggtaaccttaggtggttttataactttagacttgggaaatattcatatcacctggatactctggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccaggacaaatgaaggctacacgagctgcggcccggtagtcgagatgtcatacggcggagggttggtgcccaatgctaggggctcagttctgcctgcctgtcccgggtatcccggccgtaggcggaattgggtcggtactcttgtctaaggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaaataaaatgtggaatggttggcctgggttggcttgggacgagctgggacccagggtcgggttgccagttcggtctgaatcatcgtaggccttgggttaaggcaggttcgtgtgggttcacgaccttgattaataatactgtgtagctctaggatcgtctttataaaatagctttgggcaaataagtgacttttaaatgctgtttactgcaaccctaaccccttatgttataattcctttgtactcccttgcaattattctgcatttgtgggtgtgtcttgttgagtacggtggttgtactcagtcttgctcaattttttccccaagcccagatgaggagttccttgaagatgaaggctttggtgtctagctcgtgcctgccgtcaagcgcctgtggtcgtcgccctagtcttccgctgtttctcgttgtctttgagtgtgctgggccttcgttgcccgtgtaataattttatttacgcttccgcttgttaaactctgaattgtatcaacttttggtgtaccttgcctcctgggacaaggaataatacacgcacgtcaggaatgcctgttgggtgatttccggtcgtgacacggctggaggcggccggcggcgtgggagagagaggagggcggcggggagatggctagggaccacggggaggctcgggagggggctaaaacgagagaacgggggatgaggatcccattttatatgagagaagagggagccggccacgggggaggtcggaacggcggcgggaatggcggccgacggccatggaaagcggccggacttggcgcgtccgttcccggggattgaagacacgaatcaagggggaatttgggggcaattgaagaggattcaatggggattaaaaccccccaattaattttggaattggccaattgaatcaagcggatttggaggagggagcgagctaggtttccgggagagagagagaggtggccgggcggctggaggagggagacgacgcgcctaacgcgtgggccccacgcggtcgggcgcgcggtcagcgcgcggcaacggcgcgcacgcgcgcgcacgcgcgcgcacgcgcgcgcacgtgcgcggcacgggcgggagggcgccgctcgggttgggctgggcggccggcccaggaggagaggagggggaggcggcttgcgccgggcaggccgggaggggggggagagacagcccgggagagagagggaggagggagctgggccgaggggaagggggcccaagaggagggagagaaggagagggagagaaagagagggaggaaagggagacttcggccgcgggccgaggggagagagggaggactttgggccagacttggcccaaaggaggaaggagggttatttttaggtttttctttttaataaactttgttaattgtttttgttgcttaataattatttccggtgctataaaaattcaagtaaaatttgagggctccttttagaccaaggagaatttaacaaaaattctccgggccacatttgaatttttcttgcacgtattttagtgtttgccaatttctttccgaattttaattaattctattattccttttagaaaatgatttttaattcgggatgaatttatcaggacgtgacattgcactcttgctggaccaacagtgtccatatgtaatagctgtctcggtgcatccgtcatcacagaaacaataggagtatatgaagaagcaaccatcttagcatgacgacacggtgtacaaaccaaatcaagatctttcttaagtttaggcaaaccacgaacaagatccaaaccacttaacctagtgagatgatcaaaaccaacatgttcaagtctaagatgccaaaacatcacatctttatcaaacctagcaaccaaacatgttataataggtgaaacaggattttcaaaatcagctttaaacacacttccatagcgagaaatattcaacacaaaatcaccacaagaatcaaaaactttacttccagttttcttaaagtgaacctcaaaattttcatcaacaatttgtgaaaccgaaagcaaattgtattttaagtcctcaaccaaagctacattcttcaattcaaaattttcatttaccttaaccaaacatgtaccgagaacggcacttgtagaaccatcaccaaagataatcgattcagtcttagatgcctttttgagagaggagaatcagtttttatcaccggtcatgtgctgcgaataaccggaatccacgagccacacgttctccttccttgccaccaaagcctacacacaagcagaagtcgaagcctcagtactggggttagatgataataaaaatttaggaaaccagtactgagacacacgaccagaagatccaataggcatatatccacgtgcaaaatcaattttagaattttcagaaaaattcctccgaggccggtctaaccgaggtacagtggccggtctgaccgcctctgtactgccggtctgaccggtcgccggtctaaccgcgggacccactgcggtctgaccggtttcctcgagggaaaactgtcacgtcctgataaattcatcccaaaataaaaatcatcttctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattgaaaagaaataaacaaagtgaaaaggttttataaaaagaaaatcctaaaagaagtctgtttcccccctttttttccctcttgggccggctcggcccattccctccctctccctctctctctctctcctcccccgcggcccatcggcctcccccgtgcgcgcgccgctgacaggcgggcccgcccgccgctctcgctgacgggtggggcccacctgtcatccccttcctcccgccgcgcccgccgccgcgcccgtgccctagcgccgccgccgc

SEQ ID NO: 17606 - DNA, 2624 bp, Oryza sativa
cttcggccgcgggccgaggggagagagggaggactttgggccagacttggcccaaaggaggaaggagggttatttttaggtttttctttttaataaactttgttaattgtttttgttgcttaataattatttccggtgctataaaaattcaagtaaaatttgagggctccttttagaccaaggagaatttaacaaaaattctccgggccacatttgaatttttcttgcacgtattttagtgtttgccaatttctttccgaattttaattaattctattattccttttagaaaatgatttttaattcgggatgaatttatcaggacgtgacaaatccaccccccttacaagaatctcgtccccgagattcgaggaggctagcaagaagataggttgggcggtcttctcttcttgtctgacttcttccgtcgcgtcttctataacaaacttgcctagcaaaactcctccactctggactgcttggctcgatctcctgttgcagatggaatcttctcttcacctgacttgtccctggttgaacctttagctgacttcgactgggttgtggcacttgatgatggggcttcagatccagaacttctcatagttcatatctttggcgtcaacctcatacaacttacccacttcatgtcatgcgtcaacactagcttgtcattactaggataccatgtttgtcatcataagaatatcatgcttatcatttacttctaacttgccactgaatgctttggactatgatgtcacgcttatccagcataccatgtttgacaacttgtcactaactgcatcatattagctttcctggcctccgggtgctagatactactgctattcgatgcaagggtcgataacttttgcctttgaattacgtttctcaaaagaaccaacttatcccacttgacatgctttgacatctttctaaatgactttactgctgaacttgttattgtctgatcgttttcctgccaaatctgaagcttcgttgttagatgtgattttaatctgacctctgtaaactatcttcgaacatatcacttggttcataactgggaatagctcccatgaacaagcaactcggattcacttgctttacattcagtttacttcccactattcacttcatgttgtcctcagttagcattcaacgtattcctttacacctttgaccttgatgtgttctttcccgattcctcttatcaatcacctttcgacctacttctttgcctggtaataaacatctttttcgatatctcctatcagtcatcttttgacctttgtcaactaagtactcttcactccgagagttgtggatgcttctggtgacgatgtggtacttgagcctgctgcctttcagagaaaccttcaagtggttcgtcaaaagctagactggcggttgttgcctttgatccaaagaggacacatctgaaactctcagtccaaacaaaagtctctttggctttttaatccgacacagtttaattggttttcttttccatcaacaggttggttattaactcgaggttagaacatagttcctctggaatgagaccctaggtctcctttgacagtaaacaattatacgcatgatcccatatcagcatcttccaaaataatcctcatagaacttgtttttatcacacatgtctcccttattacatgaatacaaggcactgccttaaacaaaaagggaaggtgcttaacatcggtacattgtatcctcgacaggaatcatccataaacgtagcaagctcattatttataatcatgaatatatttatttattacatgattgctgcaaactcccgattacagtgataagtagcgaactgaaaatcacaaacatggctacatagctggcattgttctagtgactgcatccttgattggttctgtgatgatatgataggactgcatattgctatcattcacaggagaagcttccttctgattgctggttgaagcgaataacggtcttctgcttggtatcgccctcctgaggttgattgccctttgctcggcctggagtaggtcggggagagacacaacttcttccatcgacgacaattctttgctaaggccgtcggtgcagagaatggttggtgctgaaggtattattgctatgatttattgcagagtcaggtgcagcaggaggagcattggtgctgtggatgatatcgtcgatgttgttgttggagctgactagctgatgagacaatcgtagggttgttcgttggatttctgcggtcttggtcaacaacacactgagttggcaatccttgggcacatggtttgtaccttcgcatagaaaacatgtgaccttgcgggtgggacattcacctggtggatggtcttcctcacaatgagggcagagtgtgagacacatgctagcaacatgtccaatttctccacaacgggggcatgcttttgattccatctcttcctcgccgagatgtcggggagactcatcttcatcatccgaggagacttgatctgacccttcactatcagatactctgccaccatggcttagaaggtgctgggtcaactgtcgtgcacctcggaaggtatttcctctttgccgtctaggaatagttatccctgctg

SEQ ID NO: 17607 - DNA, 853 bp, Oryza sativa
aggatcgtctttataaaatggctttgggcaactaagtgacttttaaatgctgtttactgcaaaacttaacccctatatcattaccccttgtacccccttgcattaatcgtgcatccgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcggaaaaaggcaattttcccggttgcgacaagctggtgtcagagccatcccgactgtaggttaagccaaatggataaaacctaaggacatattttataaataaaactatttgcgaaagttccttttttctccttcccctaatgctatttgcaaaaggtttactccgtttttccttcttcggactttcaactagtactagatggttagttttgcgaagaagaagatggcgtcaattgtccgtcaaaactccagaagactgttggatcccttagcgaagcaaaggaagcagtgaagccagatgtgaagcaagagtgaagatcttgggaacccatcgcagaacctaagccaccctctagtgtttcgtttgtcgtgtgtttccttgcttgcgtgtgtagcgcgtggtttgcatcagtgggttgtgatgtaaccatgcta

SEQ ID NO: 17608 - DNA, 7018 bp, Oryza sativa
gccaaaaggtgcaccctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcctcttgctagcctcctcgaatctcggggacgagattcttgtaaggggggtggatttgtcacgtcctgataaattcatcccaaaataaaaatcatcttctaaaaggaataatagaattaattaaaattcgaaaagaaattggcaaacattaaaatacgtacaagaaaaattcaaatgtgacccggagaatttttgttaaattctccttggtctaaaaggagccctcaaattttagtggaattttcagagcacaaataataattgaaaagaaataaacaaagtgaaaaggttttataaaaagaaaatcctaaaagaagtctgtttcccccctttttttccctcttgggccggctcggcccattccctccctctccctctctctctctctcctcccccgcggcccatcggcctcccccgtgcgcgcgccgctgacaggcgggcccgcccgccgctctcgctgacgggtggggcccacctgtcatccccaaccccgcgccgcgcccgccgccgcgtccgtgccctagcgccgccgccgccgcgaatcccgccgctcccgtccaccccgcgtgcaatcaagaggggggaattaatccccgcgttcccctcccccgtttccccctctttcccctctctctctccctcggattcgttcgaatcaagcccgtaatcatcgccggcgcaatcaatggcggccgaaatctccgcggccggtttccttcctccccggccgccttctctcccttccgacgctataaaaacgttgcccgagctccgctctttcgtttccgccgctcgccgctcactctcgccgtcgaaatcgtgctcgcgccgtgctcctccctctccgccatcgccgccgagctccgttccgccgccgccgccgctccggacttcctcctactcggcgacccctccgtccgcttcgccgcgacgccgtcgatcccgtccgccgctccgcttcgcccgtcgaccgccggagcaccgtcgtcatcgtcatcccgagccgcgccgccgtcttcctccgctccgtccgccgtttccaccgccttcgccgtcttggggtgagccgtggaccgctccgttcgtttcccccttccctcctctctcttgggtgccgctccgccgcgccgttggtcgccggcggcgaccatcggggcgcgggcgcgctcctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgcccctcggctgacgcaataatccgattttttttaattgaaaattaaatgaagaaattcgcaaatatccatttaaagagcatataaacttcaaatggccatatcttggccgtttgaactcggaattggaccgttcaagtctctaatttttccttaagaagtaaagaacccatttttgtgctttgtttatgctgttatttggagtttattagagtaaaagccttttcttttccgtcggtcgtgtagacgctgcagcttcggaagatccgctcttcgtggaagttgaagccggtgtttgggaaagcgagcaaggcaagtcacatcatccttgagcatattgaatcccagtttgtaaaattatgttgatttaaattattgcattatcgctttatttaaattcccgcgttatcactgttttatttagccatgcctatttacctttgttacgaccatattattattgttattgttattattattaccttgttcaccctagattaaacaaaaccccatctagtggacactctatttatggttccactagtttaaatttaggtagatgcttcgcaatttaattaggcaacattaggtggttttataattttagactttgggagttctcatatcttttggacaccatggaatggttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaacactaaaatgtggaatggttggcctgggttggcttgggacgagctggaacccaggtcgggttgccagttcggtccaaatcatcgtaggccttgggttaaggcaggttcgtgagggttcacggccttgtttaataatactgtgtagctctaggatcgtctttacaaaatggctttgggcaactaagtgacttttaaatgctgtttactgcaaaacttaatccctatattattattcccttgtacctcccttgcattaattatgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctggagcgcctttgtaataatgtaaatactatcgatgtaataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagctcctctttttctccttcccctaatgctatttgcaaaaggtttactcccttcttccttcttcagatttcaactagtactagatggtcagctttgcgaagaagaagatgtcgtcaattgtttgccgaagctccagaagactgcaggatccgctagcgaagtggaggaagcagtgaagccagctgagaagcaggagtgaagatcttggagaacccgtcgcagaacctaagccgccctctagggtagagtcgttagtcgtgtgtttccttgtttgtgtgtgtagcgcgtggtttgcatcagtggggtgtgatgtaaccatgctaggttgtttgcttaatcaacttgcagaataagtgaaacaaacaacacatcagcaagaagagttagttcctttaaggtcctatccttagtttctaatctgtctctcccctttgttttccctctctccctctccaaacctttgcaacagatggctgacaatgagaagggcaataaggtcagaagtcaggacattggtacctcaagctcccgagtgaatgaagcaccagacaccagttgtgtagcagtggtccaacacctgattaaccagaacaaattgcttatagagatactacagcagcatcggatgccaattttgaacccgagtcggatgcaacctcaagtacagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgaccagacgtcagagaagaaataccttccgaggtgcaccacagttgacagaacatcttttagctaatggaggtagagtgtctgatagtgaagattcagatcaagtctcctcagatgatgaagatgaaatggaacgtaaggcatgctctcgttgtggagaaatcggtcatgtcgccagctcatgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaacggagagaagcatcaaggcaacaccaatcctcgccaagattacagttccagcctaactccagtgccaggacagaggaatcgaaatgagaaaagaaaatgccgagtccgggaagacatctgttgcttcaattgtcaaggaatgggtcatttcgccgacaagtgcccaaaaccgagaaacatagctgccggcacgacagtccacgcaactccctgcaatcagaagcttgctcctcaacgaattgtcatccatgcatcccgaagcagtcctatagcccgcgttgcaacagctccaattccaatgaatgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccgaaaactgtccccaaccaaggcaaaatcgacctccacattaccgccaatttacacgaagcagacattccaatcgtattgtggtcactggagcaaacgccgtacccgtaaggcctcgtgataatcagaacccatagcagaaacaatgcaccaatgctcctcctgctgcacctgactcggcaataaatcatagcaaccattctctgcatcgacagcctcagcaaagaattgtcgtagatggaagaagttgtgtctctccccgacctactccaggccgagccaagggcaatcaacctccggagggcgatacccagcagaagaccgtcatccgcttcaaccagcaatcagaaggaagcttctcctgtgaatgatagcattatgcagtcctatcacatcatcacagaaccaatcaaggatgcagtcactagaacaatgccagctatatctctccggaatcaaaatgagcagccatgtttgtggttttcagttcgctacttatcatggtgtaatcgaaagtttgcagcaataatgcaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcttttggaagatgcgaatatgtgattatgtgtataattgcttactgataaaggagacctagggtctcatttcaaaggaactatgttctaacctcgagttaataaccaacctgttgatggaaaagaaaaccaattaaactgtgttgggttaaaaagccaatgagacagtagttggggaacaggagtttggatacgcctgttacagatcaagataaggattgttgaatgaaacccataagtgtacccgccatgcctctacattgataagttcggatatacctgcaaacagttaagaagatccaggagacatcaatattctagaacataatagtcgatggttggtaattagtcgatcaggtatcagaaaagggtcaaaggtgatatggcagaagaacaatatggatgctccccatctcgaggaagcactaaaccctagtggcatagatacagatagcaagcaatgtatttccctgaaggtagtcagtgcagctttttgacgaaccacatcaaggtttcactgaaaggcagcaagccaaaggacctcatcgtccccagaagcgtccgcaatccacattaaagaataccacctgttagagataagccgaaagatgattgataaaaagagattggcaaagatgttctctagcatgaaagaagtaggccgaaaggtgattgataaacagaaacatgctctgcatcgctcaaggaagacccctgattgtaattgccccgcaacagtcaccttgtcattaagtcagcaagatgacctaggtaaaagtgtttctatgaaggcaaagagtgaaatcttccactcggtatcagatgctacacggagtgaaaaatgcaagcaccggttaccaggcgacgccacgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgttcgtgggagctattcccagttatgaaccaagtgatatgttcgaagatagtctgcagaggtcagtttaaaatcaaaagtaacagcgaagcct

SEQ ID NO: 17609 - DNA, 5745 bp, Oryza sativa
  unsure (1)..(5745): unsure at all n locations
tgaaaagccttcctgagattctctatcttcctcccttgggatgaactcttcggctgttgttgttggtcttctcaccatctttgtcttctcttttgcctctcccaagcttaggacaatgcgaacgaagatgatcaattgaaccacgcattcaaagcaacgatttggaccacctcttttcatgttcctggcattattcatagctcgagaaattctgttagcaaccaaagccaaatcctcctcctcgatctgttcgagttgatcatcggatgtggcattaaaaacagcaagaaaataaggcttatatgaagaagcatgaacatccgaagaagaagaaaaagaaaccaaagcacttgacttagaatcaactttccgagaaagaacattcatctcatgtgttttcaattttgtataaagtgaatccaaagtcatccaaagcttctccaggtttcatctcaaatttaatgtactcctttttgaaaaatatcacgacgaagttctttaatgttattcgttccttgatgaaagttactcaaagcattccaaatttcatgagcagctcaaaaatgcgcaacacgatcataatccgaacgagaaataccactcaaaagaatgttgtgagctttgcaattttgttcaaaagcagttttttcagcagcagtattaatagcttcaggaatcacatagggacgagaaacttttctccaaatatcataaacatgaggcttagttgaaaacctagcaggagtagccatggcaaaaactctagatcgataaaaatccaaagaagaaaacaaggctctgataccacttgtaggatcgaatcacaataactaagccaaccagagggggggtgaatggttggtatacccaaaaaccataaacttttagcggaaataaaagttaccctcgaaatcgacggagatcggtttgaccgagattgatctgctggtctgaccgaagcgtagccgccggtctgaccggtgttgaatctccggtccgaccgccgcttgccgccggtatatcgccggttagaccgtcgaaacccggtgaaacacaaatcgaagaactcttaaagtagatgatgactttattgattctctctgtgtttgcaaagtgcaccaacagcactgtagcgcccgttccgtcgtggcgcttagcgggaaaactatctcttaaaaaccctatttgcgaaatccgtttctttgcttgttgtctagtgtccgtgccatctcagatctcaaatccccgatctatcgtcgagttcaatcccgaatccaaatccttcccaaatcaaatccctccgcaaaagtctattttgcctccctcgggttcgatgggccaaactcctctcggcccatctcctactccctccccggctctctctctctctctctctccctctcccccgctctgcccgtgcgctgcgcacgcgtgcgcatgagccgcgccgagccgagcgtcctccgccctcgctgccgcttctcgccgcgccgcccgttgcttcccgcgcgcgcgcgccatggtggccgaccgcctggtcgccgccgccgtcagcgcctgcccgcgccagccgcccgtgtcgtcgctccgctccaaaccgccccgccgtcatcgccgtcgtcatcgactcggccccgcctctccccgcgctagcctccaagggacggaggcagagctcctcctccctctgccgcgtcgccccatcccctcctccttttcccaaagtggcaaggggcaagccccctttctcccttcctttttccttttcccctccccgccggcgtcatccgcctctgtcgccgttttggccgcgagcgccgagcgccagctagcgccttgaccgcccaaggtcggtttccaaaccgacatcgtcgtcctataaaccaaggcgccctcccatccattcctcctcccgtttcgctcgccgccaccgcgccattgccgcccctctgtctcacctccgccgttcatcgccaagcaccgggagagccagtgcgttcgtggacgcggaaggggactccgggcgctcgccttcttcctcttccccggcccgaggccggagagatcactcccgtgccgtcggcctctcgtcacagcgccccgcctcatctcggtagtgcatctccccgttctccctcctcaatccatctcttccccttagttttcggtagtagcatgtgtagcccccccgtagctagacagcgccgccccgactgctgccgtcgctcgccgtgtgctcgccgccgttgccgcccgagctcggaagcgcctctcatcgccggcctccctcgatgcgattcctcctaatccggcgcaaggggtggattcccgtagccgcgtagatgctctcaccgccgggaatcggcccctcgtgaccttgtcgctgtttcccccttttctctccgccggttgccgccgccgtaatccgccgccgtcgaacatcccggtgtgctcgccttcgcctgtatcaccatggtttgctccgccgcttgccgctgtcgaccgccgtccgttccagccggcgtcgtcgtcttcctcccgccggcccgcgtggcagccacgtaggcgccacgtcggcgccacctcagccgcgaccgggtcaagtagaccccggtccgccgcttccctccgccccctcgcgggcgtggtccatcgcgagccgtgaggctccgcgtgggcccgccgcaccgcgtcctccgcgaaccgcgcgcatgcgccgcgcctccctccctaaaccctagcacgccccgcgtgcacctcgctcacggtgagccgagtcgccgacaagcgggtccaaccggggaccacgcgggatggacccggcccaccggctctctctctcccctccgcacccgagccgccccattctctcgggccgcgccctcaaatctcgagatctatctaatggcacgcttagaggtcaataataaggctttattttcgccgtttgctgagttgtcccgtttcgcgtgtagtttcggagcccgaagacccgcagtgcgaggatttcgaggatcaagctcaagatctcgagcgaggcaagccacctttgaacatcttgagcctatatttgaacttaattatattgtgtggatattatgggtaccccatacccatacggcatggttatccgactagtcataggggataacttatatctatggaatatgtaatagatcatgactcgggtattacgtttccttatatattacggaacagtctaaagtcctggtttgataatattgtaaagtagatttaggaaaccgataccgtattggttaaggtttctatcttgtaatcctgccccccaccctatataaggtgggcgggaggccctctagagggcatgacacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggtaaacgccgagtttcctgacgacgagtgcgatggaatcaactttatgagtcgccggcttcgtcttcgctttgggagctccttgattcctcgccgccgacgacttcaacaagacgaatcgtcgctgctattctctgcctgatcttgttcgcatcagcacgacggcaacgacggggcaacgacagttcgacggatttgatggtcgtcctcgtccaccaccaagcctactggtccaatctacccaatgaggatgccatggtgttgcaagatggatctacaaacacgaagcatgccaaaaccaatctaatcggatgcataggagacggctgcagccacgccgatgccttcctgccgtccagcgtcgtgctgatggacaccaacgccgctcgcgactgcgacctccgcctcctccgctccgtttcggagtcagtcgaagagatcaatctcggcgagttttttccttttaatttccgacttcgccgggttttttccttttcaacttattgttgtttattagattgatctctaaatgtcagattaatctctcttggtattttctgctgtttgcatgtaacgccgcggcactactcttgccgactggtgtttccgtctgcatggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccaccggcctgcctccatcgccgccgactggtgcctccgcctacacggtcggttggtcacaccaccgttgatgggcatcgtcatcttcaccgccggcctgcctccgtcgccgccgattggtgcctccacctacacggctggcctattatgccgccgctgttgggcgtctacgacttcaccgccggcctgcctccgttgccgccgagtggtgcctccgtctgcatggctggcctattaagccgccgctgttgggcgtctacgacttcaccaccggcctgcctccgtcgccgccgactggtgtccccgcctatacggtcggttggtcacaccaccgttgatgggcatcgtcatcttcaccgccggcctgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttgcattgagtagtgagtcgggggctacagatgttatatcatattttttataatatttatcttgattgcttgcgacataatctgagtacaaaagtacctatcgagttatggagttctatcttcctctgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctaatccgtgaaactttgttccattaatgacgaactcatatcactcatatgcatgtttgggaagtgcctaggccgactcccgatgcttggtggttatgactagtcggacagagtgtttaaacgtacagagtcatctgctcggagaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17610 - DNA, 1885 bp, Oryza sativa
ccgcctcgtccgccgccgactggtgtttccgcctgctcgctggcctattatgccgccgttgttgggcgtctacgtcttcaccgaccggcttgccttcgccgctgccgactggtgtttccgcctgcacggctggcctattatgccgccgttgttgggtgtctacgtcttcaccgaccggcttgccttcgccgccgccgactggtgtttccgcctgcacggctggcctattatgccgccgttgttgggcgtctacgactccaccaccgacctgcctccgtcgccgccgactggtgtcctcgcctaaacggttggttggtcacaccaccgttcatgggcatccacgtcttcaccgaccggccacctcgtccgccgccgactggtgtttccgcctgctcgctggcctattatgccgccgttgttgggcgtctacgtcttccccgaccggcttgccttcgccgctgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgctggtgtcaccgcttgcacggctggcctgttataacgccaactgatgctatcttcttcacggctggctacatcgctgtcactactaataggcatcagtatcttcaacacaagctgcctacgtttgccatggctgccgactgttttcttcacttccatggctgcatgattctgccagtgttgattggccttaccatcttcatcgccggtcgtctcgtctgctgctgactagtgccctcgcttctacatctggtttatacagctatcactactgatgaacatcatcgtcttccgtcgccgactggttatgttgtcgccgactagtgcttttattttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacatcaactctcctccaagtgaagcatctacaacagctataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgccacactgctattggctggatcaccgacatcgtcatcttcatcatgtcggttgcgtttgttgtcgtcaactacacaactttatcgctgagcgccttcatattcattgctggctgacctgactgccgccgactggtttcttcgcctccatggctatgtgacttcagtacttttgattggtatcactatcttcac

SEQ ID NO: 17611 - DNA, 1104 bp, Oryza sativa
ttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcgggaggccctctagggggcatgacacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacatattgcttgaaaaatattatgcattgataggatcgcacttaatctgcttgtcccgtctgcaaggcagattggcggacctacctaatttgttgcatttgacccttccattgtaattattataccatgttcccttgtatccacctagttgcgcctcggtaatcgtgcactcggcacgggtatcgacggtcgctgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgaagaactcttcctttgatgaatgattgcaaggtgagtatatgacatactcagcaagccacgcagcaaatatgcaagtgcacaggataacaaaggatggcataatagggttccatttgcaaaagcagcatttagcaaacatttgagaatttaacaaaacagttaagtaataattaagcaatattaaaccaacgctatacaacataccctgttgtataggcccaaccattctgaacaacca

SEQ ID NO: 17612 - DNA, 6284 bp, Oryza sativa
cggcgagaagagaagagcacggggatccttttaaaggggctcggaggcgacggcggaggcccacggcgacggcaacggcgaaggaaactcgcggcttggagagaggaaagccgatccgattcgaactcgaatccatcgatttccaaaccgatttagccgaagtttccaaaggagaaaaggtagaggagatcccgaagatcatttcccctctatcaattcagccggaaacggaaaggagcggccggattggaaagcggcggcgacggcagctcggcggcgcgaaactagggtttcggcccgaggaggacgacgggcctgacaggtgggacccacctgtcagcggctgcgagggcgcgcgcgcgcgcgggcggctgcggactgggccggctgggccgaggagagagaagagaggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattaaacttagatcttctcttcaagacttttaaaattatttctagaaattccaattaaacaacaatttatatattttgaattttcagggtgtgacaaacctaccccccttaaacagaatctcgtcctcgagattcggaagaactggcgaacagaagcggatgagctgacttcaattcatcttctcgttcccaagttgattcttcttccgagtgattactccattggactttgcaaaaacggataactcgattcctggttcttctctcacttgtttccaggatacggattggtttctcaacataagtcaaatcctcttggacttctatctggtcaatattagctccttcggtaggtacccttaaacactttttcaattgcgacacatggaacacattatggactcctgccaaagattgaggtaactccaactgataagcgacctctcctcttctactgacaatcttataaggtcccacaaaacgcggtgccaattttcccttggtatgaaaacgatgaactcctcgaagaggcgtgacacgaagatacacataatctccctcttcaaaactcaaatctctgcggcgattgtcggcataactcttatgtcgagactgagccactcgcaatctttcttgaatgatctttaccttttcttctgcttcccttaggatatccgttccgaaaacctgacgttctcccgtttgatcccacaaaagcggagtgcggcacttccgaccatacagtgcttcgtacggagccatctgtagactagcttgataactgttgttgtatgaaaattctgcataaggtaaattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaattgactgcctcgatcagacactattttcttagggacaccatgcaaacacacaatccttgccatatacaattccgctaagcgacttccggaataagttgtctttaccggaatgaaatgagccactttggtaagtctgtcgactatcacccaaatagaatcatggcccgatgacgttctgggtaaaccagtgataaaatccataccgatttcttcccatttccattcaggaatcttcaaaggctgcaacaaaccggctggtttctgatgttctgccttgactcgctgacaaacatcacatactgctacgtattctgcgatttcacgcttcatacttgcccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatctggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcaaaacacaacctaacccaagtttggatgcatcgcaatacacttggaaacccttctttggatcaggcaaagtcaaaataggagctgatactaagcgattcttcaactcttgaaaactctgctcacattcttccgaccacttgtacttcacatctttctgaagcagtcgtgtcatgggcttagcaatcttggaaaaattctctataaacctccgataatatccggcaaggcctaggaaactgcgaatctctgaaactgtctttggttgcttccaattggttacggattccacattactaggatcgacggcaactcctcctgctgagatgacgtgaccaaggaatttcacttcagacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggaaaaaaacagtggcacctttaagttgatcaaacagatcatcaatcctgggtagtggatacttattcttgatagtcacatcgtttagtgcacgatagtccacacacattctctgagtatggtctttcttttccacaaaaataaccggagctccccatggtgatgaactcggtctaatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctagaatgacatcaaggtctttggattttaacaagataagattggccagaaatggtactccttgaatttatattctgacagaggggctacgttgcaaagagagtgcttgatcacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagcagcgacatgatttacacgagccttggatgctggtacagcagagttattctgggtagggacaaccttcacgcgtcggggcttcggacacttgtcagcataatgtcctggatctccacagttgaaacacaccacgggcttgctgccttgctccctcttggcaggttgttgctgtgctggagctgcaacaggacgtggagcttgattacggatgttgttgccagcattgttgttgaagaactgacgttgcggacgaacaacagacgaagaacctccctgtggcatggactggggtcctaaagtaagacgcggcttctgattattcccctgttgtgtcttgaattgagcaatccgacgtttcttctgctccatgcgattgtacttgtcctcctgacgaatagccttatccactaatttctggaaatcagggtaatctccaaccatgagtgggtaagaaagctcatcattaagtcctcccaaaaacttctcctggcgctcttcatcattgcgcacatcttctggagcataacgagcaagacgattgaactcgtgcagatactccgtaacagagcgagatccctgagtaagcgacctgaactccttcttcttgagagacactactcccgatggtatatgcgtcttccggaaagcagcggtgaattcaagccaagtgataggttcagcagtagtcctgttaaggcggaagtgatcccaccattcagaggcagggccatgcaactgatgtgatgcaaatgaaaccttctcctgatcagtacactgaagtaaatccaacttcttctctatggcatgcagccaatcactagcttcaacaggattagtggtactagagaaaacaggcggcctcacacgaagaaattctgctaacttgttttggggaggtgcatgattattccctggttttgctgattctgaaattgctgcatcatcatgttcataagctgtgtctgttgagcaagaacttgggccagagtaggattctctccattgttgttattggggttgttgggaccattcccattgctgcgagtgttcaccatctggcatggacagggcacaagaagagaaaacgggggaaactacttaggatagagaattactttgacttttattgatcttaactgagtttcattattacaaactgaagactctcacaccactaaactcaccaacttcctaacactcaaaagcaaacaaacacatgcaattacatcccaccactgatgtaaatcacatgcaagacccacacacacacaagcaaacttaaaacaagcaaactaacacaacgatctaagacaacggcttaacaagtcactctagttcttccaagcatcggaggtcgattgaaggctcgttcggctcatcttcctcatctttgatagctacccactcaaacttggaattgttgcgcttgggttcttcttcttcatcactacttatgatgatgaccggaggatccgcttgagctggggcaacttctttctccaccacacgaacctttggcgccagttgatagcgagggacaaataaagctctcttccttgcggtaagacgaatcctggccttctgcggcggtgcttctcccttcaatgcggctaattccttttccaaacgatccaccttgtcttctaacttgcaaatcttaccacgattccgatcttcacgatcttgagctgctaacacagtctccgcacgactttcatccatagcccacaacatctcaaccaaatgtttcgtggtaacatcattctcaattccttcagtctcaaggtaactgccacggtcacttccctgaggttggcgaggatggtagcgatactcagtgtcggccaattgatcactgtagcgatcacggagctctcctatggcgatccttgccacctcctgacatgcatggatgtagtttcttcctccagcttcaaacattactgaggggacctcttcactattgctgttcaaggtgactttgactcggcacttctcttcatgacgatcatgaggaatctgggtataaaaaggggcagtcccgaatccaatgacaaaggacatcatacgcaactcctggacaaaaccctcaacaccaaacaggtactcaggcttgtaacgcggcatctaaagacaagtgaaaggagggagttaagacctttatccaattaatagcacagtttttggattaatttgaataa

SEQ ID NO: 17613 - DNA, 2967 bp, Oryza sativa
tgggaggagaacagttctacttttccaatatttttcagagggcttctatgggtaaccatttggcataacctagggtcaaagatgctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgaagaactcttcctctgatgaatgattgcaaggtgagtatatgacatactcagcaagccacgcagcaaatatgcaagtgcacaggataacaaaggatggcataatagggttccatttgcaaaagcagcatttagcaaacatttgagaatttaacaaaacagttaagtaataattaagcaatattaaaccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccttcaaatccatgtgctcacaacccaccattaccaggttttagttggcacattaattaattaactaatcacgattgaccaccgtgaactatcaataagccatcatgaaataatagtgagtcattagttatcccataagtgtactaatgtttctaagcagggctaagcaattatatctaatatctagttgaaccaatataaataaagctcaactagtcaaattataataacccaaggtatcaaggaataaggtaatcaagaacaaaagggccataacaatcaataggttaattccacccaatgacattcgaaaatagatgcaatagttgaatagaaacaatagctttaaataggatcaacatgctcaaagggttgtttgggatctgtgtgacttgccttgttggccttggaactcttcaaactcttcttccgcgaaaacggactctctggaaacgacggaatctaagcaaaaagaagcaaaatcaccaaaacagcacataaacaagcatgaacagttcatgtggatatttttaatgtgtagatctcaattttagaaaaatttagagacttgaaccaactaaatcggagctaagatgaattagttatgaatttttaaagattaaaccggattaaaacacttaaatcggtttaaaattgaattatgacgcaataatgaattatttttgaaaaggaaaaggggatttattgcgtcagcggctagggtttgggtggaccgggcgcacgggcggcggttcacacgaacggacggccgagattgatccgatccaaatcggacggccgagatcgatcgggaccacggcggttcacggcggacggccttgatgacgccagcaatgatgtcaccgatggcggcggcggctcggcgaggcagacgactcgagcggcgcacgctcaccggcgaacggcggcgctacggcacgaacggaggacaccaacgggtagcggacggcacggcgaactcaccgacgaccaaagcgacggcggacgaccaacggacggcaacggcgacgaggttgaaacggcggcggtcttcggcttgacgacggcgacgatgctccggcggtctccgacggcagcgaaagagcggacgaggacggcgacgacttggcgacgacgacggcgaccttcccgagcgacggcgacggctggaacgacggcggcgcacggctggagcggcggcggcgaaggcaaagctagggcacacggcgctagggctactccggcgacgagaggcgaaggcgagggtggcggcgtgtcacgaccggaaaacacccaacaggcgttcctgacgtgcgtgcattattccttgtcccaggaggcaaggtacaccaaaagttgatacaattcagagtttaacaagcggaagcgtatataaaattattacacgggcagcggaggcccaacacacaaagacaaacgagaaacagcggaagactagggcgacgaccacaggcgcttgacggcaggcacgagctagacaccaaagccttcatcttccaggaactcctcatctgggcttggggaaaattgagcaagactgagtacaaccaccgtactcaacaagacacacccacaaatgcagaataaatgcaagggagtacaagggaattataccataaaggggttagggttgcagtaaacagcatttaaagacatttagttgctcaaggccattttgtaaacacgatcctagaactatccaatattattaatcaaggccgtgaacccacacgaacctgccttaacccaaggcctatgatgattcagaccgaactggcaactcgaccctgggtcccagctcgtcctaagccaac

SEQ ID NO: 17614 - DNA, 1744 bp, Oryza sativa
cggtggcataataggccagccgtgcaggcggaaacaccagtcgtcggcggacgaggtggccggtcggtgaagacgtggatgcccatgaacggtggtgtgaccaaccaaccgtttaggcgaggacaccagtcggcggcgacggaggcaggccggtggtggagtcgtagacgcccaacaacggcagcataataggccagccgtgcaggcagaaacaccagtcggcggcggcgaaggcaagccggtcggtgaagacgtagacacccaacaacggcggcataataggccagccgtgcaggcggaaacaccagtcggcggcggcgaaggcaagccggtcggtgaagacgtaggcgcccaacaacggcggcctaataggccagccgtgcaggcggaaacaccagtcggcggcggcgaaggcaagccggtcggtgaagacgtaggcgcccaacaacggcggcataataggccagccgtgcaggcggaaacaccagtcggcggcggccgaggcgagccggtggtgatgttctgactgatccattcctggagcgtaagagataagcttaaagccatcaatcctttttatgcatatctggatctggatcctgcagaacaaacatataggatgagtagtatctgatataaatataatactcgagaaaaaatcaagtattttaaaatatttataaatatgtatttctcctcttgtcaattttgatttctccgagcagatgactctgtacgtttaaacactctgtccgactagtcataaccatcaagcatcgggagtcggcctaggcacttcccaaacatgcatatgagtgatatgagttcgtcattaatggaacaaagtttcacggattagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattatgaaaattgtttaaaaaatacgatataacttctatagcccccgactcactagtcaacggcgaaccagttgatgtagtgaggcaaaggaaaagacaaaatatcatataaagaataaaataaatgatgacttagctttgtcgtattccctcgatgacagcagaagtagccgatgtgggaataaagtcgtccatcaataacaatgaagacaccagtcggcggcgacgaaggcggtcgacggtgaaagcgaagatgcccactaatggcggcataataggccagccgtgtaagcggaaacaccagtcgacggcaacgaaggtgagccaacggtgaagatgtagacatccaacaacggcggcataataggccagccgtgcaggcggaggcaccactcggcggcgacggaggcgggccggcggtgaagtcgtagacgcccaacagcggtggcataataggccagccgtgtaggcggagacaccactcggcggcaacggaggcaagccggcggtgaagtcgtagacgcccaacagcggcggcataataggccagccgtgtaggcggaggcaccactcggcggcaacggaggcaagccggcggtgaagtcgtagacgcccaacagcggcggcata

SEQ ID NO: 17615 - DNA, 1676 bp, Oryza sativa
acgcccaacagcggcggcataaataggccagccgtgtaggcggagacaccactcggcggcaacggaggcaagccggcggtgaagtcgtagacgcccaacagcggcggcataataggccagccgtgtaggcggaggcaccactcggcggcaacggaggcaagccggcggtgaagtcgtagacgcccaacaacggcggcataataggccagccgtgcaggcggaaacaccagtcggcggcggcgaaggcaagccggtcggtcaagacgtagacgcccaacaacggcggcataataggccagccgtgcaggcggaaacaccagtcggcggcggcgaaggcaagccggtcggtgaagacgtagacgcccaacaacggcggcataataggccagccgtgcaggcggaaacaccagtcggcggcggtcgaggcgagccggtggtggtgttctgactgatccattcctggagcgtaggagataagcttaaagccatgaattccttttatgcatatctggatctggatcctgccgttgttgttatcagcaatggcggtggcgaagacaagccggcaaagtggactcgcggccgatcgaccggaaagctgagacgcctcgactccatgaccagcattaatcgcctcaatagtgccgcgtaattatatgcgaacaacaacaaaaaataacaagagattaatctgagattaaaaatcaatatgataaataatgataaaactaggcgtccggcgctggacgagtagttagcgtgagcagatataaaaaattgctcaatggaaaatattacataaaaaggaaaataaagacacttagctttgttctcagtgtcctcctccgtatatgtgttaatggatggacatgggatcatatcggcagcttgtgacagacatgcactgtatgtggaacaagctggattataccgaattgaaaaccatctgtatgtgcagtatggcttgtgcttgcatgctgcgtgctatgcgtgcgtgagtccgccagccatctgggcaagacccaacagatgccgactgcttgcatcaatataatggcaatgtgtagtggcagtcggacatgcaaatccagtcacgagtcggtgctgatggctgagttgctttaattagtcatggttgatcagatcccaagtcggagaagattttggaaataatcgtcgcgacggtcgcgtgggacttggcttgatagtgatcaggttcctccgatggcagggcatgtatttaatggatgatcttgaaccggtgatgtcgaaaactaaatcgtcgaactcccagagattgatcttagatggcagggcatgcaacgacgcaaaccttcgggcgtgttcatgcaacatctcgactgatatttcttttttaagattgatctgaccacaggatggtgtcgacgaacatggcgatgaccggatgagaacgaagccatcttgagccttcccgactgatttgaatctgagccagagagaacttgttgaagttgtcggcgacgaggaagcgaaaactcccaaagcgaaaacgaagtcggcgactcatgaagttgattccatcgcactcgttgataggaaactcgacgcaacccctacctggcgcgccaactgtcgaaacatgaattcggcaataataaaacggggtagcgcacaagacctaaagtggatggatg

SEQ ID NO: 17616 - DNA, 4915 bp, Oryza sativa
cactcgccggcgaacggcggcactaggacgcaaacggaggacaccaacgggtagcggacggcacggcgaactcaccgacgaccaaggcgacggcggacgaccaacagacggcgacggcgacgaggaggaagcggcggctaccttcggcttgacgacggcgacgatgctccggcggtctccgacggcagcgaaggggcggacgaggacggcggcgacttggcgatgacgacggcggccttcccgagtgacggcgacggcgcacggctggagcggcggcggcgacagcgaagctagggcgcacggcgctaggacgactccggcgacgagaagcgaaggcgagggtggcggcgagaagagaagagcacggggatccttttaaaggggctcggaggcggtggcgaaggcccacggcgacggcaacggcgaaggaaaccttcgggaagaacgaatccgagacgaactcgaatccaactcattccaaaccgattgagccaaagattccaaaggagaaaaggtagaggagatcatttcccctctattgattcggccggagaaggaaaggaacggccggattggaaaggaaacagcggcggcggctcggcggcgcgaaactagggtttcggcccgaggaagacgacgggcctgacaggtgggacccacctgtcagcggctgcgagggcgcgcgcgcgcgcgggcggctgcagactgggccggactgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggccactttttatattggaatttattaattaaacttagattttcttttcaagacttttaaaataaattctagaaattccatttaaacaacaatttatatattttgaattttcaggatgtgacaaacctaccccccttaaacagaatctcgtcctcgagattcggaagaactgacaaacagatacggatgagctgacttcaattcatcttctcgttcccaagttgattcttcttccgagtgattactccactggactttgcaaaagcggataactcgattcctggttcttctctcacttgtttccaggatacggattggtttctcaacataagtcaaatcctcttggacttctatctgctcaatattagcttcttcggtaggtacccttaaacactttttcaattgcgacacatggaacacattatggactcctgccaaagattgaggtaactctaactgataagcaacctctcctcttctactgacaatcttataaggtcccacaaaacgcggtgccaattttcctttggtatgaaaacgatgaactcctcgaagaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcggcacttccgaccatacagtgcttcgtaaggagccatctgtagactagcttgataactgttgttgtatgaaaattctgcataaggtagattcttatcccaacttccaccgaaatctagagcacaagctctcaacatgtcttccaaaatttgattcaccctttcagtttgtccgtctgtctgcggatgataagcagtactaaagttcagcttagaacccatctcttcttgaagtttcttccaaaaatttgaagtaaactgactgcctcgatcagacactattttcttagggacgccatgcaaacacacaatccttgccatatacaattccgctaagcgacttccggaataagttgtctttaccggaataaaatgagccactttggtaagtctatcgactatcacccaaatagagtcatggcctgatgacgttctgggtaaaccagtaataaaatccataccaatttcttcccatttccattcaggaatcttcaaaggctgcaacaacccggcgggtttctgatgttctgccttgactcgctgacaaacatcacatactgctacgtattctgcgatttcacgcttcatacttgcccaccaaaatctttccttaagatcctggtacatcttagtactaccagggtgaatggagtataaagtatcatgagcttctttcagaattgcatcctttaaatctttgttgtcggggacacagattctctcacccaaccatacagttccgtgctcatcctccaagaaaccaatagcttttcctcttctcatattcttcttgatctcttgaatatcaggatcattaatttgggcttctctaacctgatcaattagagtgggcttcgcttctaaggctgcaacgaaacctctaccgacaattcccaaatttaatctttcaaattccttgcataattccaatggcaactgtcgtccttctgtaacattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcgcaatacacctggaaacccttcttggatcaggcaaaatcaaaataggagctgatattaagcgacttttcaactcttgaaaactctgttcacattcttccgaccacttgtacttcacatctttctgaagcagtcgtgtcatgggcttagcaatcttggaaaaattctctataaacctccgataatatcctgcaaggcctaggaaactgcggatctctgaaactgtctttggttgtttccagttggttacggattccacgttactaggatcgacggcaactcctccggctgagatgacgtgaccaaggaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggctcctttaagctgatcaaacaaatcatcaattctgggcagcggatacttattcttgattgtcacatcgtttagtgcacgatagtccacacacatcctctgggtatgatctttcttttccacaaaaataaccggagctccccatggtgatgaactcggtctgatgtatcctttctgaagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatcttttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtccttggattctaacaagataagattggccagaaatggtactccttgaatttctattctgacagaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaatcacatctggagcatcttgagcttctgcagtagcgacatgatttacacgagccttggatgctggtacagcagagttattctgggcagggacaaccttcacgcgtcggggcttcggacacttgtcagcataatgtcctggatctccacagttgaaacacaccacgggcttgttgccttgctccctcttggcaggttgttgctgtgctggagctgcaacaggacgtggagcttgattacggatgttgttgccagcattgttgttgaagaactgacgttgcggacgaacaacagacgaagaacctccctgtggcatagactggggtcctaaagtaagacgcggcttctgattatttccctgttgtgtcttgaattgagcaatccgacgtttcttctgctccatgcgattgtacttgtcctcctgacgaatagccttatccactaatttctggaaatcaggataatctccaaccatgagtgggtaagaaagctcatcattaagtcctcccaaaaacttctcctggcgctcttcatcattg

SEQ ID NO: 17617 - DNA, 1716 bp, Oryza sativa
ttcttctctatggcatgcagccaatcactagcttcaacaggattagtggtactagagaaaacaggcggcctcacacgaagaaattctgctaacttgttctgtggaggtgcatgattattcccttggttttgctgattctgaaattgctgcatcatcatgtgcattaactgagtctgttgagcaagaacttgagcaagggttggattctctccattgttgttgttattggggttgttgaggttaggaccattcccgttgctgcgagtgttcaccatctggcatggacaggataagaagagaaaacgggggaaactacttaggacagagaattactttaacttttattgatcttaactgagtttcattattacaaactgaagactctcacaccactaaactcaccaacttcctaacactcagaagcaaacaaacgcatgcacttacatcccaccactgatgtaaataacatgcaagacccacacacacaaacaaacttaaaacaagcaaactaacacaacgatctaagacaacgacttaacaagtcactctagttcttccgagcataggaggtcgattaaaggctcgttcggctcatcttcctcatctttgatagctacccactcaaacttggaattgttgcgcttgggttcttcttcttcatcactacttataatgatgacgggaggatttgctggggcaacttctttctccaccacgcggatctttggcgccaattgataacgagggacaaacaaagctctcttccttgcggtgagacgaatcctggccttctgcggcggtgcttctcccttcaatgcggctaattccttctccaaacgatccaccttgtcttctagcttgcaaatcttaccacgattccggtcttcacgatcttgagctgctaacacagtctccgcacgactttcatccatagcccacagcatctcaaccaaatgccttgtagtagcatcattctcaattccttcagtctcaaggtaactgccacggtcacttccctgtggttgacgaggatggtagcgatactcagtgtcggccaattgatcactgtagctatcacggagctctcctatggcgatccttgccacttcctgacatgcatggatgtagtttcttcctccagcttcgaacatcgctgaggggatatcttcactattactgttcatggtgactttgactcggcacttctcttcatgacgatcatgacgaatctgggcataaaaaggggcagtcccaaatccaatgacaaaggacatcgtacgcaactcctggacaaaaccctcaacaccaaacaggtactcaggcttgtaacacggcatctaaagacaagtgaaaggagggagttaagacatctatccaattaatagcacaagtttttggattaatttgaataaggtttagaaatcaaagtagaagggaagtaaataaagtaaaccaagctttgcgagataatttgaaatagttggaaacaaggtcacaaattttgtactttttaacaacaggtttcaaaagaaagttataaaatcaacatactaaatttattttattgcagcaagattaaataaaacagtattgtaaaacttttgctggtaaatgagccattagtacagtaatagatgtacagtactaataacactggaataaattttcgaatgagaaccattaaaagagatttaagaagtgcatgtgccattagtt

SEQ ID NO: 17618 - DNA, 564 bp, Oryza sativa
cgggactaaagatcaaaacacactatataatccatagtaccgatcctcttttcccgtccacacaacaaactcctccctctatctctttttttcctctctaacttcttatctctttccttatctctaactcccctcctctccttccttttttccttcaccacagtcaggcggccggcgcggaggcggcgacgcaggggccggcgcggaggcggcctgcatggcggccggcgcggcagcgcggggggccgcgcggcggcggcggtgggcggcttggcacggcggcgcgggaggctgtgcggagacggcggatgcggtgggcggccgctcgtcggcaaccggcgcggcgctggccggccggcgcggaggggaggaggggaggcggcagtggccgccggccggattttttttcttttttttttgagatgtgaatctgtgatgtattttagcgtgagatgtgaatctgtgatgaattttttagaaccctgtgatggaatttttttaagagtttgtaatgtatttggagatgatttgtttgaggatttggagatgttctgtaatatgtga

SEQ ID NO: 17619 - DNA, 933 bp, Oryza sativa
  unsure (1)..(933): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgatcatagtccaagaaggatgtagtacagcaatgtgattggaagagctattagcatgccaaaaattaccctgtaaaaagtgacaatttgcccagaataaatataaacaccatccaaacaaaaatatcagcaagcaaaacaagcaaaggaaattgcttacgctgtgctcaggatggccgggtggacattgtattcttttgcaaaaacaaaaggcacaatcccttgtggtagagccgcctatcaaatcgaattcccagatatatatatcaatgagcattagcttcacatatactagtagtatataatgcacagggaaataaattgctcgaatgattgatactactccagtaagtactacctccgtcccatattacttgtctttttgagtttttttatcaatgtttgatcattcgtcttattcaaaaaattttgaaattattatttattttgtttgtcatttgctttattatcaaaagtactttacatatgacttatcttttttttatatttgcactgatttttcaaataaaatgaatggtcaaacgttgcaaataaaaagtcaaaaacgtcacctattatgggacggagggagtacatatgttccagtaaagaagctgatggaatcatatatacggagggcctgt

SEQ ID NO: 17620 - DNA, 5497 bp, Oryza sativa
ctagctccacaactctagtttattttgtgagagaactctacccagctccattcccagttctggtggagctgaaactgtttgactgagctctagctcagttctagtggagctgaaactgtttgactccaggaggggtggagctggagctgtgccaaacaggcccagagtatataagccagggtctgacagatcagaaccccgaccctgtatacgctgctggcaaagccaaacgcccccacacatgataagcttgtctaccaaattttataattggcataagggagaaattaaattatcactttgcacgggttgcttactgtagtaacttcttttagatgcatgcatataggactggtttggtttgagatctaaattaggcttaccaatatttatcaatttcaatagtatttagtgtctatttggtttgaagccaaattttggcatgcctaaaaaataggccatttcaatagtgaacttaggctattttggcttcaatccaaacacaactttgctttaccaaaattagtcatgctaaaacttgccaaaatttagtattgacaaaatttagtaagatgtatttaggccacaaaccaaaccaacccatagttacctgaacaatggcgacgtgcaggagcgtcccgcggagtccgatggcgattgacgcggcggccatgacggcagggcccgcgaggaagcggacggccatggagacgacggcggctgatttgccacacgcgatgatgctgggctgcagcgccatgaacaatcctggccacgagacagtttgacagcgttagctcgagcgcgggccagtgggcaccagtgcgtgtgaagagggattaattgcggagcaatgcggtgtagggctacgggaagacatgagcacaaggggcgtgggcacccacccaggctaaacatggccatccccaggcctgcgtccgagagaatggagatggacttctcgacgattgctggcatggagacgtgccacctgtgacccatgaacacattgcccgttggttagctcccggaacagtaaatatcaacatcattagccactagagatgataaaataacaacaggtgtgctcttatgatgattagtagtagtagtagatgcaggttactccaaaggaaacggggccaatcgttcatggttccttgcttggaaacgctattgtgtgactgtgtttggtagactggctcgacgacgaccagtgctcgcgcgccgtgcaaattctgcctttttcagctcctacagttcgcgattggtgccgaccgggcccgcggcggtggtccgtgccggcgggaaactcactcacctcgtcggcccaccaccgccgtttggggatccgtaaaaaagctgcttttcggttattcccaccgccacggcacgtacgcccccgggcagtttcggtgcttcctagcctaccgcctacgcgctacccactccctctggcttcgccgagaataatatcgctctcgcgcttatcatcaccaacaccatcgcggtcctcgatcctcgccgaacttgtcgtctctgtcgagtgaaatcaccttatcacccgaactaacttaggcagtagaaaaaatgagtaattgcacaggtcacgtgaaaaaggtaggttaatcttcggagagagggaaaaagaaaaaacggcgtaccggaaggcgacgagggaccaggcgaggccgaggaggctggagtaagtgttggggttgcggatgagcttgcgccacaccattatgaggatgaggcgtgtcatcacgctcgccggcggcatttggtactgccccgcgcccgcggcgccgccgccggcgttcggtccgtcgacgtcgacgaccttcgggtgcagctccgccgtcgagctcgaccccatcttcgtcagcccgtcaggcaaggccgcctcctcgtctactgcctcggcgccgtccaccgtcttgccgcctccgaagctgaagttctctccgccgccgccgccacccaatgccactgcgccgtactcctcgtgctctgaaaatgtagaaaatttgggaaggtctatgtttagagttgcacatggagcccgtgattaagtgacagtactactactgcggcattaatgtcgggacggacctttgcctgagccgttgttctgcggcaggtcggcggggatgaccatgtggatttccttggcgccgacgtcgagagcgccgccgccgccgccgccactgaacacaggcaggccgctgacttctgagacgggagacgcgctcgagctccacacgaacatgtggagctccttggcatcgtggttgagtgcccccgtggtcgttgccggtggtttcggcggccgtgccgagtgctcgtcgaagttggactgcctcggggttgggccccgcgacgattgcagcgagtagagctcggaggcgccgaagctcgagccgcgcaccgcagcgggcgtcgggggcggtggcccgccgccgaccatggcgaagaagtcggcgtggttgaagttggagccccgcggggttgggttccgcgacgagctaagcgagtagatctccgctcccgtcaggttcgacggccgcggcgtgaccagcagcgaccgccgcgacaccgaggaccggcgcacggtgacgtgcagccgcccgtccgccgccacctcggcctccgtctccgcgtggccgccctccagcgacaccacgtccgggtcgacgtgcagggacacgatggacgccgccgtgtccgggaactggtcggcgatcagcatccgcgcggcgcggaactcgaagaggaagagcatcagcgtgtaccagatgatgcactggagcacgacgatctggaccatgagcgagccggagtatggcccgtacatggcgatcagcagcgggatccccatgacgagcgtgttgggcagcgtggagagggagaagagcgtgatggaccagtccagccgcggcgcgccggtccgcgaggggaggcgcgaccacgcggcgagccccgccaggacgagcagcttctgcagcgtgtccgccgccaggaagcggaggttcatggcgtacgggtcgttggtggagatgaagtggaaggacaggagcggcacggcgaagatggcgacgaagcggttgatgccggagcactggtccggcgtgaagatgccccaccaccgcaccgacccgtacgccaggaacatcgccacgtacagcggcaccaccgccgccatcaccgtgtagaagtcgtgcccggatatcatctcctcagcctatctcaatccaacgcgcccggcggtggatcgagtgcctgagcgagctagaactagctagttatacatgcaggagcggccgagtggagtggcttcttgctaactcggagaactcggggtcagccacttataggctgcgtccaagtccaacgagcacagagttgaggagcggtctacattctcccgtcatccaggctccagggtggattttactgtaaaaacatgagagattttgaatgcgcgatcgtgactgacccaccagtgggcgtgtgcttcataagaaacgatcaatgtttcgctcggaggtgcaaattaagcccgtagttcatgcgcgcacatgtacaagctagcgttgtgatacacaatgcaatgggtaccgggggtatatagattgcatcttggcgatggatttgcatcactggatgcgaatagagtcatagaggcattgctgctctgaagatagatttgcattgctccgtgaaaccgatcgattgatcttatcggttatgtacgtggtgggctttttccgtgactatgcaagctgatgatcgagcgcgcgtacgggatactgcagaagttgtactgttggtttggtaccactgtctgcacttatccggctctcacggtgccccgaccgtccatgaatgtttggactcgagaacactagctactccagctagcagctactccctccgtactatattttgggacggatgtagtacaacaatacgtgtgaaagactagtgttccaatatgcaaataacagtagctcggtattgttgaagtactatagcaacaaatcaacaaagattggattagttaaactattgaaattgcgcattttagtgtcttcttggtttatacatgaacaagtgctatacaaccgaatggcgaatggtaaactcgtgcaagatcgaggggatgttccctcatataaatttttctttcaatttcgatataaatagttatgaaagattttttaaaaaattgacaatataaagtataatgatatctatcagtccaaaaaaaaacaagtttaaattcgacttacacattgagaaaaaaagtgacaaattcatatatgaacattatattatgctactattcatatgttggatttgtctcccttttttatatctcgatgtgtgagttgagtttagataaaaaaatttatggagttgtatagatatgttgtatgagtgttatcatatttttttaaaaagaaattcataaccgtttggatggtttttaattaaacgaacaaggcaatatcctcttgaggcatcaaaatagtctcccgcaagattacagaggtttgtctatggatcgccttcttgagagggccaacgaggtacattcttttgtgttgaatggctgaacggttaaatagctgaatgatttgcgaattactttagggcacaaatggatatatttagtatcataaagctgcatactggatttaaaactttttttatgaaatatatgtatgaattttttttacaaaaattgtaatgtttaagagcatgatcgagaagcgtggagtgtggacatccatccctcattctattccttaaaaaaataacaaggcaggctggttgctagcttgcatgaaagagaatgtggccgattgacttggggaagaactctattttaatgtattgcaaaagattgcgcttggctagtgatgattgcttaatcatatgctaagatgtacttatctccgttttcgtgggacaaaattttaaaatcttaataattcattaatatacaaaactttttatattaaaaaatatcaatagaattgtcatgaaatatattttcacattgatatagttttatttcgaataaacacctaattaacaaaaaaaatgtattaaaaactatttgatgtccaaaataccaaggaaaaaggaatatagggacaagggagagagtatgtacgtggtacattgtcacacccagattatgcactgccgtacaacaacacatgacaagggcgtgctgtaggaaaacggcgtaaaccgctccctacgagaccaagataccaataccaatcacatgacacaacattggtactcacagaaacacttatgaatcattgtgatccttaatttaagtggaaggaagcagcaacgacagctgcggacccaaggactaactcccaacaccacatgcaagcaacggttgtgaaccaagatgaaacctaattttcatttcacttcaactttacctttagagcagagagaactatat

SEQ ID NO: 17621 - DNA, 5174 bp, Oryza sativa
tttccccaaattccagtggcacgtagccgatatcatgaatagtagtggtatttatctaaaatggcatatttgtagtggcatggatacaattaacccttgttttaaagctttgaataatataagtgtttgcttttccacaacagagaaagacaaagtctactgactttccaagtttgcacaagtagcagagttggcctcaaagcgagtttcctgagccattccatttcagtactcctagagtcccatagttcaagacatccatttactttcatggacttcctaagtcccctgtctccctgatagccatttatttccagcccaagcatcacgtttcccaaaccacaacaatgtttcacaaagcacaatataaacaaaaactatgctaaggaatcacttcacatccgcccatgacccttctacacagtcgtttgaacaactagttaactctatagaggggtacactttacccccaagctgacgctactaactgggtcacacaacctgtgcagaacatccacatatgatgactttgaggctttcatgataaggcattttgaaagatgacacaaggttacctcatgccaactaaaggggtccttggactaacaacaggctagatcctagaccatgctagcaaggaatcccaagggttctcctcgacaccacctcgacgatgcagtccattggtattcaaggcttccctggcctagctagttccttagccgggagtgttccacttaacccatgtggtcgtacttacatgttcggatgtagtttaaaggatagtccttacgagcaaccaccaatgcatctcgcccaataatgaccctgtgtcgcgagttttctcataaactcatattctttcgcaggcactaacccacgtgtcagatttttcaaagctttttagaaacaagtttcacccaagttgttctcagatttaaagattgagggctaccgtcaatattcttacaaggttgcacaaataccaacatacaacaaaggtggttacaagggaacatgatatagctattatgaaggaaagataaaatgcaacagggttaggtaggcatatcattccatcttgtagacgaggcgaaacatttgcaagtgcacgccaattgacgcataatcaatttacaaacaacaaacttaagttcaaatatgggcacaatgtaacgccccgatttttgttcggaattaaaaatcatttaataatgcatttcctagaaattaaataaaaagttaagcaatttatccaagtgaattattgggagaattaaaattttccctttaaaaatcattggccgggaatattttgtagtattctttgtgccctaaaatactctctgaaatttcccgcgaatttttggagctcatgaaataattttaaaagcaccaagttcattttaaccaactaaataaaaagaaaaacaattaaaatctccctttctctctttgggccattttcggcccaagtcttccttccctcccgcggcccgcgcgcctcctccctctctcgggccggctcccttctcccttggcccgcttgcaaaagtctgttttgcgtccctccttctctcccttcgccgacaggtgggaccggcggtcccacctgtcagctcctcctcctacctctcgccggccaaccccaaccgccattgccgcccacgtcgccgcaaaatccggcgccctctcgcacccgagctcgcatccaatgacgtgggcacgatcccctgcacgtcctccaccattttcctcgctcgtcccacaaaaaccggcgccggccgagccgccatcaccccgcgtcggcgccccacttccccggcggttgccgccccgactccgcctctcccgtgctcgatccggcctcccctcccctatagaaacattccccgcatctccctctccattttccccttgtttcccgagcccggcactctctccctcgctctccccacgccgctcccgcgcgccgccacacttcggcgaactccggccgccgtttcccgtcgctagggtcgccgccgcactgctccgccgccaccgccagctttgccaccgcccgggcaagctcagccaccgctccatttcccctctccacctccgtagcgccgtagccacgtgaaccacctctcttcgccgccgccgccgactccagccgcgtcgcgccgccgcttcggtcgacgccgacccgcgccgttgcctccctcagctccgcaaggacgaggaggacctcggccgccgcccctcttcgccggaaatccgccggagctcctccttcctcggttgtcggtgagatccttctcatattgtcgcggtcggccgtcgttaccggtcaccccgcatcggtcctcccctccccaactccctcttctccttctgaaggtcaagggcgaccccgtccgccctccgtcctcgcaagccgccatcgggcaatcgtcgtcgctgtcatcttcctccgcgccggctgccgcttccggtgaggacctctcctcccttccttttttttcccgtccccctttcttgccgacctccgcctcttggggtgcgtcgcggtcgccgtgcgcgctgctgtcctccggccgcccgccgccgttccacgtcgccggctgctgccgccggtggccgcatgccgccgccacgccttggctcggccgggccggcttcgtgccgcgcctgtgcccctggctgccgctcccctcggccgcccgatcggctcaggccgatctaggccgtccacgtggtgacgcgcacccgaggccacgtgtggaccatgtccaccgtgcgccctccccctttgactcgctgacgtgtggggcccgcgtgtcggcgccggccgccccttgctgacgtcagcgaggtccttttcctttgtaaaaataaataataattgcgcaataattcgttaataattctagaaattcatataaatggctcaaaacttctaaaattcatatctaattcattcgaactccgaattgagccattcaacttgcaaaattcatctaaaattgagctctacatgtttgtttagtttttatgtactgttttcttggtttttattagagttttttctcgttttgcgtgccagcgtgtagaatccgtcgtttcggaagttcgcggtcgcaaggataagagttcggaagattgtttgaagaagcaaggcaagtcacacattccccttgagcatgttgttcccaatttataaatgttttaccgtttgcaaataaatatgcatgttttgctaattacatgggatcagggtttacctatctgctcgcttgtgccatgtttacttgatatctgtcctttgtcaaccgtgggtaataaatcgcctagcttgtgttactttgatgacctagctagaactatatgcttagccatgcttaattaccactagctcagtcaatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggagtgggtaactgcttgatctgaagtatagctcgaccctttcctaggcaccggtggcgagggtgggcgtgatggagttgggttggccggggtgtccggttgtccagctgccggattcaccgcggcgcaagaggggaccgcccactgccttttgaggggtgggggtgaaaccttagcgtggtgtggatggttaggggaaggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgattgaccagattcaccgtgattagtctcacacttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccagaaacccctccttgtatccccttgcatgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgcgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacacacaatatgttcaaaggtgatttgcgttgctaaggggcttcacaaatcttctcgaaaccactttcgaacgatttttcgacggcccaaattatacgcaaacagttgaaacctacacaaagatcaagaaaaagacatacttaggactagtaatagtgacattttgatatgtcacaattttagagaactacgggaggtggaaggagtcgaccagagctagagatatggattttgaaagtttaattcattttctagaacattggaaataatttattggattttcataaaggaatattcttaggaatattctagacagttcacttacaagtggggcccacgtaactagtgagagggatgcctagaagcatatccacgagcttcattttttaagaaaaataaattaaatccagcctttagctcgtgttcttccatgaaaaaatattacaaaagatcagcattaacattacacatcatgatggtgtaaaagttaacattgtttagatggaaaaatatttaaagcattttttttctaaatctccatccgtagttagcaatatttgcataattgtagtatcacgactgcaatatgccatgcacaatatttcttgttctatcactcttttg

SEQ ID NO: 17622 - DNA, 24688 bp, Oryza sativa
gggcaaaatcaagtgcaaaccacaataccctctcattttccaaaactttgttgacaaaactagaggaaactcaagtggaaaccacaaattcattaaggcatgaaaactacgtttgcaattttcaagagaattactaccaattaccatatatagggctagtgctatagtacgaacatctaaaaattctaagatctacattggtttcatgtggaagaaacacaaaattcataaaaagagtaaagtatactagcggtatcacaatttgtttggtgggtgcaattaagtcactcatcttgcaaattgctcaaacaagacacctatcttctttccaaggtgcaaatcacagaaaacatatgccaagtgggatgttcgtgtgctaagttagatgccatattaatttcattcatatacgttaacacaaatagaccaatggtctaatagtattgacaatataatctaatttaagaatatttttgttttttttgctaagcattatgcaattgtgttgactgaaagcatatgcatgtagcagcgcatgtaagaatacagaggttaatttgcttttttttttgcttaacttcaaacttgtaaccttgccttgcccatatggatcgcaagcgcatcatcttataccaatagggtttttaatttagcaacaaacacttcatgtgacatgtattctataatatttgcacccatgaaacaagttgagtggcttgtttgagtaatttataagattagtgactagagtgcacgcacccaccttacaagttttagtacccacggtgcattttactcttcataaaaggtgcaatgaagaggttgaaaacaacatttttcactctttctatgaaattaactaaaacgagtttatttttgaaattttacatcaacgtgcaacataacctctaacgcatatggtgttttttagaactttttaaactgtaatatatacagtttgtttgttgcatggttttcatgattacaccagaataataggtgcttttctacttgatactttcctcaacaacaccattatgaactgaagaataatttttttcatccttctagtttgagctttcaaccgcaactgtgatcaaccttcaagtgttatttcaacccttggaactacaaaatcttaactttcacgtttaatttgaagtgtgagactgagcacatgagttagctatgtgtgtggaattgaaataatcataaaatttatcaatatctatactaaataggcactgggaaagcaccaagattattagaaatacttttatgctgattaggtcgatctaaatatcatgattgcagatcttattaagagtttgttttaaattgttgggacccaaggtcacgaacaaaatggggataggtggggaaatacacttttcccctaactatcctcaaggtgacatgaacttgagatatattggttgacttatgttgccattgttccaatccaatgtcacatgtcttgctacaaggttaggctgtcttatattgccttgggaggtatacatgaagttacattagtgcccccaaaggtacatgcaaagttacggtaataccctcaaggagctgtaaaccctaggggtgttcctgtacacttggatgactctctggaccactagcgccatcttgcaagggcagttggagtggtcacccaatattttctaatggaatattcttgccgggttgtataatcaagccttctcctcagcatggcgtgtactacatgcccctcttgtaacaagctcgaataatatttgatggataaaacaactttccctgaactagacacgaatagtatttgatgggtaaacacaactttcccatgaacatacttgttaggcgttcgaggccatgtcttggttaaataggaggccaaccctttgttccgggtgcctgctacaacataaataaaatatgccaatggaaattgtcatggttatgaataaggcatacctcctttcctatgaattacgaaatatacggatatggtataccttcgtatatacgatatattcccatatatgataaggaaaactagaagatattatggaaaatatcctcatggactggtgattaaccgagtcctactcagagatgattgggtttattctatatcatgcaggtttattgtctccgagttctacttggagactaaggcaattcacggtataaaagacacaccccctgagaagttcagatcatcgaatcatagcgccaacacacccatcataggttatgaagccggaggatgcgaagcctactcgccggaagatcttgtcgaatcatctcgacaagggtctcgcatgtaacgccggattcatctgttctctgtgtactctgtggttttccatatcaatctcatataaactgaattagggctattaccttacaaggagtctgaaccagtataatttttgtctctctgttcgtcttgatgtcgtatcgtgtagatcctcgtaccaacgtaccccaataccctatttatccggtctacgggtatcctccgtcgacagaaatgttatgtacttctaattgaaataatgtaagaaggttataccacaagaatggtcccctgctggagtttgaggtagtattgcctccgttggtgttgacggaatccttcttctccttgtctccagtgtttgacatgttggtgaagacgaagtagacgttgataaatagtgagtagtcgagccttgcgctccccaaaaacctgatcgcccgcccgtccgtgcaaacgtcgcagcagtgcgtggtttcggaggcctactctcccaacgcgtatgcacacattcgtcgggatgggattaccgtagcagcaaccgccttggaaatggatgaaagtgtgtctcacttctccttagggagatcaaatccattctcattttatatgaggagtggaagatgaagtaagagtcatggaatgggaagaggaatagagtaactaattctcatcaattagccatgaaccatcaaccaaccatcaattaggtgtaattgatgtaggttaccaatggaataggaagagaaatagagcaactaattgtcatcaactagccatgaatcatcctccactacacaaccatcaaccatccatcaattaggagtaattgatataagttaccaattccctaatcaaatggattaattctcaaaactcatcatcccattaatatcccataagataatgaatacacatgaattcctagcataatgagccttggaatttatttgatttaattgatttaaatggatcaattacccaattaaatctaacatcttgtccagtcgttttaccaaatggcttgcttaattagaaaccactctagtttcttcaagcttgctactgattctactgaactaggattagtccaaaaacgtcccttgtcaagttgtcctggcttctagcttgtatcgcgaaataaagcttttgttgtgctagtaacagtgtgtaatagtgagactgccgtcgttttacaattgatacctatgctgccaacatttggtagctgcagcgatgggcacacaccatgcatatagtatggatagggatggaaacggtcagaagaatgctcaaaccattttcataatcataatttttttcccaaaaactgaatcggaatgattgtgtgaaatgataacgagattaatactactacaacactagaaaatatcataaacaaaattactgaaatagagtctcagagataacgtaccacaagaacaaggaggtcatagtcatatctatactacaaagtaacgtcatgtactaagcaattagtgtagatttaaagaagtaaataattaatttaaattctttataatgatactatagcatcgagaccgacaacacatggaggttatggtagcatttttctaattctaatgggttgccgatactttacacttatttgtttcggatgaaaatggtgcaccgttaaaacagttaaagaaaacaccctcccgttttccatcttgatttccagataagataatacagagtcgaaataaaatggctagtacagaacacaatgatagaaaactccgagccgtttttatccttaactatacatatcaggtcaagtccggccaactcctacagaatccaggacgggttggattgacacacatataaaaggctggtcttagaattgccgtctagagttccggtcttcctgaccgaccggctggcgagttcggtgctttgatctcgtgctcacttcgatccaaattttgtgcgtctcgtcaagtcactgcttcgaccccgtcactgctacccaattctcgcacggctgaacctagcttgtagctgtccatccgacgcctaacttagttaactgtcacgcagcaatgcagcatcggtagtcgccggccggtagcctggtaggctactgtggttgatcaacggatcgagctgagatgatatccatcccctggtacagactacagaggccgcgtgaccaatgtgccagttcaggggacaagaagaaaacgtaggccataagtgaaggaggcgaagcgggtagcgtccatcaagaacagggcaatggattgcgggccactggactggacaccggtccgggaccaaagaaaaatccacgcccacacgatggcacgagccgtgcagccgcgcatgccttgatgcgtcgcgtggtccgtccgtccggccgccgaggcgaggcgaggagaggcttggcggtggcgggcgtcgtcaaaaaggttctcgggaaaagtccgcgggggtgatttgtcgcgcgcgcccacgaaaatcgcatcacgtggcatgcttcggcgtccgtctgatcgtgtagcggcaggcccacccggggtcttttctgcgctttcgtgccatgatgtcatgtgtggtctcgctagcttctctctctagtcttcgatctcttgagctacgccaccatgccatccatggtatgtaggagaacgctacatgcatcgcatctcaggcataggcccaagttctggcactcatcagagttacttaggagagttccttagggttggttttgtttgtggtctaaaataggccttattaaattttatcaatgcaaaattttagtaagttttggtatgactaattttggtaaagcaaagttgtatttggattgaagccaaaatagcctaagttcactattaaaatggcatattttcttaggcatgctaaaatttggcttcaaaccaaatagacactaaacactattaaaattaataaatattggtaagcctaatttagatctcaaaacaaaccagcccttagggcttgtttagttcccaaacaaaatttttcgtgctgtcacatcgaatgtttggatacacgtattgagtattaaatgtagataaaaaaacaattacatagttcgttaggaaattacgagatggatttttcaagtctaattgtgccatgatttgacaatgtggtgctacagtaaacatttgctaataacggattaattgggcttaataaatttatctcgcagtttactaacggaatatgtaatttgttttttgttattggactacgtttaatacttcaaatctgcgtctgtatatccgatatgatataaggccatccccaacccagaaactattaagtagtttccatacttaccatgtcatatagacactgtgtatagaaactatgtatacaatggatggagtcttcaaattaaattctcatccaatcacctctcttctctctcctttatccacgtatgctcttgtttttatttggtacttgtgtagatatggtttcttgtatgagaaatgatttcttcatctttttacctctcttctcattgactctattgccacatatgatttttgcttatgtgacaatgtatttaatactatggaaactagatgacatagagggttggggatggtctaagggggaaaattttttgccaactaagaaagcccttacttggatgtgatacgaccacatcgttgaatcatcgaacaacaacgtggcagctcaccacggcagcggccagcgggtcgtgccctgtagacccccgattttggaaatcggaaatcttctgtgtttatccgtaccaatccctggatcagtagttggtacacacatatatagttggatcacaacatatcagagttaaaagagttaaatacttacattagggccaggtaggccaacaactatcagagaacaaaataatataagggcccggttaacatgccacaggcagtcgactgggaaacgagacctaaaacaagaccgcactccgatcatcttgttggatacgcaagcgtaccgacaagggcttctcttcaacactctcctaaaagatatataaatagcaagggtgagtaccaaccgtactcagcaagccaccataacaacaatgcatatgataaagggtatttcaaggaatggcttcaggttcttttgcataaagctagttttgcaattcttttcacaagtctaagacatagcatagactgatcaagttttaataccagtgttcacattaaacaacgacggttctgtccaccattcattgtgatcccaaggatagcttcccgccattgagtcgtcatggttttctgaggacgtccaccttccctcctcccagtaagtggctccaacagcataaaaatcatcatgcaatatcccatcccacacaagttaagaattttgagtctagccaagtgtaatacacgtcccggtgctcaataaccgcgagcacggctattcgaatagatttggtttattcacactgcagtggatgtacactttacccgcactccgcaactgcccaacacatgagcctcgtcccaacacatgagacgcgtcacggcaaagctttttgataacctcgcattggcagtacccgctccatgaactttacatcctcatgcactctaggcgtacacggtttctagcagtgagaggagttctggcgcacccgggaagggaagactcacacatgcattaagttataaatatgtttagattctcacatggcagtcctaccgatggggacaccactgtagacacccgcctcgcagtcctaccaatggctgccccaccgtagagtccctgcctcacacatcaagaaaccactatgcatggatactgcctccgctcagctatctactccgctaggtctatacccatacgagaagtgcggttgtacgggggtcgtttcatgcttaacttcatggctcggtccttaattgaccagggatggcactagccttttccggacatcacccaaatcctccgtctgccccagtcgaaaacagttgtttaattttatttctcttttcacaaatcatgttatcaacatcatggcaatgtgacgctcatgtctccacatgccgtatctcaattaccttcccaaaggtaatttcccaagcatatagcatttgataaatatgagtatgcatgattctagaatagcatttctaagcaattgttataattgactagggactcatacgtaaacatggttacgaaggcataaggggtaaataataatcaaggcatggcataatcacaagtaggatgttcatcattgcatgcaattttatttgtaaacaaaataatttcgcaattgggatcaacatgttcaaggaatagtgatgacttgcctgctcagaatcatccttattcttgatacaatcttgatcaaccttcacctcctggaagctgcatacgttgcctcacgactaactgatacacaaattctataatacgcgagaaaaactaatattcaacaacaagcaaatatgcacaaccaaaatacaaacgtcagggtcgaacctagggttgctcgtactattattgcttgctaggggattccaatcatgctaagggctaaaattccttaatctttctattttcatcgtggtctatttaggagttaatcgatagtgtataaatgagatatacatatggctaatctgtggtttagtcaagctaatgactatggaaggattatggctacacatgtatttatctaaataaagtggtcatatactagaggttctgttgtcggatagatttaggatcaatcaaataattacagtgaatcatttgtattattattttactgatggaggcattactttaattatgaacatattttacttgtcacaataaattatgaaaggataataattatccatgctttgaatgttagagttgtttaggttaaccatattatggttacagattatcccttaatgaacaatcctaacttacagttgaactataattataattataaggtcaagatttataactagtatttatccaccatacatgtttgtcatatactccttggtttaatatatgctaaaggtaggttattgttcttatgtgtgattttaaatggattgtacagtatatgtgatttaagtgggttgacaagtgattttactgtttgagtaattattggatgctaaccgactcaaccttatttgggtggttctatcataacaactctgttcctattcctcataaataaattaaagactcatctatgtgtattcatgtttgattgacctaattataaggctagctttattatttaaataatctataagtcatgggtttaattatacaacaatttaatagtactagtatctccctatacattaatttgagacatcatttaaaattagtttgtgtggttattacaatgacaaagcatgttagagagaaatattcttacatctagtactaattttatttgttagcacatttttaagttgactattatgcattatcttagtattaattatataccattggaaagcttatgaatttagataaatttaggttcaagtttcactcaaatccgagttaaaatgagagagttacgctagtttaaatattcaaatttgaattaatccgagaaattgcaaaaaggtactgttcataaatgatttatttttaatccgaagtctgttcttaacactaacagttgctgacacgtggggtcaaacctttactttattttccaccgaattaattttctaaagggaaataggatgtgctaatgacaagtggggcccacaacctattctcttctcttttctcgttctctctatcgtcttctacctccagaccgagcgggagcagcaggggagacgcggcgcgcgcggcaaggccggccgagggcgacccgacggtgaccaggggagggagtggcaaggctctggcgtccacctgccggcggtcacggcgtaggacggcgcaggggcgagcggcgccgcatggccgccatggccgccatggccgggcacgggtagctaggtgctagggcgatacggagggtttacgaccaaattggtgagggcgtgagcatctacggagtgtgggggttccattttactcactagatggagaggaggagctccgggatggcttgtccacggcgagctcaccggcggcagaacggtggccggaccggcacggcgacggtttctaattggcgaaattaaaggggactatagtttctacggaactaggggaggccagaggagcgaggacttaccgagggatggaggaacgacgaagttcgatgtcgcgggggtggagtagagaagaagatcccgtacgcacgctaggtgttcgacgaaatgtgtgtgagaaagagaaagaggcagagatggggctaggccttgtgatggcagccaaggtgtgtggggaggaagggagatgggaggggggtatttatagggtgtgggaagggtggcttaatggtcgacgcgacggacggcgcacggggctcgaggacgacatgatggtgcgcagggctcgagggcgacatgatggcgcacggggctcgagagcgacgtgatggcgcacggcagcgcgtggctcaaggcggcgatggcgacacgcggcgacgcgatggcgcggcagcggcgcacggggcatgaggcactgatgcgacggcgacggcgacgcgactggtacggggctcggcgcggcgcaagtgacggtgacggtgacacgagcggcgcggggctcggctcggcgcggcgcagccaacggcgacggcgacagcacgcggcgggttggagacggcgcggcgacggcgacgcgacatgacgcggcggcgcggggcgcgagttgacgcgcgacagcggcgcggcagggcgacggcaatggcaacaaaacggcacgcggcggcggtggcagagcgaggcgacggcgacgcggcgcggtgatggcgacacgacagcgacggcgccggtgcgggtggggctcgaggccggctaggacggcgcagtagtggggagaaagagagctgggatggctagaaaccaaatcgaacacctaggggctaaggaacagtgctagccaactatttctgattttagagggtactttgcaattaggaacttggtgcaatatcgatctacatatcgaattaaatactcccataattctattatatatagagagagcctagtttatttgaatgatcatcatttcatgtgtactcatattatggcacccacctacattattcaaatattttaatatttgataaaataggttaataataactttttgtttatttgattttaatatcttgtgcataattatttgtaggattaaatatattctcgtaaattatatctattacttaaatgtatattacatttaaaatgtagttcttttctttacttttttttatcatttatggtttggcaagtaataggaatcataacaaccagcatgatgcaaaagttttaaaaaaatttgaaattttagtgatttttattatcggaaattttcagggtgttacatgcccgaagccccgaagtccaaaccgagagtagctcgcgcgctgccgtgtcgaccgagctggcgcctccaacaagtccacggcacggggcgggagggaactgtattccgtgagacaatggcacgagaggcagctgcagaatatgtccctgcatgcctggggctatgatatgagctgtggctgtctctgagatctcactggcctgatgaaactctacatggtgcaatgcatatgctgatttgcatttggcgaatagcggaatagggaatcgcgtgcgtagtatattaatccgccgatcacttaacctaaactccaaaaggtgatcgtcgtgcgtacgtacgtacagcgctccggtctgttcggtcagccctcgcgaagcttcacggaaacaaagaaggcctcatgatcgggagatcagaagggaggaaaaaggataacgaggaaactgtttcgctttgtcctcacgcacacacgcctcatgcgtccgtgtttatcgatcatgccactgccctgctgatgaacaagttcttcaagcaagttacggtgatatgcgcgcgcccactctgcaaggagcagggaagtattggcggcacatggagcagcggaagaaaggcatttctttgaaccggatcgtttcagctaatctatcgcccatcaccgcatccgacgcatggttggatggaatgaaatggaattacatttacacgtccacggcgtggttgaaaccgaaaaactggatcgcgtgtcacaaaactcataatgattggactaactgaatgtcgatttcctagcgcaatgattcatcaataatgcctggaattggctccgaaagtctgaatatgaaaatgatggctggatgggactctatatacatatgtcgataaaaagatcttctaaaaatttatcagatgtaaatatattatgattgtagtataacttatatagtattacttatatgtaacttttaaaaatccgaagtggtggtcacaggtcaaattccctcacccgtgcctgcgttttttttatcctttctgcttgcacgaatctcgaacaaaaattaattgttaaatatttttgtgaaaattataaacaagttacaccaaaatttaccatatttacgtcagacaaatattttcaagaaaatttatggacatatttatagcaaaaccgggccggattagcaagcgcatggaaagaaaggctctcaacgaagaacctcgcatggaggcccaaaagtgcatcatcgtcggcccgtccggcaaacggcccatatcttgctatgtcggcccaaagaaccctcgaaagctagggctttgcggagggtttagccgcgaccccgttcagtcaaccgtcattccgtctcttgctctcaagcggcgtgcaaccatggcggccacggcctcctccttcctcgcccgccgcctcctcctcacccgccgcgtcctttcctcccccctccgccccttctccaccactgactcctcctcatcctcctcctcctcctcttcctccgacgactcccgtgcgggatctgatgcgggacccgaccccgagcagcagcaaccgccaccagcgggccaggatcagcaggccgccgcccggccgcgcgccggcgacacccgtcccctcgagaacggccttgaccccggaatctacaaggttggaactccttgatcccctctgggttttgattcggtgcgagctgacagcctgattggggattttatttttttgtgtgtgtgggtgagaatcgcgaaggcgataatggtggggaaggtggggcaggagccgatacagaagcggctgaggagcgggagaacggtcgtgctgttctcgctcggcaccggcggcatccgcaacaaccgccgcccgctggaccgcgaggagccgcaccagtacgctgaacgatgctccgtgcagtggcaccgcgtctgcatctacccggaacggctcggcagcctcgcgctcaagcacgtcaagaccgggtgagccctctgttgcctctgcagacgagctgtcacgtaaacgtagtgaagggccaattcctgatgtttgagcgtgacaacctctgatttcgtatgttggattagattcttaactacaatggttcaactgcatagctctgttgcaattgatttgttggtgagtaaagcatctgttatgattatacttgatatgattggtacttggtttccttggggtagaatttggtatattcctttagctctgcatgagtggggattggtagatgcctttttcttttgtgtcgatctattgacttgaacttactctacctctcatttgtgattacatcactgttctactgtattactcaattagtaagaagctaaatatattagtctatctttcgcagttgtcaatttgcatataagtgacatggtaataatattttaaggttttagctttgtacagttcctttttttaattctttggttgattaactccactaacacaagtaaattgtaccatttcaacatttcagttctgttctttatctggaagggaatcttgagacgaaagtgttttctgatcctataactggactggttcggcgcataagagaaatagctgtgcgctcaaatggtatgtttattgcaccattgattttgacttgtggcaaatattttcttgaaaacatgtactagtgcgttgcccatacctcatgttcttttaacaagttctgtctagttctcaaaaagcaatgctcataccactacagtacgttaagtagacttttcgctgtttccttttatttttcacgtacaaactacaaagtaatgtcatgttgcatatgagcattcagcgatactgttcaatatttctatcgatgttgtttagtcggagtatgatactttttttttccatacgaacaggccgtctcttgtttcttgggaatgattgtaatgcgcccaagttaggtgaagccaagggcgttggctacttctgaaactgaggtccactcgacatcaaggtatatcagttgataaaattgatttaaattagaggtatctcaactgtgcttagctttaagcgttcaacgtatggtgaagatctcagtagtggaccagctttatggaacaaatacagttggacatcattgtcgaaaccctctaataattgaacaactgattgtactgtataacttgattttgacaaaacaacatatgtggctgtgctatttattttagttctcccaaaatttcttttgaccttttgggtcagagaagtttgtgaatttgagcttttctacaataaaatggatctgtttactcaatagttgttctatgatgcttccagtctaatctgataacccccttaatacctaatgcggatgataaagcctatcactttttttttggcatctgacagtaaacaaaaatatttgaacaactacgggagttaccacatatctttctgaagtatgcttttttcttgtcttatctcacgtgtccatcgtaagagcatctccaacagtctctctcactctccaaatgtctatttggccaactctccatctaatttgacaagccaaactcgttgtttactccaacagcctctccatctaccatctccattacaagtctatgacaaatgggacccatacgtcagcctctactacccttcttccactctcttttccccacccggccaccccttctaccacctccagtactacttactgcctcctcccctcgcctttaccttggatgcggcgacgacggatgacgacggccacggcaactcgcgtgcgcgcaaggcgcggatgcgcgaggcgacggcggacggcggcggcgactcgcgtgcgcgcaaggcgcaggtgcgcgaggcggtggcggcggcgactcgtgaccgaaccagttcccgacgacggcgacgacgcatggccaccaggcgaactggacgactccgctggcgacctcggcggcgaggaagaaggcgaggctgtgcacgccgaggaagtaggctgcgccgcgccgccggcgtggccccggaggcgaccatggcggcaccgaggaggcggcggaggtcggcgcggtcggcgaggtggcccacggcaaacatggcggtgacgaggaggcggcggaggtcggcgcggtcggcgaggtggccaccgggctcgccgaggcggtgcgggccggaggcggccgcgcgactggaggcggcggcgtgggaagctggcgccgcggcttccatttggaggcgacgacgaagaagacaaggaggagcgtggtgggacccatggatggccagtgaatggcaagtggagtaggctggccaagtttggctagtgagggaagaaatttggccatccggatggcttggagagtgggatggagaggctgttggagtgggatttttgttcaaaatggctaaattttggcttggagagtgggatagagaagctgttggagatgctctaagatctgtagagtttgagggataaacaagttatcaaacctgcatgctaacaccccaaaactttactttctcacctgctgaacacgccttttctgtctcaccatcgcatatccagatatcatctgctttgcacatcagttaaatgtaatataagctcgaagggtatatatagttactttgtgagctaaaagttttagggcaatgcaactgattctgaagatcaaaccggacattctaagatagacaaaaagcccaccagccattctaaaagataaacagaagacgaacacattatgcttgtaacagaacaatattcttatgtctgtctaataaacaaaaggtgaatacactatgctcgaaacagccaattctcactgaagatgagcacattattcttgtaacagagcaatcttctcagacttgcctaatgtgacgtttcctcggtggagaagttggagcgctgggcaagaacatgtagataccaaaggacaggaggaaagctgacatcgaccaatccttctagaatctggacaatctctcccatcgttggtcttgtgttctcatcatcttgtatgcaccagcaagccaccttgcaagccctctccacctcttctaagttagcatctgcacttagttctgaacctagcaagtcttgaatcttcccttcagggagtctcatcgccactagcactgggaagaatgtccctgcaccttgctcaccttgccgatgccaatctgcatttctgtttcctgatatgatctcgaaaagcatcatcccatagctgaaaacatctgcctttgtggtgatagctgtgccgcttatccattctggggcaagataccctatagtgcctctcatggttgtcaaaactctgctgaaatcccttccgaggagcttggcaagtccaaaatccgcgatctttggcatgaaatcagcacctaggagtacattctctggctttatatcacagtgtatgatgaggctcctgcatttctcatgcaagtaagctaatcccttggcaattccaagagcaatctgatatcttgtcttccagctcaaagtcaatggagtgcttccaaataggtaacgatccaacgacccatttggcatgaactcatagactagcatcttcatggacctctctgagcaaaatcccagcaaccggattaaattcacatgctgaattgtgccaattgtgctgacttcagctcggaactgcttttctccctgagaaacaccatcaagtttctttacagcaattagtgtcccatcaggtaacgttcccttaaatacaggaccaaaagaacctttgcccaacctctcagagaagttttttgtcacatgctgtaggaacctatacctgaatacgaccaacgaaccctccactttgttcgcttcactcaaattcctcttcctgagaatcagaagtatgccaatgatcacaatgagggtgacaaggatagctccagcagttgaagccccaataacagttgccttcctcgttagctggagaactctgatgcagcgagccggatatggatgctatgccccactgaaccatcagcaggagccactagattgattaaatctccataccacaaagaacaaccaccagcgtaggaataagcggtacaagagcaattgttcagacaagcctgcttacatccatctgtaccagttgccaaaccccaggctttgtcaggcaacttagcaacagctagtgcatagaattcatcagctgttgtcttgctagagctattgccatcatattgtagcttagtgtttctcatgcaacctccactgggattaccatatcgccactcgccgttgtactgcttgctgaaacccctgagacaactgcagaaagtgacggcgttctcagtgcacatggcaaaagaaccacaaaggaagtacacggcgcactgtgcttttggcagtgccaagaagggcacccagtcttttttgctctccatccatactactgtttttacctggcctgaaatttccataataaacatcgctgtggcaatggatgcattagttcggtacacaaagtagctctcttggttgttaacggtaaatttgtagcttaaaacttctttaggatacaatgccatctcaggaattccagtaaacatattaccaatccatttgcccgtttcccagtagatggcagaattgttccatagatggatgaactggtcgccaccattcgggtcaatctcaagcgtataatacccaggtgatggatcaacagagcttttccatgagataaatcttgtgatttggccagtaattttgttccgtccaagcttggccccagggagccacacattggtcggttcatcaaaactctgccataggaaattggaggtattggaggcaggagctaacactaagttgcctgaatcaaggataactccaactgtggagttgacgttattagtgatatttgtggcccagatcaaagacctggcctggtcgaacaatgccaaattgccatcttctgatgctgtcaactgtgataagtttggatcagagattggagtcgcccgatttgctatccagacgggtgtggtctttgagatcttgttgtaccaaatagcaaggtaccatctgttaggcgctctatcatctgaattgttaaccactgagattataatagttttcaagaatgcactagacaaagacttctagagcttagagactagtatgtgtatctagaaagaaataacgaagataggtcttgcttcacatcttcaacaaatgctaactgctgcatgattcatttgttgtacatggaaatatcttcttctacaaattataatattttctctcttatatttccatctttcatataagttaaaatttaaagcttgtgggaaagtaacaaaaagaaggaaaagaattatgccatgaaacgagcatatttcggaagccttccttgtggatttcaagaactcacctatttctttctcacaaaaatatgcctactagggcactagccagatattcacctccaacctgaaagtatcaagtaaaataaaaggaaacatgtggcgtggcttgtagtttctttttttcccctaattatagccccccaaggctatagttttatactattctttttctattatatcaatataaaatatttccttcatcccataatataagggattttgaagggatgtaatacaacatagtactacaaatctagacatagggttttgaagggatgtaacacaatatcgtaatactagatagtgtcacatccctccaaaatcatttatattttgggacggagggagtattgtactatcttggggtgcaataagctttgcacataacatgttcaaaacatcaatttggtttgtaattactattgcaatacaaggatggcacactgtaaaactataaaattgccatgaacagtacttttgaaaaaaaaaacatattaatcgtgttaagtctgtaaaacattatacaagatatatgctaacgacagaatggaatatcatccttacgatatcccatcttgtatcccctataaaacattaccccatgaaatcttgtacggaacttgcataaaacattttttcgatagtagaagtcaatctagcctctacatccaggatatataggcatatagccaaaacatgcatagaaattgattgaactatttaaattaagactcactgaaacatgcatacgcctaacaaaactatatgtacctcgttttattttttgttttggtttttgatcaaaccatattgtccttactgcaattatacatataaaatttaggtatttccggggaaaaaaggtttcttgaaggactggaagaagcatagaactatgacgaaacatgcagaaatgtgggtgaaagctttctgaaaccttttgtacttaatgaaacccgatgagaattggaatataaagcagaggcaagataaactaatagctgaagtttacaatatgtctctaatctctatatcacttgttacttgctacagtagttgctataaaaaatacaaacgaaataggctgaagtttttgaagtggatgatagggctgaattattagctcatgtatatccacgtaccaggctggaagaaccccagcgcgaaaagtccgccggacgagataagcctttggccgccggagagcggccgattccgggagacggtgtcgtctgcccgcgcgcatatcagcagaagaaaacacggaaatatcaacgcgcccaaggaggcctccattagtgattggcttcttttgctgggaggaaagcaattatatagttcagccttgactggtgctactgtgccagaatagtaaaaggcgagactacggtggtgtttggaatggatagatggcacatcggacgttacgacactaattaaaagtgttaaacagagattaatgataaaaaccatttcataactctagactaattcacgaggattagtctatgtgatgctacagtaaacatgtgctaattatagattaattaggcttaaaaaatttctcacgaattagctctcatttatacaattagttttattagtctatatttaatactctaattagcgcatatgacaaggactaaaattagtctcctcatatccgaacaccacctacaaaagagtattccctgtttggttgctcgtgtagttattgactttgaggttttttttaagataccctagatatatatataggccgtccatttagtttgatccaacgcgtcagaattcgtcatacgcggacttccgttgctcataatccacgcacttcttggcttaattatctcttgattattgtttcatatttggagagaagatatccaaattattgcaccggcagatagctatgaacagcatcttcgtttttttttttcttttccttcttctctattcgattgaacaggattttgcaaaagcacgtacaatctatgatcagtaattaatcctcaaattaaacaagaaggttgcatgcatgcctgttcattctttcatgcttgcatgcaaacccgggctctaataaggactttttatgctgcaagctaggtttttttttctttttttgagaacaagctaggctgttactgttgttaatttgagagagatggcggctggcggcgacagtggcagcgctcgttaagttgggggccatgcgagatggaaagagagatcctcacggaattattagatttaataaattaattaattattactttaaccaaagatctaaaatatctatataaatcaatggtacttcctccgtttcacaatgtaattcattctaacatttctcatattcatattgattttaatgatatatatatatagattcattaacatcactataaatatggaaaattctaaaatgacttacactgtgaaataggtggagtatgatttaacactattaccattattagtaaaagtgtgctgtaaaaagcgtccggactccggagtttggagttcctctgctctgtacctctggaaaaactcggtaatacaaaaatagaatcattcgacaaaatttcaaatgggaatacgaatattcttattcaacgcagaaaaaatatatatcaaggagataaaaaaagcttaactaaattaattaaaccagaatttattgcagctgttgtttcttcttttggatcattgtgtttcctacgaggtgggtcgccgccgacagagacttctagtgtcgtacatgtacatttgttagtggcggtcagttctcagttttcaccgtagcgggccgggcaccttttgtcaactccggcaactggttgtttggtgactatcacagattcagaggctcgcagccatgattctctcaaccatgacggcatgacgaactctcgcttccggatcatccaaagaaaaactctagggggcatgtactatcccctagcagcagattgatagcttgacaaagaaccaacggtgcaacgattcattaattaacatgttattattattttctacgtatatctttatctctacttattataaaacttaaagatgattctgtactcatccttatttccgtccatagtccgactttagagctgggatgtcgtgcgtgaacgggtcacgcgatggagggagtatatacgactgaaataaatttaaacggtataatttttatattatggaatgaagggagtatatccgactgaagtgcagaagtattctctccttaaggggttgtttagtttaaaaaaaaaacttttcccaaaaagcatcacatcgaatctttagatatatatgcatggaacattaaaatatagattaaaaaaactaattgtacaattagggaggaaatcgcgagacaaatcttttgagactaattagtccatgatttagccataagtgctacagtaacccacatgtgctaatgacggattaattaaactcaaaagattcgtctcgcggttttcatgcgagttatgaaattaattttttcattcgtgtctgaaaaccccttccgacatctggccaaacgtccgatgtgacacccaaaaattttcatttcaccaactaaacaggccctaagccgcctccaagaaaataaagggcttcttgattaccccgagaaaccgaaaaatagaaccaaggccctctttgtttaggcttataagccaacttataagctgaaaagtctaaacctaaacaaacaagcagatttttcgtttggcttttttgaagccataagccattctaacactattaagccaaaagttaggttagagaagcttttttttttacttatatgagatagatgtatgactctaacactagacttaggttattaaatccactggcttataaattattatgccaatatgctgacttaaaagtgtaagccaataagcataagcctaaacaaagaaggcgtaagcccgaagtactgtgcactgtgacttacgtatagcttctgggatatttaagagaaaagaaattctccctccgtcctatttttagtacagtcgtgggtttctgtaccaaacgtttaaccgtctgtcttatttaaagaaattataaaaaaaatcaaaaacttgattcatgcatgagtaatattcatattttatcatctaataacaatataaatagtaattataaaataatttaaataagacggacaaacattaaacactaaaacccacaactgcaattaaattggaacataggtattattcaggcagttctgacgtcaatgtaccgcaccgctcagtttatgtacactgaacatgcggagaattggctagggcctgtgctgctgctgatgccgcgcgaggttaccgtggccgcacggtcgtggtgacgagcaggaggccggagctgacatggtgagcgcgagcagctgcatcctcaccggtggcgggggcaccaaccgctggtctcactggtagtcgtcgtcatcatcgccgtaagatcgagctcaacggagagagaggataaagggtgtgtttagttcacggtaaaattggaagtttggttgaaattggaacgatgtgatagaaaaattgaaagtttatgtgtgtaggaaagttttgatgtgatggaaaagttggaagtttgaagaaaaagtttggaactaaacaaggccaaagaatagccgtgttcgggaggtgaggttggaactcacctcccgcgcacataaaaaggagtgacatattttattatgattaattagatacttattaatatttttagaaaatagattaatattatttttaacgtaactttcatatagaaaccttttgtaaaaaataacaccatttagttgtttgaaaagcgtgcgccggaagacgagatatgtgagttgggaaaggtggggaagagagaagagtgaaggaggaatattatatagtcgtcactataagtgagctcttacatagtactccagttcctttttcctaaaataagtttattcttacctatttcacacgtattactatgaaatcaaaaaaactataatacctctgttttaccaaacctcaatgtagttattttctattttatctacttgcagagtatttattttctaatttcacaaattccgataaagtgattacttaaaaaaatatatttgagtgtaggtccttcctatttttaattgttttctttatttttgaaactaaaatgccttgtaagtgttccatcacctaaaagaccacgtcaaactgccacaagtgatccaaatcgcactgatattattagttgaggatgagatgctctgtatccgtaaaatgatgtgaatgaaactcaattgaagggatgtgtagtgaatcttatccctttactttatattctattaatcctaaaataagtttagctttcatctatcctacacataccgatacaaattcaaaaagactagaatatccctattttatcaactcccgatataatgatttctcattttcatttacacttgatataattattctctattttcataaactctgatgtgatgattacttaaaaataaacttattcggaatatataggagtaggggtgaaaacggtcacggaaattaccgatcgatcgggcgccgtttccgtttaaggggtaccgtttccgaccataccgtttttggctatttttaaattttgttttttctaatttctctctgcatcgtattaatgtcgatactgagtagtttaaatgataaatatagtcaattaccggctgatcgagcatcgtttctgaagagatgctaccgatttctaccatttccgatcgtttccacccctataggaggagctaaaatgaacttattataggacggagagagaggtaacttgatgttgattttttcaagatttttattgtcctaaccaaaataaatcacgagagtagttttattgtcctgtttggaacaggggaatttaatccccccggcgaggccacggtaaacctcgcccgtcctttagctaactgcactcaattaacctagtagcaaacgatcccattgtaccgcaactgcacgaacaatttaatcctgccatacctagtactgtagtattgtggtctgtgggtatcacacgatacgcctcccatctccgatgaatcccccgttgatgtacctatactcgcttcctgtgtccgtgaggatgaggattgaggtcaaggtgagagcgcagattacacaacgggcaaagactcgcttcctcaatggctccggcctccggctcccaggaagcagccatcagctgtcatatcagtgctacacctgctacagtatactactactcctccagtgggcagagtgacagaggagcagtgggctagggagtagggagacctccactagcaatgcagcaatggccctatttagttctaaagtttttttttttctaaacttctacatttccattacatcaaatcttatacacacaacttttctatt

SEQ ID NO: 17623 - DNA, 6846 bp, Oryza sativa
gtcagctgccttgcaatcacaatttgatcgtcaattcgtcattgtggggacaaaaactctgtcctaatgtactttccctgcttatcctattctcaaggctatcaaggtattcaaggtttcaaggaggcacttggaggcatttgggccttaagacacgggtaggtagaactcagcatgcatgcgcaagcctttgaattccaagggggatcactttagtttaagcctttgctgagaacgatatttggtaggagtatctggtagagtactatagtttcagactttcagtccacttcaagacaccatgcagaattagctaccggtgagaagcaactattctaatcgaagtcagcagtgatccaccaactaattgagtttagtcactcgatgctcacctggaattcacctaaattcttgcccggttcattggttgttgccatgtttcgtgtgtggtgtccacagattaacgagcagtcaacctggcgacacggtactcacaaatcacaatctgtagcattcgctcactactcatcactgacttaatatattactcgtcactgacgacgttactgtaataaaattatactagcatgcttacataatatttaagatataataattattaatggatgataatgtgatatttttacatactaagctttagaatttatactacggagtatgttgtaacttattaaagtaaagtaggataaacatatgaaaaaaaaaaccactttctgcagaaggggacagcaatacagcacgagtgcgcgatacaggaaaaaaaacagcctattcagattcaacactccaactaaaacagtgggtccgattagtcaaatcaattatgcgaggcaaatgaactatctggagctcaaagattttacggttattcccattcgtagcccggggcactaggcattttcacgaattaaatatgaaaacatattgtccattcaattttttttaaaaaaatattcgggatgcaaaatcttttgcacaaatatactatcggtctcacacaaccattgcatgaaaataacgtgaaaatgacgtcgtgacttgtatcacacagtgaaagtcgctcaagcaaacagcgataccgcaagcaatcaacgctatcgctcaagcaaatagcgataccgtgccttgccgatttaattagcggttaattatcctagttagcgattaatcactaatcagaataattaatcactaattattattagttaattgttaattaagtaattaattactaatcaaatggatctcattggtcagtgtcgctgattgcttctgcgagaccgaccgaatggtctcgctcttccattccgcgagatcgtgcgcgagaccgtgcggtctcgcgctttcgccacgcgataccgcccgcaacgtcatcgtcatatcattttcgcgtaacagaagtgcgacaccgatggtatatttctgcacaagtttttgcatcccgaatatttttgagaaaaaattgagtgaacagtataattttaaatttaattcctagtcactgcatgttcatgagttcatcccatgacattaggcaacatatatatatatatgctcacgacaaaatcgatccgttaataccttccatgggatgtccgtttatatacatcgtcgaaatgcctggaaagtcctataagatatcactaaacttagcacttcgactcataatatattattccctccagtcataaatattttatgttattgcaatatctatacaacttcaaaagactggtgacagtaaatctaacatcccatcctccattgtgcggctttacagttttttcaaattggtcatactattctctaatatttagagaatgtctcactatttgattcaaacaagttaaatgaatatcatataattaaataaacaaacacgtgattaaacattttacaaaaactaaatattttttgggcatttagctattcaatctgtctcaaatataacatgtagattttaaatttggtcctaaatataccaagctagtactcataaaaggtgagttttaccactataaactacccatattcatccactactccttccgcctataatataagggattttgacattttgcttgcactgtttgaccactcatcttatttaaaaaaatttgaaattattatttattttatttgtgacctactttattatccaaagtattttaagcacaacttttggattttatatttgcacaatttttttaaataagataagtggtcaaacagtgcaaacaaaatatcaaacttccttgtattatgggccagagggagtatcatttagctttattatagccccagctagtccaagcatgcacctcatacactccgagggaataaccaagttttttttacctctctccttaataattgtgtcaaaggctaaaacttactatattttagaatggagggagtagtatttagtaaaaaaaattattatcggtctcatctcccaagtggatacccccaagcttctacggtccgcttattgaggaatagatataggatggatgttcaataaggacaggtcatcgcaaagaaaaactaatactgcctccctcccaaaataattgtaattctaggttatttagcctccctcataaggtttgaaaagaaagactatgatgtccctcattaaatggtgtataagtaagagtggaagagtggttgagggtagaatagaaagaaatttgaatgagaagtaattgatgggacaactagtactctattgtgataactattttgggataaatttgaattgtagaaatacaattattatggtagaaagagataagtgagcctacgagtctacgactaccaattccatcggacttatcaaatactcggtttaaaaagaattatgtgcatatatttgcctcaaaaagtagcataatagcaaaatttactagatttcataaacttattattgaaaaatataatagtatgttttatataatgtcacaactatattaaaaaaatatgtgaaattaaatgggaaatggttatgattggttgagacgagagaataagtgaagaaattgaacatgcgatgattgcgattgcttgaaaggatgaagtagatgtaaaaattgatatataaaaattggcgaccctaaattcaaaagtttactgaaggagtaataattacgaatttaaatatacaagttattgacttttggtcatgatgttactattcatctttttttaaaaaaatgagtacaagttatttattttgttgtggtttgttttatagttaaaggtacttcatgcctgaactattttttcccatattaatgaaaaacattatatccaaaatttaagtcacttggcaaccatcaggccatggcgccaagcacgccatcctatatcctaccacctccattttggtttcaagaaaaccaccttcattttgaaacataaatatttcttgactattactttttgatcttaaaatgaacaaatatattactgtttacgacagactaaacctattcggttgtatagcaaaagaattttcataggtgtattttgggatgaaggtatagctagctgtgagcaactgactgaacatttatcaaatggaattgtacataagttgaaaaaaaaaaagaatggtagagccacatttctcctgcacgactgcctggcccatgccctctctgctataatctgcaccctgtcttccatttcctcatcaaaaaaacacaacaaaacagaacagaagcagaccaggtagcagacaaagccaagagtttctcacactcctcccatcgcttctcttctcttctcttctctcctctcctgtctgctcagtttggtgggttctgctcaccagtctccccccgcagtacaaaacctccattcctcgccgcctcctcttccactcggaaacgggtagtagaaaagaacacaccgcggtcacacacactctcttcagcaacaaacgatgaggaccatcatggcgaggagccctcacgagtcatccttctccttctccaggaggcacttcaagtggccagttcttggcaagagcagcagccatggcgccagcaatgcaggggaggacgacttcatcaaggcagaggacgacgaggaggccaccatggccttctcctccacctgcccgtcgttccactccgaggacttcgtgtcccctccgccctgcaagccgctcaagcagcagcagcagcagcagccgcagcagcagcgcaggaagggacgcacggccgtgtcccgcctgcgcacggcgctggccgcggccctcgccggccggcaccgccaggtcgggctcggcgcccggctcaccggcacgctctacgggcaccgccgcggccacgtccacctcgcgttccaggtggacccgcgcgcgtgccccgcgctgctcctggagctggccgcgcccacggcgtcgctggtgcgcgagatggcctcgggcctcgtgcgcatcgcgctcgagtgcgagcgcgccaagggcggcggcgcctgcgcgttccccaccgccgccgcggccccctcctcctcctcctcctcctcctcctcctccagcgccggcggcaggaagctggtggaggagacggtgtggcgcgcgtactgcaacggcaggagctgcgggtacgcggtgcggcgcgagtgcggcgccgcggactggcgcgtgctgcgcgcgctggagcccgtgtccatgggcgcgggtgtcataccggcggcgtgcggcggcggggagggcgacgtcatgtacatgcgcgcgcggttcgagcgcgtcgttggctcccgcgactccgaggcgttctacatgatgaacccggactgcggcggcagcggcagcaacaacaatggcggcccggagctcagcgtctacctccttagagtttgatcactcgagcgtctcccattctcacgttttcttgtatcgtgtcagttcttgcatgctttgttgtttcctgttgtaggctagtagtactttagtaggtagtgtgacggtatgagtggttctggaataatatgcatatggaaactgggattgaaatggaattattttttctttcttttatgtttttttgggcactttgtttggtgcctaggagttattggactgaggtgttcgatcatgtgagtttagtgtcactgacgtatgggtctatagcaaagaggattcacatatcagtaactgaaagtcgtataatttaagtcgaacgagcttaatctaaagatatcactcctatatacagagaaagtatggtaagttctttagtaaacagtactcaagaaggtctaggacgtcattttctaatccagtgatgggtgatctcaattggtattgtactagcgaaagatgattaagatcttttaacttaagttatgtgattttgagttactaacatataagttatgtgattttgagttactaacatataggttctttttgctacaaacctagagtcagtgaacctagagtcaggtgacttagaggcagatggtccttctcctccaggctccagtgaaagaagggagatccagatatcaggaaggagcagggatgaccggtgaacagtgttgtattatccagaaagattatgtgatagtaatgattattatcgaactgcatcaattgtctttgttctcatgcatttgtctctgccataatgtgggaccgacagaatgccggactgccggagtacatctgttttccgaagttgtttttctaatcactttatttatttattatgtaaatcactttatttattcgtaagcttaattttcctgtattttactgtcaaaattgggggtataaatatgaaacccgtggagtgttaaaacaagatagagcaaggaaagactagattcataaagaaacacttagctatatgttccattttaaatgagtgcaccaaacagctcaattacacccagtcaatgaaaaattatgtttatgaatctgaatatgggtctgtctatataggtatatacctagtaaatattgagagctactatacatacgatatgtcacatacgaagctagtacgatgttgtccagctgtttcctagcgatgcaacaagtaaggttcaccatccgttagtaatcgtacgagaatcgtacataacaatcgtaatcgtacgagaatcgtgcataacaatcgtatgcacagctagcattttcacaacttaagtttgtttaatttgtgttttgttgagttgtgatcagtgaccgcttgagattgcggcgcaggtagctagccaatggccgcgaatgcccaatgctaatgtacaagttaatgaatagaacttttataataaaatcatagtacatattattttttttctattttgttgatttttaacatgacatttaataattcatgttattacaaatttagtgcaaatatgaaggaatataggtcatgttcaaaatatctttaataattaataaaaacacatcacaataaaacaaatggttattagtatttattgtatttttaaataatatgagtggttaagtgtcatgtgtaaaagttaacaatgttatatatttaaaaatatattgtaatcatctaagtttggtatcttctttattttgtgatagtagctagtcaaattggtccacattgtttagtggtatgttttgatcataatactcagggttaagaggaagcaccggtaacgatggactcatgcagtcatgcttacactggtggagaaatgctttttagtcccggttcgtaacccccctgtagtcccggtttttcaaccgggactacgaatccgggactaaagatcgctatctttagtcccggttcaaataaccgggactaaaaatcaatctttagt

SEQ ID NO: 17624 - DNA, 57275 bp, Oryza sativa
  unsure (1)..(57275): unsure at all n locations
tagtcccggttggtagggactaaagatcttcctcttattaaccgggactaaaaatcatttttagtcccggtttttaatggaaccgggactattgtggatatggatcgaccgaccaaagatggtttctctaccagtgttacatgactccatatacttaggatatatatttgaaatatattaataccgaaaatttgacacccaaaaaaaaaactagtataatacacccccaactatcgatgttggacacttaaccatctttgagttgttttgctatggttttttacacgtgggatgccacgttagcccttcgcaacattgaatgaaatataataatacattaatagtttaatacagcgtgtaggcctgccttctctctcacaccgtcacatgcattctctctctctctctccctgtttatggttctgtaaagtggacaaggagatgacacacggcaatgacggtagggttctcgccgccggcataggtggtgcctgagaccggcgcagctgaaaggaggcctccctgttctaccaacttacctaagctcttacgcatgttaggtatttccatgttgattattcacactatgaaatccatcttgccacctttctaccacactcgcatataacagctagagaataatcaaatgtcccctctctgtatcgaattggaggtggcttgcttctaccttgtctggagaactacgatgcagatcgtaaagtccttcccgtgctgccatttccaaagctggtcatgtccctcgatctacttgttccgtcgttcacggattccacctacttgcccttgtttcctccctgtgtggagattcttgttatgtgctcagccctctctattagcgaccgcatacagctgcttcggttggcgaccgtgcgcaacgtcttggatctgctccttccccatgacacctcctccgccgactaccgccacaacctgttggagatgctccttccccgccgccgtgcaccgtttccagtaggcctcctgctatcccctacgttcatagcgctgatgccttcgaagctccacgccgccgttatcgctgcttgtgaaaaagctaggtcaaaacgaaccaaccaagcaatatgggcttggcctatattttcctatgcgctaacgtgatgaagggtgacgcagcatcccacgtgtacaaaaaccacggtaaaacaactcgagtagaaataagtattcaacattgaaagttgagaggtgtattatgcctgggtttgtagttggggagtgtatttttgacaaatataagaatttaggggtgcaaaatgtactttgctcacattctataactacaaaatctatgggttgttcagatcgatgtcatctcaaaccataccatcctttggtaaagttaccaaaattgtgcatccatttagttcctttttttgacaatttagtccttttagaaaacttattttgaaactaaccctcgccaaaaactttaacaaaaaataggccgtgggctcagcgctagtgcctttggcgttgaacccttgcccacatggatccacagatggcgtggggtcagcgccaatgcatttggcgttgactcccgtatacctgttaagtacgtgaagtatattttgatatcatgtagtgcagtggtgaagcccatcccttgacttggtgacctgggttcgaaccttgagcttgcacctttttttttcacttttctatgggtaacagagaaaaaccaaaaaaagcggttaaaccgctgcactatgaagaaatcatgacaaagaatagcacaatgtctaattattacgtacatggggttagcgccaaacacttaagcgctgacccatgccacgtccacaaccaactatgctagcgtggcaaattttagtgctgtactatttggtgctgagacgttggaccttagcaccaacaggattggtgttgagtccacggtctatttttagttgaagtttttggcgagggttagttttgaaataagttttttaaaaggaccaaattattaaaaaaaggcatttagtttcttaccaaactcttgtaaacacataagaaatccagccaaaacttagcaatattgttaaatttggtcaggtttatttggctacaatccgaacaaggctgaatatctggtgagaaatctggaagctgcgtggctagaaccagggtttacgattccgacgaaatccgatcggatttcgcgaaattttgacatttcgacgagactcgaaagtagaaaccatctgagatttcgaggaatttcatccaaatttaaatttgaattgataaaaaaatcttataaatactatgatattcatagaacctattgagatataaattttcgaaaaaaaaatgatgtattgtgtgtatttactaaaagctacatcaggaaagaaaagaataaagaattaaaaaaaagaaacaaattaccgatcggaatttcgatgatttcgatcggaatttcgccaaaaccgaccggttttcgagaacttgtcagcaaactcaaggatttgtattcaaattttattcaaattttggtttataaaatttgttcgaaatttaccggttttccaccggatttcgtgaaattccgaatttcgccggtgcccgaaacggaaggtcatgtcagaatcctaaaccctggctagaactagaggccccttaaaccattgatgcaatacctgtagtgcatattggagcatggaacagtcggaaggggtgtgacttgtgagaggtgaccggggtcgtcgtctccgaaggatcctgcttctctgctctggtaagacccgatgggtcgaatcatggcgcatggaaggacagctctctttaaaacctgattggtactccgtactctggtgtgacctgcttgtgcttggagagatatctttttcctcggcctcctcccctttctgcctctcgcaaggtgattgatgtcttcatgaatgtcagatggtggattcggcacaagcgactccacagatatggattcccttctcgtttaccgggccggtacttcgtgctgtatatcatcagatcctcactgtttacctcttctctccacgtacgttggcttatccttctcttttcactgtaatcacgttttgttccgacgggtcatgcaaagcagttttacacaacaaagcaagacgcttgatttcagaatgcatctcaattctcaagctcccatctactgctcccagaatcgttgcagttgcagagctgccgctaaactcaacttctgaactcatatggttcaaaacagcaacactcactaacagtttggaacttctgacagtatatacagtggttttctattcttctctgtcagtctaacagggcgcagtgcctacttcttcctcgcgtggattcgtgctaaagctagtaagctcttggtcttttcggctaggtaagacaaggcgacattccctgcagcttatacccactaaaagcgattaagcctctattaactaagcacgcaagtgatgatggcctcatgctatcattcgatgggggctcgcccaggacagcatgcggcgcctacccatgaactcctgcccggctcggctcgacagactgcatctcaatccattcaatcagcacaaagctgagaggaatattatcagataggacagagctaattagcgccttttcaacggaaaagctcgggggggcttgttcgcacgaaacagcagcagtaatcatgtaaagagcaccacgccaactctagtattagcactgcgtggctcacacgtgctgaatgtacgagagtctgaattgaattgtgcgccgatgaacctggtgctctgattacaggccgggcaacgaattggaaagggagaaacgatgtaggcaaagctcattgcaagctttatacggtgttcacgagttgatccccacctcaatgcactcgaatcattggcacattgggcctgaacctactcgtcaatggcatgagaagaaaaaaagggtattgcataatagtatctgatctgaaagatgctacaactttgaatcatgaaatggtccagtaccaatgctttacgatcaaaatttgacatttttttagcagaaagtgattaattcatatttgacacgagcattatatcaattaaatgcaatcactcaccatcttttctagataattcaagttggcgaattcagacaaaaatcaacacatacatgaaagacaaataaattgatgcatcgtgcttacaacatcaagtgaagtgccgactaggcaagtaggacccagcacctaccgatcgaccaccaccaatatcaagatgttacttgcccttgctttctcttgataaatcagcagctgcatgagcagccgcgctagcactagtattgctagatgcacatgcactagcctgagcttccagatccaaaatccatgatagcacttgactacttgtagtaagaaaataagaaaagaaaataagaaaaaaaattacagatcaagcatgggaacttggaaagccaagccagaagaggagatttggctcacaggggaacgaagagaagtatactcgtgcttccgtggtgccaccggcggcggcagcagcggaggcggcggccaaacggcctccgcctggcgttggcgcatgcaatcttccgctgcgcatagctgcgatgctgttgctttcgcgtgtggcgatgacgacggcaccgggaccgtgcttttactcctgatgactgtagtaaaaatttctacggcagccatggagtggagctgtgctgtctgtcacttgcttttttgggggacggagatgcagaaattgatggacccgtcatgattatagtattattattgcagtcacttgtgtcctgtgagtcgagccgtcgagcggcacgattgatgtgatggccaatgtacacatgactactcctgctcgcctctctttcggtcttttgttcgtcgggccggagaggagaggagaaaagatacgagatctactcttctgtgtactctagtattcaatccgcgtcaaaataaactaattttaagaatatagagtactatattttagtattaaaaatctagatatatgtatatctaacatatccccaaatttataatagaagtttattttattttgggatggatgaagtactccttaatgacgcgaggcacaagcatcgtgtgaggttttatcgccgtaagagcaagttcaatagtatagccaactactagctccaattcatctatagccaatctaatagcttatttatacaatagttacatactacactattaatacctggtcccatctgacatacacacactgcgtcttggagtccgtgctatagctggctacaaatctgtagcccgctgctcttctctctcctcatttaattccttaaaatgtatttgcagctggcttatagcctggtattgaacctgctctaacaaggaaaagatatgggggcactaatccatttcctcgctggattttcgggaataacccagatccgacaaatggcactctgctcagcagatggatgggtggtgtaagtttttgtgtaatggtatagttatatcgtacgcactgctgcagtgctactgttcatacgatgaaaaaacagctcggtagcacagccacaaatgatgctcttagttgtaggctaacctatacccgtggccggacgaaaccgagcagcaatgcggagtaacgtcgggcaacggcccacaaactactatcgtcgcagaggcatacgagccgaaatattggggaggcgctgtattcacgtaaggaaaaagtacaccaaaggtccccagcttgtcatcgagttccaaaatcgtaaaacctgatacaacacatctccaaacttagaaaaaccagtacaaactatgtccctcgacggttttgactttgattttgtccgacgcggcagccaactcagcgtgggccccacacgtcagcctcttcttcccctccccctctccacctctcttactctctcctctcctcttctctccacaggcagccggcgggggagtggctctgcgtgggcgcggccggccagcggcaaagcagctccttcccccgcccccgcgcccaactgctccttgcccctcgcgcgccgctccttcctcgccgcccagcccagctgctccccgccgcccgccgctcgcatgcatctaaggcgttctacacgccaagaacacccacgtcgcccgctaccgccatgcagctcctctcccggccgcccacgcctagttgctctctgccgagtgccacccatggagaggggaggagagaggaagagaggtggagaggggaggggaagaagaggcgcggcaggggaacacgggggctgggaagggccttttggtggcgacaacgatgcaggagcaggtgtcgttagcgaccacacgagccgctgcatgtgcagactcgccaacggcactccccgtcataactctgcctcggcctccaccttcctcgccgtcgcctgcaccgcttccccaacaaggtcaccatcgacgtcgccctatccctgccgccaccgtcgccgctggacgaggcaagagggtgaggtcggaggagcagcgcatcggccatcggacgatggcggctgcccacggcgaggtccccgtggaggcggtggtggccgattgtcacatcctgaaaattcaaaatatataaattgttgtttaaatggaatttctagaatttattttaaaagtcttgaaaagaaaatctaagtttaattaataaattccaatataaaaagtggccagataaaatttcattaaatactttgcttaattctataattcctagatttttctgggatttatttgagctaaggaagtatttttaataaatggaattgcatttaagaaataatttaaattgaaaaagttttaaaaagtcttcttttggctttgggccgaaagtcggcccaaaaccgccttctctctcttctcggcccagtccggcccagtccgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctccgggatctcctctaccttttctcctttggaatctttggctcaatcggtttggaatgagttggattcgagttcgtctcggattcgttcttcccgaaggtttccttcgccgttgccgtcgccgtgggccttcgccaccgcctccgagcccctttaaaaggatccccgtgctcttctcttctcgccgccaccctcgccttcgcctctcgtcgccggagtcgtcctagcgccgtgcgccctagcttcgctgtcgccgccgccgctccagccgtgcgccgccgtcgttccagccgtcgccgtcactcgggaaggccgccgtcgtcatcgccaagtcgccgccgtcctcgtccgccccttcgctgccgtcggagaccgccggagcatcgtcgccgtcgtcaagccgaaggtagccgccgcttcctcctcgtcgccgtcgccgtccgttggtcgtccgccgtcgccttggtcgtcggtgagttcgccgtgccgtccgctacccgttggtgtcctccgtttgcgtcctagtgccgccgttcgccggcgagtgtccgccgcccgagccgtcttctttgccgagccgccgccgccgtcggtgacgtcatcgctggcgtcatcaagcccctctcccgtgagccgccgtggactcgttcgatctcggccgtccgatttggatcggatcaatctcggccgtccgttcgcgtgaaccgtcgcccgtgcgcccggtccaccaaaccctagcccgctgacgcaataaatcctcttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgcttctttttgcttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctggtaatggtgggttgtgagcacatggttttgatggtcgtgctcatggcaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattataaaagatgctataactggtaataatttgattagctcctggtttggaatggtacattcctggtttggagatagaactgtgcagccggggtggttgttcagaatggttgggcctatacaacagggtatgttgtatagcgttggattaatattgcttaattattacttaactgttttatcaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctttgtaatgacattctattcgcttatcaattagagtaatatttgtactctattatcaatttgttattgtgtgcctcggctgattcctggacgagggttcacacacatgtaagcgtttggaattttggatagaaattccgagcgtgacaccgatgcatggaggaagaggggcagagcccgtgccatctggctcacggaggatggctggcgccccggctggtgacgggcacaagcacctggctccagcggcaaggccctccagggcaccgatcggcgatgacgacgtccagtgcggcgtccaacggcgaagagcccctctgtctccacactcgcccacgctgtcgcctttggcttccgcttctgggttggtgccggcctcccctcccgcgtcgcagctgccgccgccgtcgcctctccgccaccacgctcgcctgccaatgccgccttgctctaccgccgccctccctttctcctgtgtctccgccgccgcgtccctgccgcagtatcgccggccggccgtcgacctcctcaccccggcgacctcctccccatcgtcggccgacctgcccagtgcagagagaagagtgagagagagagataggggagggggagggggaggaaaggagaggaagggagaggctggcctactgacatggcatcctgacatgtggagctcacgtgggtcccatgctaactcaatcgccacgtcggacaaaaccagggttaaaatcgccgagggatctagtttgaactggttttgtaagttgggggatgtattgtatcgggtttcacggttaggggacgattttgtaactcgattacaagttgagagaacttcggtgtactttttttccttcgcgtaatgaggaggtggcctgaccaggtgtggatgcggattggagggtccatcccgcgagctggtggaagtggaaccgtggaagtgagatagcaacggatgtacacctatcggaatcatgaaatagctatggtcatagccgttattttgcactaaaacttgaaacgggaattgtgctgttagaacttgtgtttttattttaaaaaagggtgccattctttacataattaaccttaacaataattcctcaaaacctgaggttttgtgaaattcactctaaatattacggagtactgtatgtaagaatttaattccaagatagaatcgactaacttgtgcgtgctctctaaatattacggagtatgcacgctctctttctaagtttgctcgcctttctcgttgcgtgcaagttttgcatcaacacgtagaacgacaatgagctaaactagcttgcctcggcagcttgcatataatttgaattagttttgtgctatcgaccaaaatcaccaacgtaaatcaccaatttcgactaacgcgtgaacggaatcgaatctcgacagtacgttccaagttcctagacaagctggagagtctccactttgtgttcatatggactctccactttagctgtgtttgttcatgctaaaatttaaagtttggttgtaattggaatatatgatgaaaaagttgtaagtttgtgtgtgtaggaaaattttgatatgatgaaaaaattgaaagtttgaagaaaaactttacatctaaacacggcctttgtgttcattggactcttgctcaaaacacgtaagacaaatcgaaccagaaagcaatttgttcgttttgtgtggacggcatctgaatctcacggaagttaattaggaatatataattcgatcagggagttgcatctagggtgaataaggatatattattattctgttcgatgttcgtgtgcgccaaaatttccgaagtggactggaaggctccaaatcaaaccctcaatgtgtaactacaattttattccgagtaattttcctcttttttttcccttcagatgtacaagaaatctgcgtatcattatagtcatctcataaacacccactaaagcaaagttaaaaacatgagaacttgtcaaagaaaaaaaggtactacgaccagcaacctgtacaaacatatattcaaggtcaaatactagtaaggcctttggtctaccattctttgagtacttttgatttcagctaacttcaatattatgatcaagtactacaaaactacaaagattttaacacatggcaaataagcgtattatggtcctaaggtttttacaaactacaccgtataatcaaatgtttttcttatcccaccatgcttatgatttatgaaattaatccaaaacatctacaatatgagagttttaatcatctaacttaagtgtttttatttttttttcaatagtagtagttaaattgattaatggtgtggttttgtgtaactcagtgctaaacatatgtggatttgtacaacgccgaactacgatactccccagtcccaaattataagacgccccctttttttttagaaaaatcaaactcggtatattttttactaatgattatactaaccatatatttatgttaagtattatgcatgttatattactagattcaaattttaaagtattttcacgtgatggtaatttcatattcattgaaaatacaaaatataataaattaatggttaaagtatatcattgaaaaaccatgtaaaaaattataggccttataatttgggacagagaaagtagattagtttttgtgaagttctactcatttctttcacttgatcataatcttatggcacgcaagctatatagataagaggttccaactcaagaaatctgaaaccacattatgcacacccagcttgttatacataggaataaaagcgacaccaattttgttacaactggcacagcccaccttaatcgtataagaaaatgggctgcagttgggcttgtcctgatgagctgcattggcgtggtttggccctgttgttcaccaggaaatactacatgcaggcatgaagcaaccactacgaaaaaacaagatcatctgccgcaaaacgcactcatactcgcatggttttctcatgtgttagcatccatattctccgaagtgtgcgtatctgactcgacgaataatggaactcaactatttccaatagcaaactcacgtccggtaactctgcaaacctagcaagcatccaattctgtaaaagctcccccgttgcatcgtgccatcacttgcctggacaagcaacaataatacaggggcgcctttattcctgcacatctaggatttgtactctgcacacttgagagagatcttgcatatctagcacgaaggcctataaataccttgttgccatccgtttccagttcatcatcaacaacacagctgcttaagagcttctgagccttatcccagggtcaggacagaacagagcagagaagcatcagaagaatggcttctctgaaggccgtgaaacctgccggacttgccaaggagccggctgccaagctcagtgagacggcgacgaagcccgcggccgccaagggcggcgtcaagaaggctgagcagaagccccgggagcccaagaagaaggtatagtactgcagctgatccaaatccaacttgatgttggtaatcttgctgttgttttcttggcagcgtctcttcttcgtgttgatttagtcatttggctattttcatgtgaaatcaggtgaagagcagcaagccggcggcagccaaaaactgatagtggcaacaggagagatggagatagtacgagggtctccatcttacgctatgctatgggattatgaatcccgtctgtcccttcctctcgtcaccccgtgatgtcttgatcatgtagcagcaaccttagtcaagctggtcttgacggtgtgtgcagcccatgtgatgaatattacaaataagatggtacagttgtgacatccgcttcatattttttcacttggtgttaattctgtttggattccatcactgagaaaaaaaaacactgaaggtttcgcctgaaaaaaaaaactcgagaaaataaacccatcatgtaagaaagagcaactatgaacaaacacgtatggggaaaaaatagtaaagatcaagcaaagcacaactggcctagctaacagcaaaactgaaaattcactacaaaaagaactacaaaataactggcagcatatatgcgagtacaaaagaaatgaactttgtgtaacttggaacagaacttaaggactgggcagttgctacaatataccgattgctgtcgggaacactgcaaaagtgtcttgctatatcaatctaagtacagcatgagcttctagattagctagatagtaatattatctgctttactaaaattacccatgattacaaggttctacagtagaatataagcatggttacaagccttgagtgatatactgatataatatacaacactatgtacaagaagagaaaaaagatgtggtttccaatcatgtagcttccacttctattcaataccatctacaagttccgcagagttctaaagtgccaaatgcccatgaaaggaggtttagcttgcctgatcccatctacaatggcttcgccaataatcctttcctcattaaggcagaaaatgcacatatgtactttgcattagttagatatttaatgtacaaattcctctgcaaaaatctgcatccaaacatttccaaataagtataaatttcattaatatgcaaataatccaatagttggcataaatacttcaacgaattaatggacaaacgagtagtgaacatagaaattgcaaactgttactaaaacagtttggactagcaaatagtgtattttaaatataatattcacaaacaaatgtagaaccaacctcaaatccctcaacaactaaattctcaaactgccattgcacatatggtggtcttttaaataagttcaccataatatcaccactcagatagggaaaaaaagcatctggcctgtttgattacacagaaggtggcacaaagacttttctaagcatatcgtggaaaatgatattccagttctaatggcctgtttgatttgaggaatgaggagatcgattgaccacttgacaatgggttgtttggtttaacgaatgaaattggaccatcatctcatccccaaaagtacatatttaggccctgtttggcacaacaccagatcttagatcctttctggatttagagtttgttagttaaacaatagtggtttgaaattttatatttcctataaaatacgaacaaaatgattcatccaaatgctaatataatcacagatccagacccatggattttctacccagctctaaaaattgatggatctggaactgtgtgagtaattgcaccaaacttgtaggataatcccatgatggataacccatcctagatggtctgattcctcaaaccaaacagccatagtcccacaggccacaggatcatagtttcagatttcaactctacatgcaagttcggtttctattttagataagtaataaataaccaatggtttacaagtcggttgtattgtcattgagaatagttctgtcttttaaaacaaaatatcttatcagagtcccttaacagaagatatacagcttagaaacaccaaaatactgacatttgaaacttaagcgccacttataccttataattttattagaataaatacaaaatcacaactacacaaaaaataatagtgattacctactagaatggactaaatcgacgggccagctgtaattgccactcaaacaccaggcgccttggagctggtgccagagcaatcttttcttgtgtaatttcatcatcaacatgaataatagacaatacatcttcaaccaatggatctcttccaccccgaagaggatcctatggaaagatgtaaagaaacaggttataatcaaaggaagtttaattgaacaactataagaactcataattaaatgatattatagtcccacagcaaaaaaaaaatctatatactttcaaaagactgtattataaaaaaaggtttaagacaaaaaaagatagcaacgtgcttttattatatatcaaaaaagaacgcggcagtataataactaagtatatcttttgcaagatcttaacatctaactcaaaccagattccaaatgattggtcaataccagttcctcgttagtgtgtgataatccaggacagctgggatacaccaacactggtagttcaaaatggtcagcaatcgactggaaactggtaacttcatcaaaatttccctgatgcttttttcattttaactattttaaaatctcctaacagtggtaacgtgagtacaaaacttaacactacttagcctaattcagttagaacttagaagtcagaaatcggtgagatacggcaaaaaagatcatgacccttgccataaaacattgcacgtaactttaactttacacatctaagtctgccgatactaatagagcttgagaccagaaaaaataaattcattatagccattccgcgtatattacctgtataaatatatctgtatgtgttttgccttcgtacaactgtaacttggcttgagcaccagcttgttgaaggacgtcagcaaaagtttgactgcatacaaaaaaacagagtaactggtatcatgaaaatggaaaacattatgccagttcaacaaggggtcaatcaacaaatgatccatccactacacagaacaatcttacagtacatggcaacaagaaccaatatagctgaaagcatgtttataatagaaaaacaagtagcacaacaccagtaatatttgtttctaacagtttaacttctgaactattnttgtactagtgttgaanntatgggaagacaaataatggttctccaataaacttggccattctatacaatcannattctcctatttacaagtannctttgaattaaattctacttgtccttttgaactccagnnatttaatttgaaaaatgcccaantataagaactttatggctccgnngttcttatcttagaanaaacttgcaaatgcttttcttcaattctctgctctgttatatccacatttaggcttgtaatagccaagatgtaaaaagacttcatattcatgatatgctcatttaagcttctaatagacaacactggaaaaggatggagagtataagggaagaattggggcattagagatgttaggcatgctacatcttggtttacgccttcatcaatccagctttttttcaacttagattggcattgcttcctaaattcaagtgaaactggacttagtaaataaaatttcctttagtaacacctgcatgtcatgccataaaaaaaatggagggtagataggtataggtgaagcgtgcatttgctcgagtttgtcttgtgtcatcttaaatggacatctgcagaaggcataagaagaaacctggcagatgatggtattgaataatcttcagttccatgcataagaacaatgggaggcagaagagctattgtctgggaacttgactgcttgacaacaatttccggagaataacgtgacaatgactcctctccttccattatgctgaaacagttattcaaaaattttccttaactgctgtttaaacaaaacaaaccactttccaagcatagacatattactacctgaaaaatattgaacgattaagaccacgttcatgaaaatggtcaaccaaactatgcatgttgtatctgctccccaaaaaaaaaatgttgttagtgcttccaaattccaatgtatgcttagtattctatcagaataatccgaaagagaaaagaaaacaattgaatattggaggctggtgcttattcgtaatatggtgataacaatcatcataattcatcttcaggagataacttttgaagtgtctatcaaactccacagcacattgagaaatgatttatttgtttgactaggagaaacaatttactccattagagatttatatgtaatcacattgaattgatggtcaactaaaatcagggtaaaaggaggttgatataataaatcataaatatgcacaatgaatcattgatagttttatttacaaatcctgaatgtcaaattgaaactgagttaagcagtttggtcgaaccactttcatattggcacacatggaagcaccagcaaatgaagagaatggaacaaagaataacttgggggagaattcatagggtttctatttacatgttagtaacaaatacaactaacccagatgatgtgaaatgatgaagactattaattatttcttatttaagattagttcccatttggatgcactcccattgattcacgtgccaaaacaaataaatgcaattacttgtttgaagattggaagaaaataacatgcttccagtgtttgatcaaatatgccgaggacaatatcttccagagaaaacggccaatatgcccgaaaaacagaatatctgacatccaagtgtgaattttaaggatagcaaaaattaaataagaagttggcagactttttgttgcttgctgccaactcaatgcatataccagtgttgcagtaataggaatattcacgcaaaaaaaaagctaataaaaacgaactgcaagctcaccctccagataaaccaaaatatgctttgatttgtgtaacactccaagaaatggactgcccactagattctttcactgcctgctcgatgagggcacatgcagcaatatgtgctcctgctgactgacccaccaagtagatcctacaggtttaacataaatccataagtatgtcatgaaggagctagaatttgctgtttttatatagcaaaaggttattctggaggaagttacttatgaaggactaatgaattgaaggagcaaggacagataataaacagaattatatcaatatatggcttgacaatatctacacaaatatgaagaaagaaaatatctacatgaacatgtgatatttgctactttacctagcatgaagagtttaagggtaagcaaccaatgccataaatcaactttctttttctaataataattctaggaatttcaaggaggctatcaacagacattgctatgtaaatgccaaaaaattcacatgcaaacttgacttcaaaattttaataacagttctgtaagaacctttcataataaccttaatagaaactgaaatagttgttatcttaccgattaggatcacctccataactagcaatgttgttgcacacataagaaataccctgggaagcatcgctaaccatgtcacctattgttccttgagggaaatttctgatataaatgtacaacgttgtattaaacaaataaatattgccaacagtacaattcctcattagtaataaaatgatatagtattgattcagtggagtcatcagcacctgtaatcaatgcaagcaactatgattcctctctcagccaaccgcctcccaagaagggaaccccatgccttgtaactaaaatattttgtgcaaggtcatcaacaaagaaaagccaatgaataccgtggcgccttgttgcaaacttaacacttacccaataatccaagccccaccagttacgaaggccaccactgggcagggtctgttgatatctttgggtatgtacaaatctagcctgttcaatgtaatatttatcagtttcaataacatacaggaaacagtgttcttattttattttattgatgatgatgttacctgtttcttggttgttctccatagactatacttctacgaacctgacttgagaagaaatagtaatatccaactgtgaaccaagaaaggactgttttagaacgttgtagggtaattaggaagagaaatcagacatgccatattcttttctgaaactgtgttagggtcaggtttgaaattctgaaaaaaaattatttgccagttggtcctggtaggaagtgtctccagtaaaaattggtcaaaataggtcaaaagtcccttttaccctttcctgttcctctcatctgaactcttccttccccttatgctagacaatattgccccgaaccacgctcaaaccaagcaaaaattttgttcggaagttcaaacaaagttctgaatatttggaactatgtccatccgtcttccccccccccccccatcctgcaggcatcaccaccgtaattttcttctttttttttgcataaaaccctaaggcatcatactcttcatgcgcaacacaactgacttgaacaattgagtcaatagaactgcatgttatctgcagcataccttgcaaaaaacctggcataagtaaaattgcatagattgtcagggcaagtagttgtgacatccaccggtaacctaacctgcaaaacaattaagatagtaaggaatatgtaaaaaaaccaacacaattatattcatcgagatattttttggcgaaaggatgaaaattgtcactaaggctgtgtttagttcacaccaaaattggaagtttggttgaaattggaacgatgtgacggaaaagttagaagtttgtgtgtgtaggaaagttttgatgtgatggaaaagttggaagtttgaagaattattttggaactaaacacggcctaatgtaatgttacgctagctggatagaaacttttgctacattgaatgcagagttggaaataaatactggcacttgaaaatgcaaggcccagacctgaatatagcgctcaaagattccaatattaaagcttctcaaacattatatacttgtgaacttagctgtcttacaagtatcttaaaagcatatttatgctttggttgtgcttatgagaacatctatagctgtatacatgtcttgtaaacaatcttaactgcagcagctgttcaattctaaacaagatgtagaacagaatttctgaggcaacaagaaagaatcacatcaacaaaattcatgactaataagccaggtaaaatagaagcagccgtgcatcatgctgccacactgttccatggtgctactactttatatacatactggtcagttaattgatcagtaagtccaaagcaagagcacaatttgcacgaagacatagtgggccatgtgactaactgacagcggtacagtacacgagtaatacagaatgactgaatctgcatgtaaaccaatagtccaatacactaatttaatttataaaacggacaaaatgcgtgttagcaacaacaaaagtctgcacgccagggaaacctctaaacgttaaaacactcgtgtggaccccgtagcttaattcccagtacgtctcaactctcacctgtcctcgaagttccacacgcaattgcatcagcaacctagtcaaaacactccctacttccctagtggattatcgacttatcgttagcttctccatgaaagctgcgttcgaatccaccacacggaaggaactccaagaaaacagaagcttcgccatcggaaatagcatggaaacaaatcgccagctcacgtatcgcatcgaggcgtccgcgattggctcgtgagctagtccatgatcgattcgggcaaacgcaacgcaagggctaacaagggtagaggggaaaaaaacaaactaaacagcgaataattacccgaggtactgcaggaggctgaaggtgaggcgcgtgacgaggtacgtctcggaggccgcgtgcccgacatcgtcgcggaacgaggactgccgcctcgggccgccgcagccgcatccggcgggtcgcggggacgcggactgcaccggcgacgagcggcggcggcggccggaggagtcgctccgcgagaggagcgcgccgacctcctcggcgctggagacgggccgcattgcgggcggcgcgcggcgctggggcggtgtgcgggatattcgaatcggttcgggtgggtgggtgggtcgcaactcgcaacggtgcgggaggtggtcgggtggtggacgccgtcggagggggagagttggggggtggtggcggtggtggggcctaaataggcggagtactcgggtagtgcgtggcaacaagggacgcgtgggcggaggcgggcaaaacatggcgaaatcttccgtttcctcctcgcctcggcatccttccttccggcgtagtatcgcagcttgcctctttcggcgcttgcgtacgcctaaagagagagaaagagaggattttgtcggattgttccgagtaaaatttgatattgcagtacagatgtcagcgttttcctcctgaaaagaattactcctattttactcccaactcacgctacggggcaaacgttaaatctgtatcgtgcagacacatggcaggcagaggagcatgagatttcatcggtgtctctcgtgtttcaccggccataaaaatatatagcggaaccagattctattttcatttttagaaaaaaaaatgatggaccaagctcgaccgcaagtgcacgcaatgaccgcggcgctcaaccggtgccacagttccgatacacttctttaacctcaaaataaattcatcttttactcatcccaacattagaatacctttattttatcaaattttaatataacaatttctcattttatctattttcaatacaattatttattacttttataaactaaaagacgcgaatattagagaagaacgtaatatcaaataattaaaaggggtgaggtttcaaacttaggtcgtctagccaaccaccttgtagagctagctggaagacccttacgcgtttctcacttttataaactccaatacagtaattatttaaaaaaaataaatataaataggatgagttaaaacgaacatattataaagagggagtattccgaacctgtccacgaaatagggaatttcatggacggaactcgaaagagtgtaacagcctaatcgtctcggtgacggagtatgggcataaatgggttggtggtggcggggccgcacaccagccgcagacggcgccaaagctgcgtgcggtgcgagagaatcttgcaggttctagagccggcagcctgcgctgtgcggcgtagctggctctcggcctctagctgctggtggcctgtggccggccactggccagcctaccgcatgcgggtggccgcgacgcgcgccttcctgccccgtgccgccgcgccacgcggcaggagaaggccaccgaggcgtttgcggccgtcgggccatgggaaaaaaaaaaaaaacgtttcgaggggcgacccgctgagctcgccgagccgggctggcctgaacagcccgtgccagcttggatgggctggcctcgtaccctcaccaccaggccgagctaggctggactggggaaagttgttacgctgctctttttcgttttatatatatacttcggctgttccgctctggatcgtaatgtgccaaaggcatatgctaagatcacataacgtgcatattagctgttgtcaacctttcaaaatgtgtgctattcagaatgctactatttcttgttttacataaataatttcaaattggacatggtggattcaaaacgttgtcttgaaaaaactcaatgtaagtgctatagctctctcacgagtagagtaggaaggcaaagcaaaaattacagaaagtgtccgtgcacgtaataaactctctgcttttttgccagttgccactagtttaccatcaccgtttcgcgagttgccggaattcccctatcgccgtcctcgtcctcggccgcggactccacgccgtccctgtccgtgcgagatctccatcccaatttcatcgccgaacactccccgcctcgtcgtcgtcgcaaccacggcgcctcctcctcctcctcgacgagacgcccgcgggtgcctacgccccgtgcccgcgtgaagcttctggctgacgtacccgccgccatcctcctcggtcccggccttcctgtccctcaaaagtttcgcgaccatctcgatggctgcgccggcgtcgtcggtcatcagcagcctctccgcgacctcggccggcgccacctccacctcccgcagcagcgcctcgatctccgggaagagcgggtggtcgtcgccggcgacgccgtggtaggtggcggcgagctccctgaacgcgccgaagccgaggtagcccatgtgcacgtgcatgtccatccggcctgggcggagcagcgcctggtcgagccggtccacgtgcgtcgtcgtgaagatgaggatccgctcgtggccgctgctggaccagaggccgtccaccatgttgagcagcccagacaaagtcacctgcgacgtcgcgcggtacatggcaacacaaaaaaaaaaaacgcacagctttgtaagcgacacggtagcatctgatcagttttgctaacctaagtttgagattgaattgatggttgggatttctctttttggatgtctcttaatctgatcttcctttgcaatggtgctgagactgtgaaaacgattgagcttatcaccaaatttgtttgttttcaagacgtgactgatgcgtgtgtgttcatttttagtgcggggtcatggccgatggtgtacgtatgattgtattcttgttgtacctcacaaaatggcaaagttgacaacgcacgcgagacaaaccaaacaaaaattatgcgctctcttaaagttgtgaaacagtaaaacaactagtagtagtaagatattatgagaacgagtataaaatttgtgtgctttttagaaaggaagatttgtaatctacaagtgcatgtgcatgtgtacgcactagattttagaaaagctttagttattacatctttaatataagttttaaccatgattgttttcccgaacaaagattttaccctgctagcctgtcctgatttagaatcaggaatttacgcttcgaatctcacaagaacaagtaatttagcctgtcgtttggctagttcaaagtttaagccttttgtttcgcttaccatgcacaatttacagttacagagctaatgaggtgtattaattagtactactaagcactactaatactgaccttacgattcacggaaggcgggttgcttccgtcaggacctccatgcggttccctccgcggcgccgcgacgacggcgcagtcgacatcctcgatcaacaatatggacctgttcttcatccggatcagcagcttcgcagctcggtgttggagcggacgccgccgagctcgaggtcgtagacgtcgaaacggaggtggttggagatcgcggcgaccaggctggacttgccggtgccgggggggccgtggatgaggtaccccctcttccacgccctccccgtccgctcgtagtactccttcctgcccaggaacctgtccaggtcgtccaccaccgcctcccgcagcgcggcgtccatggccagcgtcgcgaacgtcgaggcgttgcggagcctcacgggccgccacttgccccactcgttgctgtacagcttcgcctgcctctgcccctgggacatggccgcgacgcgggccatgacggccgggaggtacgcgccgagcaccatgtccttgtgccgcccgtcgaagctcagcttgaacacctcccgcgcgtcgtccccgccccgccgcctgccgccgccgccgccgccgtggctgctcaggcgccacgtcagctccgccccgtcgaacacgtccacgaccgccgtgccggggcgcatggcgagcgtgatctgctccgcgccggcgccgcgcggcaggctcgccttcatcagcggcacgggcgccgcggcgaggagggtggagacgtacgccttggccgcgaggaagacgcggttgtagaaggcgccgtcgaactcctcgatgaccacgcagtggcggcgggacgagggtggcggcaggaggagcagcgcgcccagggccgtgtccgggaggacgtcggcgacgatccggcgcagcagcatggcagcgcccacgacggaggaggccgccgtgatggcgttcttgtaccgttccagagcttcgctgttcggagacgccatggctgtcctcgctgcagctgcagtgggaggctctgattaaggttttcgatctaatcaagtgtttgagtggtttcagtaacagagattagcattcagcaggtgaggagagcttttggagtggttgccgaaagggaataccttattataaacattgtaaaggtcggtttaattggttggtgtttgatcactctgtcatgtaattaaccaccgtatactaatgtttgttgtgtaggttgtgattaatgtttgcttaggaaggagattagtgggtgctgactagctaacagttcggtctaccgtgtaaagcacttcagtcagtcaacaggtgccctctgagtttgccaaggaaaacactcggaaatttcgaacgtacatttcaaaaactgcgatttaattggttgtgcggcttggggtctttctttaacgtttggtaatcactctgagatagccttttgtccacatagtacattgatttatatgtgaaatttcaaataaatgtatcttataccccctctaaattacttgtgttggcagttttcatactgtaactaacactccatgttacactttacacccataaaaactatccatatcggtcaaattatggcttgtttagttttcaaaaaaatttttctaaaaacatcgaattaaatctttggacacatgtatagagcattaaatatagataaatagaaaaactaattgcacagtttgtatggaaatagtgagacaaatcttttgagcctaattaatccatgattagccataagtgctacagtaactcacatgtgctaatgatggattaattaggcttaataaattcatctcgctgtttccagacaagttatgaaattagtttttttattcatatccgaaaacccttttcgatatccggaattaggtttaataaattcatctcgctgtttccagacaagttatgaaattagtttttttattcatgtccaaaaaccctttttgatatccggtcaaacgtcgaatgtgacacctaaaattttctttccgcgaactaaacatggcttatattaccccctcctagactagcaaaagttgatccagctagtggcttgaccaccacatcacttttcattgcacataggtattgccagtcagtccaatcaacaacaaagacgcaccacaaatccacgatcgttctcgcctcgtttctctgtttttgtctctacctccagtgtcggcaatgttgagccgtcctgaccggtggcacaataatcttctgaccagtagagcccacccactagaaccctaacacatggaggcaaatggagcagagctgtatcgtagaaccctaacacatggaggcctagtttcaaactttttcttcaaacttttaacttttctattatattaaaacttttctacacacaaactttcaacattttcatcacattattctaattttaatcaaaattttaattttaatgtgaactaaaccacccctgagctcaaggaggggagtggcctagcatagcgggttacagactgacaggcatggtggcagtagaatgagaagatctctatagtgcacgttgaaaatgacacaaaagctgacagcagccagcaggcaaagttgatgtccatcacaacgcacatttttaagtgagccacgtttttccgtgctcaattttaataaatttaaaaatataagtcacgcataaagtaatattcatattttattgtctcataacaacaaaaatactaattactccattcgtctcattttaagtgcagtgatgattttttatgccaaaatttaatcgtctgtcttatttaaaaattttaatcgtcccgttttaaggagcattttgtgaatgtatagtccaagaatgatttgacgcggttagtaaaaccacattggcgtttttatgacttctgtatgaaattgatggcattaaagtaattgaatgaaaataagtggcaggtgtacgaacaattgaatcaaaataagtggcaggtgtacaaatataggtgaacattgtctggcaaactgcaagaagaatcactagagacatggtggtggaacaagtgaagacttggacacatcatcgcacttttcaaggcttaaatcccactatctacctccgtgctaatacaagtacagtctaggttttatctaacttttaaccttccgtcatatttaaaaaaattataaaaaaattaaaataaaataatcacacataaaatactattcatgttttatcatctaataacataaaaatagtaatcatatttttttaaataacatagatagtcaaacggaaaaactcacaactacacttatattgggacggaggtagtaatacttaccattatactcataaaaaaaatacatttacacttttaatggaattttggtggaaccagcacaccaaaatttaaatttagacttaacacggtacttgaatttacggttatttactctttcgatggtagatggtgtacatgtttacagcgaggcgtctgtggtgaataggggtcttcttaataggggtaagatgtgagtgtgtgcgtgttgtgaactcttgtgtttgtactgtattcttaaaaaaaggggcttgtttggttgtcactttgaactcaacacaaagctttatgtggaggtgagagaacttatataaacaaagagtgttgatttctatacaagagctagctccttatatacttcaagataaatacattaaatgtaccggtgaaaaaaatatgagaaaaaaatagagacaattttatagctcatctattatacatatcagctctaatacaaaattataactaatagctggctctactattatatttggttattgatcatagcctgaggatagattacattaaatgtcaccagtggctcccggctagtataggcagcttcacaggtttgccagtgaaaactccatttaattttaatattgatttgtgaattgttatgaaatttgtacagtaaatattagttacattgaagtttatctgggctcaaaaaaaatttttggttccgccacttagggctaatttgttggagcttctagttgctgcagcttctctcagaatcaaatgctcttctaagcataccagcttttggttaaattatttatagaatccagaaaataaactagaagttagaagttagaagctgaaaaacttaatttttctagattcccagctatttctcaaaacataaactttccaaacaggctcttaggccatgtttctttcagtttgggattattataatctagattattgagtcagattactataagctagattgttataatctgtagtagaataagcggttagtttgtttctttcctagattattgggtttgcaagtctaaagagggagtgggtggcatggtgggtaatttttcatccaataatctggaaaaagctcacctaaatgagcttatcaaattataaaaagctggcttcggattataaaaaactacttcaataaattgtctgtttctttcaatttactcttaataatctggattatataatcccaaactgaaagaaatagggtcttagagcaggtacaataagttaattaggttggctccaaaatttctcacaccaccttaatcctatattaagggggaagaattgaagcgagagaaacgagcgagcgcttaatctagcgtcgggcggtagcgcagcctcccacgccgtatagcctgcatgcagcccgtgaaggcgattaaaaacgcgttatatgggccccacaaggaacccgcctgatcccatcctccagctctcatcgcatctcatccaactgcccaaatcggcgtcgacgctcacgttcctcttcctcttccgcacctacgcgcgaaatcacctccagccttgggcgtgaaatcgccggcgatacttggtgttcctctccctcttccacccctacgtgcaaaatcccctccgtctgtgcatgcgaaatcgccggcgacgcctcctgttcttcctccacttccgctcatctgctcctggctcatccgctgatctgactggtggtcgcattggtgctcatatgtgaggttgctgctgctattatgtaatgtggattctcaagttgattagtatcgatcaactttcgtatacatacaacatacatagacatatttgctgaatattcttgcttggattgacttgcctgttggactaatccggcaagataagtgaatacaacaactaattacaaaggaacaaactgaatgatgtatctgttttgtttcaggaacatatgtgctcttttgtccactgaataatgatgcacttctttcacaaataaagtttttagtttcacaaataccttactgaaatcatgttgtgtgtatttgtggtgtaccaccaagacatcttatagctaacttatagctagcttgttgtatgagttggcttttaagttagctctacttaatatgacaaaattttggagctagctgccagctgcactattgaccttgctcttagtgcattgatggtaggtcatcagtcatcacgtattcacgtgggtaaacgtacttcgaagtaccgggaaccgggttatacaggagaacaaatatatctcttcaagtactccagttacttgctaagggcattcccaacccaagacactagccatagtttccataaactccacatcattaagaaactagtactagacactactcttccaatgcaaacactactattacatacttcaatttaatgatacttatctctcatgacgttttggatgttgtgtataaaccatgtctcatgcaagatatggtttccctctctttcctcatttattcacttgccacatcattttttatcctaagtggcagcttatttaatgctatggacaccatcatagtcattggattagaaatgccctaatagctcgtttcttgttttgctcgggggattaacacattaatcatgtttggattagatgcgattgctttcgtcgcctggagctcaggcgaccgtgggtccgctccatggcaccagcccaggcgagcagaagagcgcgtatcatgcaggtttggtggttgcttcaggtggtgtttggatcagggaattaactttagttcctatattttgatactaatttagtgtattaaatatagactacttacaaaactaattacataaataaaagctaattcgcgagacaagtttttcaagcttaattaatccataattagataatgtttaatgtagcatcacataggctaatcattaattaattaggctcaatagattcatctcgcgaattagtctaagattatgcatgggttttttattaatagtctacatttaatatttataattagtgtccaaacatccgatatgatagaaacttaaaagttttagtcccatctaaacagggtctcagattggtctccggccaggtgaatccatctttggaagccaacaaattactccatatgtccctaaatatctctaaatatatgataccgttgatttttttaatatatttgatcgttcgttttattaaaaaattttaaataattattaattttttcctatcatttgattcattgttaaatatacttatagttttacatatttcataaaagttttttaataagacgaatgattaaaaaaattaacagttatatagatttacatatttcacaaagtttttaacaagatgaacgatagaaaaatatcagcggtttagggacagagggactaccaaacagccccaaaaaatgctttgttgcacttgcaggctgcagcaggataggcgcggaggcgccatcgtcgtcaccagccgcggcgcacgaccacgaccgcgaccgcggtgggcggcgtaaccgcgctagctccgccgtgccgcctcacctcgccctccctcccaccccgccgtacgtcccgagcgcccacctccaacgcagctcctcctacctccgcttcgccgtacgcatttttaatgtcatcaccagcattaatttttcaccgcttaaataaattttcgagctcagacggcgccaccggccggctgcgtcgtcgccatagcccatgctctcgcatacctcgagatccgccgcggttgctttcgctctccctgatctgatcatcccccactcgaattctccccctccttttttttctcagccgcggaaaagaaaaaacagataaaaagaaagaaaaggggaatcttggagcccgcggcccgttttgcagcctcacccctcaactgtgcgtcgttaatcgcggggccctcccctccccgtcgctgctgtggttgctgtcgtgccgtgtgggcgtcacaacgaataatcaatggcctctcctgcatcaccaagaagagaagaggaaggaaaaaaaaaatcagagagagggagaggagtaaaaaaaaagaagaagaagaaaaggagaagggagacaggggagtcagtcttctccctctgcctccgtgcctgcgcctttgcttcggagtccgccaagtttagattcgaggaggagaagggaagagaagagaagagaagagctctcccctccctctgcggcgtgtcggagcaggcgattggctccgttccaacagtccaagacgaggattattttacaaaggttaggtcttgccgccgccccgctgccgcttgtctgtctctctcccttctcaagtgtgcctcatttgttgactttgctaatccccaaatctgatttggctcccccgcattgcgcgcggcggcaacctcttcctggtgcgcttgccacatcagcctggccatgaacaaagttttcgctttttttttatgcgggagagatggggatgattatgcttgaggggggatcttgagcgtgtgtataggatcgagggttttgaacctgatttctgaaagcgcctggtttgtgaggctcaagagtctctgctttttgccggtttgagcttttaacgaaagaggcgatgggctctgttctgctgaattagccacctcgaggatggggaggttgaaggattgaagctctcttttcctttcgcagaagtaatcgcctgtgttctggcctctctgtggatatgtttcagagcttacctgtagcgtcgagtttgtctgcaacgaaaattgctggtgaatgtttcagatgttatgtattccatccatttgagattctcaaaattggttttggctctgtttaggatgtttaatgcctcaagttcctagttggtccacctatttgattaactccacacatagaagagcagaagttggtacatccttgctgtgcattgttgaaactatttgcccgttctgtagtgatctgaaagatgtcacattctgcgtgcgatcccttctgtaatgaggtcagtggtcgttttgggaaagcaagcatttcagcaacagagtgggatatttgatatctacaggccttagtaatgctcattttacagacttttcagcacaataggttgtgtctgtttccttgcattgttaaagttagaaggttccctatatatatgaaaaaaatgcaatgcggaagaaaggaacagagtaacatatttgaatcgtaaacagtgagctgggtcaaataatttatagctatcaagaaattgtcttgtttgtctttcgggctttaaaacaatgtgtgaactcctcgttttggaagaaaaactctgacatgaaattactatactgttttctatgtacaccgttttccattgaaccgttgagtttgtttgttgtttacagaagctgccttttataatgcgattgttaaatgacttgatgtatagctttatattttctgtgtatctatttgtatttggatatgtgaacatggttggatatgaacttaggctctttcttgattgacttagggtgtaggatcctgattttgttcttgaggtatgtcctcaaccagttcttcacagccaccagcatcgtcagatagagaatctacaccagccagtgataatgcaacatctcctgattcagatggtaagcagcatatcattttcttatatgatctctcattctctctacatgactgcactacatacattattattccctttcttatcttccaatttatccttcatggattttgcaggcacgaattctgctggacccgcaagaagcagaattgcactgcagttggatcagcggtcattgcatttttctgttactgcttgggtaaatggattaagcacaacaactagaactttcagcaattattgcattgcacataattttctattctctgaaatcaattcaatgctgaagatcacgctcttgtctcaaaatcccattggtgtctatataagaatacttttttctagggcaccctcattggcctaaaaaaggtcagttttagaattcttcacaagtgagttaatgttcagaattcattagatatattatcacataatagactgatgagcatatattatatcagaataccagatgagattggtgtagccatttatttatttccctccttaatgattatttgctctttagttccataggaacaatatttagtatactttttaagtgctcgccagtacaaaatttcaactttagtttggggattaatttgtatgccttgttttagcttccatgtattaatcatgagcacaaatttacacagcttttagttaacatgtttaaattactttagctgattgtcagattatctttatcacacacacaacacatttgtttcctctgttttttataggttcttattgttgcattgattggaatccttccactgacaccacgacaactgcaatataagggatatcgtttgtcacttctcggcacaacctgcaccacaggctatgctttgtttgctttttatcgggttagtaacatgtcatctgttttattcttcccttcttagataccttgcacaacttttaccatttttccttttgttcagctaccaagagcaggaaacatgcatgctgctcagatctttcaccatgtagcttcgtcaaaggattttataccattcatgtactgtcttatgtttgtcatgtctaaactgcacttgaagcgtaagcatggcttgtttactgacataatgtattcttcatatttccacctaaacacctttcctagtacttgacacgataatattttttgacagttgttttggtaccagtgatttgctgggcacttgaacatgtggccagatttctacggcgccattttactaattcctctctatacaggtaaatgaactcaacagattataagcacaaaatcgatgaagagtatgtttgtcttgccttctatgcatatgctgttgtgctatcattcacatatttaggataaggcagttgaggcattatcttcccattcttggtttatgctgctatattgactaaacattttgattacatggcttttactacttcatctctctgggtgtgcaatacctgtaaaaccatcacaatgcaatgaagaaaacaatatggctgtacatgccctagtccatcagttgtaaatcaatatgtgcaggaaactgtcataaatgttgaatagtataggaagaagggaagatatactacgaatattggacattctatattgagcctcggagggctaggtatatataggagtacatagtgaggagataaggaatgattacagataaggaaggaaccatacaaaccaatcctatcctaatatgactctaactaccatataaacaaaaaaacataaatactttatgtgcaggaaatctgcatggcaataagttgataaaaaacaaaacaaccctgcaatactttgcctgccgaacatactggtaaatgtgttataacatttgaacgcattgtgaatttgtaggacatatctggagaaaccttgcacatgggttgagacaaacacaactgcagtcaaattcctgagttcaaatgcggagattttgttgggatttcttttgattttgtctctgttctcgtcagtagagtcctacccttcagttttaattcccccattcccattaaccattcatcttaatctcttattactttttacttctgttgtgtaggcgacaacgcaatcctatgcaaacgttcatgtactggcaggttagttttttacataaacactgattaatttctccaaatgacatatttctctttttttttgttgactacaatgctgcaacaagacttatctttcaggtttttctatgatatcatttgtcatcacaattaggaatttggagtgttctttttatatctagtataatatacttttatttttcttgcgtggatatcatcttatccactataaacaagtgcttgtttagttgtacatcaaacagaataagtaccaaatgacgcttaattttgcactgcacatgctggctaaaatgctggtgacgagctcgtccaaatgcggatagctatatttcaataatctcaggatgccagccaagggaaaaggtgctcccatggctgaacaaaattaccaattaagtgtatgcaatatttgcatttaaaagataatttgggcaattttagttacttctgctctcagttgtaaaccgcaaaccgcgcccctgcatttaaatgaatgcttgtcgggttgtagagaaaatttattatttattaatgttatagtcacagaaaatttctagcaaatcactatctcactctgtttacccgctattgcagttactgaagctcatgtatcactctcctttcactgccggttatcacagagctatctggcttaaaattggccgtacagttaatccctatatccatcgctacactccttttcttcatgacccgataaatgctggcatgagatggtggttcaggtagcatggatatggctcaattaatcatgtaaaggtgtttttggttacagttcacagttaacacatggaggatcttttcagtaagttgtagtttgcgagcgacatgtttagtaccttttctttttgcgatgttgcgctgatattacttttagttactgacaagtaattcttgtaactttaccttgactgtagaactagtgtagaccttagtaatatggccaataccatgaagtgaaaaatggaaaagcaatttattactatgatgcaactggattctgctcctgatttgtatcagaccacttcatgtaccatcccaaaatataagttttgggtaggatatgggcattaagaaggttacacacgaaattaaatggaaaaatgtatgtggataaattgtttatatcttaagataacttttaaatgctataagttattaaattctgggacgaagagatcagttggtttcaggccctgggccatgtagatgcatttggttgcaaggatggaatgggatgggatgggacgaacccacttttgaggttgtttggttgaggggtgagtgggatgagatggtccctggagaggaatattcctctcagatccgggaccaaccgatccggcaaattctggcggacgaactcgtcctagttgggacgagcgaacggcatgacccgctcaagcttgaggccagcccgcgcgctcgccctactcgccctcaggagcagcggtaaacaccggcgggctcggcgacggcgacggcgaccgcggctgcgggggctcggctcggcgaccgcgggggctcgacgacggcgaccgcggggggctcggctcggcgacggcgaccgcggggggctggacgacggcgaccggcgggggcttaacgatggcggccgacgggctcggcgacgacgaccgcggccacgggggctcggctcggcgaccgcggggggctcgacgacggcgaccgtggaggctcggcgacggcgaccgcgaggggcttgactcggcgacggcgaccgtggccgtggggtggctcggctcggtgaccgcgggggactggacgatggcgaccggcgggggcttagcgacggcgaccgcggggggctcagcgacggcgacggcggatctagtggtggggagggcggtggaggtggatccgcgtcctttgcctgctcgccgccggcctgctcctccaaccgcacccctgctcgcccgtccgtgctcctcctctgttcgtccgcctgctcgcaatattgcgccgctcctcctcgccgccagccatcgtcgcacctccgctcgctctcctctttctcgctgacggtgatagcaaacggcgcccatcccatctctagctcatcccttcaaccaaacaaaaaattaggattgtcccatcctacaaaccaaacacgtaaatggaatcatcccaaccccaaaatcagaaatggtttcatcccatcccacctagtcccgaaaccaaacacacgctaagatgactagtgcatattccaggggcaatttttgcaacagtacatgaaaatgcagtgccgcaatatttcaagaattgttgccaacactctattcgaagcaggactattaaaaaaaatcagtaaatcagtactattacaaagaaaattgaaatgcgataatatttatttcatgaaactcccaggctccaatgagagttcatgcgaaccatccctaggccctgagattaagtgtgaggtggagcacggatccggcctcgatattgtactcgtgggccgccttgtcgtcggtgaccagcacccctttgtagatgagctgccctatttgcctgtcctcctcctcgatgcgcgccctgatcatggccccggtgtccgtcggctcgatgcccaggccaaacacctttgccgctgagaggcttcaccttgatgttcatgctgcctggaaggaggcggagatagaggctcagcgtcgagccgtcctggatgttgtagccagccaccgtgcagccgttctccagcaacttgtggtcgaagaagagcagctgctggtccggcgggatcgggatgccctccttctcctggaccttctccttgacagatcgtgtcgctgctctccacctcgagcgtgatgagcttccccatctgggtctccacgacgatctgcatcttcgtgtctcgacggacgtcgatcgacgacggattcggctgctggtttgtggaagatttacgacgtacgacaaaaccgcggggctttgcttcgatgctgtgggcgtattggctttgcgtcgagacttgaatcgatcgatgtaggactggtgttgtgttatgcggctccggtcctgtggtttttattggtggtagaggcaagctttcgccgttcgggttggtttccagttccgatacggccgcgacgcccagcgttcgcgttgggctccatctccggttcggcggattatccaactcgggcctgtatctggactctgaagatacaaaagacgtactgttgccggttgggatttttccttgagatcatgtagtagttctcggaatgggactcgtcatcgtgtacgtttctacgactacgatgccggagtacacggctttgtcgggtacgattatacgatgtgccgaaaagatgcagcccgatctaactcaggactagtgtgattcttgtattgtaagcgacgaagtgcatcccagtcgggtacggtacgattttgatgtcgaaagggcgtaaaagttctgtcattgcggatacgagaaaaacactgagtccactctcacacggtaggagtacatgcattatttgaagctggccggcgtgccaggatgagacgaaaaaaaatttggtggagaccgggtataattctgtaaatcggctcccgtgcagccccgaccccgatgattgccgcatggacaatctcagaatcggacgtctagttcgttgcggcttcaggcccagcgcaaatatggcataggagcctcgctcgactcggctcccgggcccgtcgggtcgtgggctcatatccctctcgtatcggcctcattcgtccgcagcagccgccgccgccaccgtcggccagcggcgtctctctcatctactgtctctcgtccaccatcgctccctctctcggacatcgtccactcggcggtgatgacgagggcaaccggctcacaatcgccgacacccactgcggcaactccatgcatggttggtctttcggcaagaaatttaattaccggtaaggagattgaggttgagggtgatgacgcggaggttgtacacatcggtcttgtcactcattttcttgaactgcacattacgccatcagaaaatgttagtggcactatcagtattaggtatatagatgccgaaattttgataatttaactcttttagaaaatttatttgaaaagtaaaccgtgtcaaaaacttatttcaaaaataaaccgtgacctcagcgtcattgacgctgaggttaacgattaaacgccaacgatcatgacgctaagcacaccttggcggggcactatggagggttggatgggatcagccatgggttttggcgctgaccccttatgtagtgataaagtgggtttgtgttaattcttgtcactttctatgatgtgccttggtggtttaacttcctatgatcccaggttcgacccctcattgctcatttttttgcttgctttaatcacacgaaaagaaacaaaaaaaaagcaggacgtagggatcgaaccctagtcttctgcctgacagtggacacattcaccgttgtgctatacttcggttcataacagtattagccatgttttgcatgtaacatatatatggggtcagcgccaaaatgcatggcgctgacccctatcgcacctgccaatggctccgcgtttttgatctcagtgccaatcccaatgatgacgaggtcacggttcatttttaaaataagtttttggcatggtttactcttcaaataagttttctaaaagggttagattgtcaaaatttcggatatagatgcagattctcaattcatatagatgaagcccaagaaatgtagcgtgaatttggagcaaatttgttcagagacagaaaggtagtagataatgttagtaaagcactgttgttaaacaaaagtcgatctccccagaaaaaaaacaaaagtcgatctgccatttactatggccggaaaaccgtatgatatacatgttaatttgttcaactgaacttgacactcttttactgaaatatatgcactgaccaagtgaccatgaagaaatgaaatgcttaaatctccaaaatcttcagtatgtatcaaatctaaatggtaaaggaccaaaatgaatattagtactttatcaaatctaattagaatctgcaaacgttcagactacatacattgaaatgtagcaattaacaactatattaaagtttgaatgcagaagcccagatcaaactaactaatcaaatcaatcctgcaccatggtaagaaagaagcccgtgagctcgatcaagagatagcagctactgcccacgggaagatggagtacatctctgcgctagccgccggcaaacagggcgaactcgtcgttaacgttgcggtcgacgagagggatgggttgtgggggcgcggccactcgctatcgccgccccgccatgcagacgacggatgagataggctgcgtcggcggcagtggctgctgctgagaagagatgtcgatgatgcgatgtgagccggtgaggcggtgagccgatgggcccggagccatcgagcgagtcggctcctccgtcctgtttgcgctgcgcctggagccatacatagtgagacgttcgattctacggttgtccacgcggcaatcatcggggtcggggctgcacgggaaccggtttacacccggtctccaccaattttttttctggatgagactatcctgcttctctttgtccaatagggctcatcattctgtacgttcatacgactacggtgccggagaacacggctggtcaggtatgactactatgcaatggttcgaactgatttagatattattataaaaaatgatctttcatttatagaaacgcatagatcaatagtagctacagaccagcaaaatgtatgaatggtgcatacggttgatgatgaacgtaggcaaattaaatgtgacaaaggttatgattggttgagaatagaaagtaggtagagaaattaaatagtgtaagtttgtaattactcttattggttttattattcttaatgttttggataaggttgaaatcaaattttttataactttgcctttcagtaacttttaaaatattagtttaaaggcactagaacaacatatatagatttatcttataaagtaataaaaataaaaatatatttatttattgtacatattataatagaaaaatatagtcaaagatatattttgaagactgtcattgtataaaacatcaagaattatgaaagtagaggcagtagttgagaagagaatatgggtgataaaattgatatattttacaataacttttaaataacagaagttatattttaggatggagagaataactgactttaggttatgggtcaagtaccaacaatttccggttctataagtcaatatcaagcccaatcagatgctatatatactagtgcatattcaaagccaagtttcacaacattatagaaaaatgcattgctgcagtatatcaacaattgttgtcaatactccctcctaagcagggctattaaaaaccggcaaaataatatacttaaatgagcaatgttaaaaaaaatcgaattgcaacaatatcatatcatgaaacccgcgggctctaacgagtcatctctagcccctgagagcaaggacgatcgtggaggagcacggatccggcctcgatatcgtactcgtgcactgtcttatcgtcggcaagttgcttcccgccgtagacgagcctgccctccctctcatcgatgcgctccttgatcctgcccatagtgtccgtcggctcgatgtccacgtcaatctccttgccagtgagcatcttaaccttgatgtcgttcatgccgcggcggaggcggagcacgaggtgcagcgtcgactccttctggatgttgtagtcggccagcgtgcggccgtcctccagctgcttgccggcgaagatgagccgctgctggtgcggcgggacgccctccctgtcgtggatcctcgccttgacgttctcgaccgagtcgcagctgtcgaccacgagcgtgatggtcctcccgttcagggtcttcacgaatatctgcatctttcttcgttgacggtcgtctcagctggtgatcgatgcctgcggcgatttgctgtgcgacggccggaaaactgggacaagagaagaccgcgcggcgacggcgaggtagtttgcttcgtttgcttctctcgtggacgttggtttgcgtggtgaagccttggggatcgataagcattgcagttgcagctctcatcgtgccgttttatcgtgcgatcggcgggcttgggtcgcgttcgaatcggcttcattttccgataccagcaggggcagaacatcgttgtccgatacgtattgcccggagtaaaccgtaccggaaggtccggaaccagcccgcacaaacaacacaggctggctcggacgcaccaagggccaaggcaggcagctaccatggccaacgaagtttggtgctgacgccactgctctctctccggccggagtcccggttgaggttggctagcatgattggggccgaccgccggatcgaattttttttacaaaaaacatgttaacactcacaatgcgtgtacattcatttctattaatacatacacatatactctacctctataagcaccttcgaaagattagaccaatatattttaagatagacaaagtcaccatggacacctcactgtcgacgaacatgtcgcctaccactaaaagaataaatagttgtaaatatgagcacacatatcaaatctaaaatttaaactcgggtaggtatcaattgagctacatcagaatgaaaatgaattttgtcaatgtaataaaacaaggaaaaaagttattagatttgaccgtctgacccagttttttaagaaaatgtaatttattttggcctttgcttatagaaacaaactacaaacaatttactacagaatttgcaattaagtcgacaatggttaatcacagcttaattgaaaataaaaaaaaaatccgaacatcagcctaaaaggagtgacatatctattactaaactttcatcgacgaaaatctatgtaaccattattttttactaggtttagaatttttacgttggttttatgggcaaaatagatccgatccttataatagtactctcaccttccataaaaattagacctattactccctccgtctcactcattactctcaccttccataaaaattagacctattactccctccgtcccactcattaagacgtggtcaaacttggcataatctttaagaataatctttgactttaaatttctcatagactataatatttgtagcaaaaaaaaaatcataatatatgaaactaaatttaagtgataatacaatgataatattttcatcaaataaaatttaatttataataaactattaattgatcaaatatttaaagagtttaatcttaaaatgtgtgtgtgcattaatgagtggaacggagggaatactttttatcaccaaaactaggagaaattaattcattttgcatataacaaagatcaacaagtatacgtacgcatgcaactaataaatattaagatgattaattaggttctcattaaacatttaatttacctatccaccatttaagtcttggatgtatagacactgtaaataacaataacttatttgaaaaaacagtaaaatatgaaataggtctttcttgtggttggagagagtacgttctacatatgttgatttatttgtctggtcactcggtagtagttattttcaccctcgatgacacgcaacttgacgttcgtatatgctttgcaaatttgtatgcatctttcacaagcacaaggatgaactcatcagttaaccgacattgtcactcatatgcttcttgaaaagaggaatcgatcgaaagggtagtcctcgctgcttgcgctgtggctggacctagacgagctccgcattgaggcgcggctttccactgttccagccaagatgacgcgggtagcctcatggtggtccacgtaggatttttttttaagctaaaggagagagaggagaagccggtgactaattagggcaagtgctatgatagatgtgactaccacatttaaatttatctatattattcactcactaactatgagacaaaccatacaatatatcacctctaatacacaaataccaatatttctaatactctcacattcttcttgaagtttgtgtggaggttgcctcttggtttaagggtgtctcatcatctctctcatcacttctctcctctacctcatcactcaatccaatgtggcacttttagggggcaacacatggagcattagagcaaggctaataatatagccagctgcttactgaatagatctttacaggctacctctcagccaactcatatagtggttagctcttaactattaatatatggtccacctgtatcgactctcacatattttcttagttcatgtgcctaagtcggctataagcctaccacccgctttccctctctctctctcctctcctctcttatccatctcagcatgtattcaaccttcttatagccttctattatacttgctcttatagtacttgcccttagccgtccggctgcacgctcggcccgaggtcgcggggaccaccaggagcgatgggttcgccatctgcgtccggtacgctgttgactgtgtccaccaccgttgccatcgctctccattgccgtcgtcgtctcgcgcttcaccgggtcgccgccctcgtccgtcgtcattgccagcgccgccaccatcagcagccttgtccgtcaccgcagccgttgcactccactgagtcgccgtccttgttcgtcgttgcggctgccagcggcctcgtccgtcaccaccatggccgccgttacactccactgagtcgccgtcctcgtccatcgtcgtcgccgcagctggcctagtccaccatgcccgccatcgcactccactgggtcgccaccctcgtctgtcaccaccgccgccaccgtccttgtccaccatgatcgtcatcttcgtcgtgcttcactgggtcaccgccctcgtccgccatagccgccgccacctacatccgccatggccgccgcccttttagacccttgccgagttgccgtcgccctcttctgccgccgttgcggccctcgtccaccccggccgcctatgtccacctcggccctcatccacggcggccgcccaccacaggcgccacgccgcgttctttcgccgcagctcgttcaccgtaggcgctgccgccgtcattgtccactgcatccaatccccatcggaagagaagaggtgagaggaaggagagaggaagagacatggaaagatggtgggtcctataaagataaaatatttgtattacagtatttcctattgtcatacattagctacaacatttattatagatgacatgattattttttaagccaacaatgggttgtattattgaccttgctctaaaggagtaagtggctccgtttactgtgactcataaatagattcgtgaattagccattatattttcagtggcagatccttctcaatcgacgctgaagtgctatgcccatgaacagtgatgcatgatgacaagggacgaagcgattggaaacagacaaccatgatctgtacatatgttgtggaggtcgggaggtaagagcaccatggaccatggtatgcctatagaaggtaagagtatatcggtgtagggatgacgaaaagagggtcaactttattttttttaaataggtaatttataaataatataattgagatttgagactgatcagtatttattaattttgaatcggcaaaaaaaaaaacgtctcaactaaaattattactccacaaaagaaacttcataaaatctctgtagatcgataatgcaaagaaacttcttaccaaaaaaaatactattagcttatattgttccaaaaataacctaaagccctagctagagtctagagtaactcgatgcctccatctactagttggagcgcgctcagaagttcccgcctcggagagcgaggacgaggtggaggacggagccagcctcgatcttgtagtcgtgcgccgtcttgtcgtcggcaagctgcttcccgccgtagatgagcctctgctgcacgggcgggatgccctccctctcctcgacgcgctccttgatcctgtccaccgtgtccgtcatctcgatgtcgatgtcgatctccttgccggtgagcgtcctcaccttgacgttcaggccgccgcggaggcggagcaccaggtgcagcgtcgactccttctggatgttgtagtcggccagcgtgcgcccgtcctccagctgcttgccggcgaagatgagccgctgctggtccggcgggatcccctccttgtcctgcaccttcgccttgacgttctggatcgtgtcgctgctctccacctccagcgtgatggtcttccccgtcagggtcttcacgaagatctgcatctcgacggattcggcttgcttgtggaaggtttacgacggctgccggaagctggagaagcacgtaaaccgcggggctttgcttcgatgtcgtgggcgttgggcttgtgtcgagacttggatcgatcgatgtgtgtggctatgcggctctccgggcgtgtggttttattggtggtagaggtagcggcctactagtgttcggggtcggcttcccgctccgatccggccgcgatgccaaaatacagttcgtctcggcttccagctccaggccggccccgacgcccagtatgtctagtatacggacgtaaaaaaactcaatcctaggtttgaatctggacatagtgtatgtccagattcaaacccaggattgggtttttttgggacggagggtgactaccgtacagtgtgatctacagactactgctgtgcatacgtattcaaaataggacttgcatcgtataggccggatacgtggcttatcgggtacgactacgatgcccagtagacgtaaccgattgcaatggtccagatgaacagatacagcacggagctagttctgatgagaccatcagctcatagcgattcccatcattgatttctatagcaatatttttagctaacgatgaaaaccaatggcaaaaaggaatgacaacgtaatacaagtggctcgtgcagcctttttatgcaatagagaaaacaatgaatggttgaacatgctccagtccatcaaatgtaaaacgtaaaacagaaaatgttactattattttattattacctgagttcatgaaaacgcatgtctccttagatccctaactattaggagtatatagcaattgctcagtacgtactgcgagcctgagcgcagcccaagaactctggacgggctcagatcctgagttttggacaacactatttcctaccaagtctccaacaagtcaagtttatattgaagttgactctggaccttgcaactcgtcagatcaccccgtcatgacagcacatttcagcaaggctaaagcaatcaaacgtagagctagccacttctacttctgttttccgcatctctgttctctcctcgcattcacttcagcagcccagctcttgccaatctctgtctggaacttgcctgcagtaacaagatttacagatatgtttaacaacagaggacatgtttacaaatttttaaatagcctgcaacaatgacattaccagcggtagagaggaagaactcatctaacactttgccatgctctgtagaataagatgggaagagttagtgttacaaacggattataatccacaatgtacatcagatatgtactacttgagtaggatgacaacataggcaggcagctggaattatattgtacagtgccctgaacaaacaaaagaagaagatggtggcatgaagaaagcggtttggtatgattgtcaacacagcagcagactattcaaagttcttgctttgtaaaaccaagcatcaatgcacgcatcagaatggtgcgataaaaaacatgatgtatcctgcatattactgtaacagcaaattgtttcagaggaaggacccaatctaccgcctggtagacttcacagtttgttaaaatgagtaagcagctagttgaatgtacacaaatttaaaattacagaaaagtaatacctttctcatattctagtgcttgaagtatcatttccacctgcaaaacaagtaaatacaagaaatggtaaaatcccttgaaccatagtgaataaatagagaatgaaaacaaagaaaaggacaaatgagatgtgccccagagtgaaactgcaaatgaccaatatgtgccacaacacaccaaaatacaatataaatattacaccttaaagagttaagaatacaaaatgaacaatatgttgcatgcagggtttaaaattccggaacaaatttcaggtctataggtgggtcccaatagacagtgagctccggtgaaaaatttcggcaaaacactgttcatggtccaaatccccaatttccaatccccttctcactcacctttctccccccgtcctcccccaacatctcctcccatcctcccagcactagcgagcaacaccggcagcggttgctggaactggaggcagaggggtggctggagtggccagcggtggttccgcggctctccggagtgacgacgatgacacaagcggcaaggcggcgcgggcctcgcatcctcgtgctggagtgccagcaacggctccgcggctccggctcgacggcgacacaagccgtggacctcgcatccttgtgtttggctggagtggccagcagcggctccacggctgtcgggcgcgaccgcgaccgcgacaacgacacaaggcacacaagccagagaggacacgacgacacaatccttgcgtttcattctcctatcctgtccccctgctttggattggatggacttgatgcatgtctatattctgatatatgtcaaatttctgtaatttttgttgttcaaattcaaattttgtttgaaaatttcgttcgaaatttccgaaagatttccgaaatttcgttattttgctgacctccgaaaattttccctttcccgatagattgaaccctggtttgcatgacacccctcttatgtaataaagaatattcttacaagcaaacatgcatgcgttaaagtattggaaattaaaaatattttgcattttgcacaagcccaaaaagttcaatgaactactgaaaccattcatcaaaacaaatgttatattcttgtttattttgtctatgttaatgaagaaaagcaagaattttccagttcatatgaactaaatataaaatatttatctatgagtgagttgtttcaggaacttggacatggtttcataaagcgttactctagcaagcttgaaaattgtagaattgtgctgaatttgtaccaattccaaacaaaaagaaagctagtatattaacgaaaatgataattctggtgtacatttcaaattagactccaggttgagaaaattaaaatcaacattataaaaggcaccaagttaagaactaagaaaaagaaaaggaacaagtagacagttcagaaaataaaaggcacgcttactttatcaaaatcctttacaaggttggcttcaatggatgaattattttcatattcttcccagagctccttgatctcatcagctacaaaaaacagaacactaaaagtagtgaagattgatgtcaaacatcatccttcatgaactcggacgtcacatcccaaatggacacaaacctattggtcctccaccgagaacttcacacatttcatttagagccttttgttcacggcggcttttttccgctttaggtataccgtcggatggagtaatgtcaccaacaatagctgtcaaacaaaaaggataaaaacctgaatataaaaggatgctaagaaaagtgggaacatacagattatacagtcctagaataaggatgataaatattggcagatgaagtgcaataacatattatcaacaagtgcatacaatagaaaattaagctaaaaacagctgatagggtgttctttggcataccttcagcaatgtcatgcacgatagcaattttgatgcatctgttttaggtaaaataaatatgtcatcacaaacaagtaaataactaatgactaatttagaaaggaagcctgaaacatctggtattttgttgtaatcaattaactagatgaacaaagaacagacgaaagggcattttttaatgctatggaaatttgaataagaaaaacacggacctttctcgatctacagcaggtaggtcaccggcaatcaaagccataagggccatacggtacatgtgatcagcaatagactcaggaccctttatgctatggtttatccagcctttccttttagtggtctgtataacagaacagaaacatgcacaactcaatatatcgcagaataataacgagtataatagacctaggcaacacatgcatggagagatgaacaattgaacaggatccagacgcttgttcatatgcttgttgctggtcacacatcccacctacttatgacatcgtaagcaaggtacccatgatgcgagacttcatggaatcatggtaatcaattcacaatacaaaatggcgattatgaaacccctcatagctgttccacattccccaagctgttactctagaaattaagggggtatcaccagcccggttgtacacacgcggtcagcgaaggacaggcatatgccttcggagcgacgtatccagaggcgatcggatcacgaggaacatcccgttggcgtaccttaaggcgatggcagagggtgaggaaatcgatggccgaggaggcagacgacgccgcggcggagggcggcgccgcggcggccgcgtcggccggcgcaggcgtcgtccgcctagggacgggcgatccgccgggtccagggatcccggaggcggcgcggacgccgggcgcgaggcggcgccgcgccgggcgctccacggggagcgaggccgggaggatgccccgcggcgcgcggcgctggaggccgccccctggaggggccggcagccgcgtggtcacgcccatcggaggtagggctcgaggtgcgctgtggatcggagcttgtggtggtggcggaggcggaaggctacggatcaatgggatgggatcgccggaggaataggcagcggcggcgggtctcctctcctctcctttgcctctgctcggggtaggtaggatcacgaccgcacgagacgaaggcgtccgatcggacggccaggggtgcatccgctcgaacatgccgtaacgcctcgtgatcatccggccgtccattccgtccattttaatcgttcgccgttcattacgcaggagcagcacatggtgctagtgctatagggacaagccaattttgcttgcgcgtcatcttgattcgtgctctaaacagcatctggaatcgagtactcggaattatacatcctgattttgttcttttattaacattctgcaaagatgtcgattacactgcaatagtacagtgggtctacttcatgaccatatatgatgagattgtaaacttcgtcggcagctctgtcacaataatctcttctaagctcgatcttatcataggccaagcattaggattcgcagcgatcatacgacgatgaagctgaggtgctggaccgttaaggcatttacatcaatcacacagctcctcaaattagccatagcgaatgcgattagattacactgagatatagcgataacaaattatcagtgacgccatcagatcaagttcgtcaggggcctcggtgccgaccgaagcacgagaagcatccctgtggctggtcggtcgggatcatgccaccgcccttggacgtgtcgatcgcctccagcatggacaccacctccgccatcgccggccgcttgtccgggttcgcgtcccagcagcgcttcatcacgttggccaaggagctagggcagcagcgcggtatctcaggcctcaagttctgtagtacatcatcaatcaaggatggtgattttcttttcagtgcttcagagttcaggaatcagagaggtgaagtggggaaaacgggataggacggcgtttttttttatttacctgacgaacaacagctgaagtgacctctgagaaactcagatcaggatacggcatatcgcagcagtatatctcccataggcagattccaaagctatatacatcacacttcctgttgtaaggatggccgttgagaacctgcacaatgatgccaacgtatgacagtaaggacaataacagtagactagaattacggaagaatggtacgtgcaattttggaagatcgcagaaacacaacatgacaatgaataagatgattgaggggatgcagggttaagattttccattcgccaagcaataagttttttgaacgataccagcaaggaaattttcagtgacatatagtcacttttcccttcttaattcgatagtttggtataagtaaagacctatcagcataaatgatacatgatcagcataagatttccgtatggttgaaggaaaatacctcgggtgccatgtaaccaagtgtgcctgtttcacccgtcatatcactaggatttgaagcctcaattcgtgcaacaccaaaatcagcgattttcactgttcttgatttgtcaaggagcatattttcagtcttcacatcacgatgaactatcttctttgagtgaagatagcttaatctgtcagtgcaaatcccacaacaaaatcttctgagattaaaacggaataatagatgtaaatccagaaaaaggaccaagagaaacatatattattacttaccccctagcaaggtcaagagccaattggaccacaactttataggctagcttccttctcctgttctttatcagaaaatttttcagtgcacctccggcaaggtactcgacaacaacgcagcaaatattacttggcatgccaaaatgtccatgttctgtctgtatatttaaatctcttgcacccattatagccccaataaactgtcagttaaatttcaagatattgtcaggacccagttgagaagcagaagacaactacgttcaccaagtgaatgaaaaaaataatgataattgttgatagctcaaaatgaactgtgtagatggcagatactaatatttattgcttggtaaattcggcaccatgttctaaaatcaattccattgtaattatgccataccaaataggagtacgcaccttcaaataggagtacgcaccttcgctactattatcagaaaaaaaatattgtccaattatacaagattctaatgctctttagcagtgcatggctaaacaccttaataactattttatacagaagaggaaaacatggaatccaattttagacacgatactgggtgtattatatagctagcaccagagtttgaacatgactgccagtcctcctactgtcatatctgatatctctagccatgaaaatattattgcaccacaaccaatggtttccttaatagattataatgccagagatacatcatgataaaacaagtttgcccatgtggttgtgccggacaatattgaatacaaattggttttgtaaaccagggctaataaatgtaaatttcccaaatgttctgtaaaccagagataatgtaaattggtctatatatttatcagtgaaacgatttaacctatgaaatttgaagggatgaaaaaaaaaagtcttctccagtcaaagattaccttggtaacatttggatgatcaagcttatgccagacagcgacctcttgtgcaaatgctgctcttagtgaagaaatttctcgttctgatctatggccatcctccccccagtcaagcattttgactggatgatagagaagatatatcagttacttcgacaatgaaactacaagtagaaataaaaagtcttttttgcatttagcaattgattcgaagacaaagttatattgaagtagtaatgctgcatattactacatcaatacacattctttttttaatgtaaatcaatagcacattcttgatgagggtaacaaaatcttggtgaactgtgcatgtctctgttttcctaaaagtgtatttagcaattagctgttaattgccaagtttgaatctatctgggggaatataatgtgacaagtgatgaattattcatgcaaaagcagtgaggaagctggttttgtcatacaaactaaagtggtagagaaaggcaagccaataaaaaactccagtgagttagcaaatactttgaaaaataaaaaaaagaacatgctggaggaacactgccatttaaaggaagctgatggggacttgaaccctgactaaaaccaccgctaccttgtgctaccaggttacatgagcatcaccaagtgatttaggattctaatgacctcttatgaatctaactgatactttccatttcaagacattgtactcaatttcctggtgaaccaatatattgaaaggacggcatgcaataggtgataaagttctggacagaaaaaaccactgcatctgcttttgccttctgtcatgtgattatagctggtgatacagtgcaaaattgctaatccggaccttttatcaacccgaatttggttcagatgcttttgaattttcctggtccctgaaaagtactgtgcctagttgcaacttgcaactttttgatctgaaatatccgctgctttaatatgtaatcttcaacttccaggtgctcatcataagacaaaacacatgaatcatgcctattaaaacttttaactgttggttggttcaatcacatgagaagggttgcacgccaaaagcacgcttatctacccagaagtcacggaatacaccatggaatcaagaaaagcagaggtatcacctttagcaatttgctgacaaggaaaagcactaatgacacgacgagcgaaaacaacttccaaaagcacccgaaacaaccgcacctatggtaaatgacgtttgccatctatcaatcgatcggctctactccataatccatatcctaatccaggaagaagaacataccgatgaaaataattaaatcacgcatcaaactttcctaaaaacttggagaggaatcgatcggaaccagaagctaacgcaggcagaagaagccactaacgagtactagtaagcaacaggccatttcatcgaatagctcatggtcatggacagcaaaaaaaacttggtcagcgccgagtggacgaatatatctgcaaagcaatcagctgtttatagcagaggggcgaaagaaaaaaaaataccagcgacgtcctggccgtcgtagacgccgcggtggacggtgccgaacgtgccgcgggcgatgacgcctctgatgacgagcttggcggggtcgatctcccagtcctcccggcgccgctgatggtgcggcgcctgcggcggctcctccccgagcccgagcctggcggactcgccgcggcggctcccgctgcccccgtgctgcgacgcggcccgctccgcggggcggccgaggtggcgctccagctgctcgtcgaggctcttgaggtcgatctggtccgcccggacgaacccggcgtccccgctcccgccgcccgcgccgggatgcctcatcgcgctcaaacctgtcgtcggagctagcgatcgatcgagcgagctgggggggttgggttcggtggcccggggtgggtggaacgtctctgtactctggtggcgttgtggatgccgcggcgtggtggtggtggtggtcgcggtggctacaggggaaggggacgggttggcgaggcggggacggaggcggttcgaggtcgtcgtgtttggggagacgacgacgactccatgtgagagcgcattggggtgtggggggaaggcgaagtactaggcgcactaggagtaggccagtgatgatgacaacttgacaagtggtgaccgaaggagactcgtgtcgcgggggtggggcccgactggagggggggtcgtcagggagtcggaaagtcagagctcaggaggtttcgtttgtgtcattgggcccatttggcatctttttcggccgggccattggcccattagcatctgatttcgcataccgtgtgaactgtgaagtagtatcacgtgtgagttgtgatggcgtgagtctcgcgcctgcgcgcaaaacggtgcggccgttttttccgaatgttttgctcccttcaaatcttttccagtctacatagaatatataggagtattttgttgaactagtagcgggtgcactactacgtagtactatacctgtacaagtgtaatgtttgcaaattgcaatattattatcgttacgtagctgttttagtactgttaaaacctgtagaaaaattgcctcccacgaaaatctacagagaactgaaatgacagtagaaaaattggaaaaaaaagaggaattgtttttattaaaacaatcgcttgaaagtggtcctagaaccgtagttttattctaaaacgttccaaagagagaaacgtcaggctttctagtcggaataagttcacttcattacccatttgatcgaaatctaaaccataactctaaactacaaaaccagatatctcgatcttcaaactcctaaaaccggtgtaattggactccctgagcggttttgggggacggttttgctgacgtggcgccatgtggcgcctacgtggcaatattgaccgagtctttgttacacgtggtgttgatgtggcacctacgtggcggtagaaataaaaagtatgcgtgggacccattagtcattcacacaaaaagaaatgtgggcccaccttattcctcctccctctgtcccttctctctctttctttccccttcttccccttcggctggtggcgcgcggggacagcgagagcgagcg

SEQ ID NO: 17625 - DNA, 5669 bp, Oryza sativa
  unsure (1)..(5669): unsure at all n locations
ggtagggagcagtcggcgaaggggtagaaggggagagaaagtgagaaaagggagagagggagtaggaagaaggtgtgacatgtgggccccacatgtcagtgggcccatatttctttttgtgtgaatgactaatgggtcccacgcatactttttatttctactgccacgtaggtgccaagtcaatgccacgtgttacaaagactcgatcaatattgcacgtaggcgccacgtagcgccacgtcaggaaaaccgcctctcaaaaccgctcagggagtcaaattgcaccggttttaggagtttgggggtcgagatatctggttttgtagtttagggtcatggtttagatttcgatcacatttgagggtcatgaagtgaacttattccctttctagtcctgtaacaactttctacgtaaaattagagcccacgaaggcgacaattctggcccgttacagcgcctgaagaacagaaggcctagacagcagtcttgggccgcatcgagccatacaagcccaggaaataaagcagcccagttcaattctatcctgttactactaatttaatcgcgagaaaaatccccagcgggagagctcacgaactgttcccttcccatggcggcgctgcctctcctccggtggggcgcttcctccctccgaggaggccactcctccgctccgccttcgagccgcctcttctccgcgctccgccgacctcccgccgccgcccgctgcgagcccggctcgagggtcatgctcaaggggatggactaccctgagctcgaggtaagagtactcctctcggcgtacgagttccgtggatccgtttgcgagttgttggtcggaggtttccgttaagcttatctggcgcgctcttccgcagaattgggtgcggtcgcagggcttccggccagggcaggccatgatgctgtggaaatgcctctacgggaacaacgtatgggcgcattgctatgacgagctggctggtaggtttcagtgtttagttgttatgccacggactatattcgctataattttgcagtctacaggttaattcctctattagtaaccttgagagcacatatatactacaaatctacaatggtgtctatcctgaaggaaatgaatgccaaattgtcaactgccaaggagataaaatctactcataggatttctgaagttttgatgtgtcagcaaagttgtttatacatgaaaactgctaaattagaagtaggttagtggttctattcgaaagtaaaaaaacatgctactccttttagtctgcatgtacttgttgcattatgttcagatgtgcattttctgcaaccttactaccttcgttacagatcagttcagcatatatactttatctcttgctacattatgtaagcagcaaaatctaaaaattcgtcataattcataacagtagtatttttaggggcggattgaaaaccagcggcatttgatctaacttaacaatggtattagcgtttcagaaagtcatgctccattagtgttattttctgaatccccacataaatgtagattgattttgctatcaaatatcaagtagaatttattttcgacaagcaaaaccagtaactttaccaaagctttacaagttttaagattagctgtgatggatttatattgcaccattttgtctttcttgtttttgtgtaagggtgtattccagtgatccagccaattggaacctacaagtggatttagcaattatcttgtgtttctttttccctttgtaattttggttgaatgaatctgatcgtttgcatctaatttcatccaggtttaaacaaggacttcaggaaaatgctaacagatcatgctgatcttaaggcattaactgtgaaagacattcttaacgcgtcagatgggacccgaaaggtagtttcttctgtgttacttatatcttctgtactatcttcagatcattgattatggaacacagaatgctacagatactgttctctcttgaagatggatcagtgattgaaacagttgtcattccttgcactagtggcaggacaactgtctgtgtttcaagtcaagtgggttgtgccatgaattgtcagttttgcttcactggaaggttcgtttacttcttttgaataacacttaacttttcaatgattgtgttggtgataattttacagcgttgcttatattttcatgctatatctgtaggatgggcttgagaaagcatttgtctacagctgagattgttgagcaggctgtgtttgctcgtagactgttttcagatgaatttggatccatcacaaatgttgtatttatggtaagcatcctcctcatggtaactaatggctctagcttttatggtcgttgactgagcagctgactgtatagttaattaacataattcactttgtagtttacatcttgaatctgtatatatctatctttaacatgccaatatttttgaactgtcgaacatatccttaatgtgatatcttgtgccacaactgtcaagataatcatatagatatgtttttatgcactctgttttcttacaacatccccctgcttctgtctgtatttcatctcaatggtatcaatattaactgttgttaaaattcaattttgttaacttgttacattgttttggagaactgtgttagtttaactattagtcttatcatgaactcatgggtgtttaggtttgtaatattcactggcatataacagttaattgattgtctgccttgcatttattcatatgatgcttgcagatacttctacaacctttcattaatatcaaacttttacagggcatgggtgagccgttgcacaacattgacaatgtactaaaagcctcagctattatggttgatgagcagggccttcagtttagtcctcgcaaggtccctgtctccacaagcggtcttgtcccacagataaaacgcttcctacaggaatccaattgtgcgctggctgtgagtcttaatgcaacaactgatgaggtgaaatccagttttggttgttgtgttgcaaaagtggtttggcattgttctgttgtttctataagtctatactatctttttcttaggtgagaaactggataatgcctattaatagaaaatacaatctcagcttgcttcttggcacattaagggaggaaattcgtttgaaaaagaagtacaaagtgttttttgaatacgtcatgcttgctggagtgaacgacaggtgaggaacctttggattatacaaaaatttccctgattgttgttggcttgtggcaattatgttatgaagttgtcttgaatattatttcttaatacttgcgtaaaactgtttttttttcttatttggaggtattttacatataggccagaataatttagactataattgctactcttattgtaatcatctgttcatagggaattacttgtatgtcttggaaataaccttttttgtccttgcaataaaataagttaccccttggcccttgtatgattgtatcattaatatttctgtggattactatgcttacagtgtggatgacgcgaagagactagtagatttagttcgcgggatcccttgcaagatcaacctcatctctttcaatccccatagcgggtcacaattcaagcccactcctgatgagaaaattattgagtttcgtaacattttaattcaagatggccttgttgtatttgttcggctcagcagaggggatgatcagatggctgcctgtggacagctaggagagcctggggactaccagctacccctgctccgtgtacctgagaaattccaggtcgctttgtgactctaaacagtaagtacggtactacaatcctcatagatattgtagaatagctttgacaaaagacatgtaactttcatgcggttcttagaggtcattctctgggccaacctgacgactgacggaatatttttgttactttctttaaggaaaatttttgttgttactacaacaagacagtgtcttcagctggcttatggcatgtaaaagaacatttaggcatagtgccgctaatctgctaagtaccaaaatccagtattttccatggatgtgtgacgcttcatctctccctatccgaattgccattggattttagcaatatatgtctgcattaatgcttccactgtgcaatacaaggagataaacctaaatcatgcaactttcaagttcatggcatttaggcactttgcatagttcctgattcggcctaagtcgtcaaagttaattctttggttagtgcaggtatgacaggcatctccaaaaggttttacaagattgtgccttgcttgagataccttaaccattaaggtgtgcatgccattgccacgacctgaccaccatacggaaggaaaggaaaagccaatctagcgcaaaccccacctgtaaaagtcacttctttccaaaagcaactctattatgctgcacatattgggcgtctttagcactaatctgctgccgaactggcagtctacacgtctactcgttgctttagcagaggcatagattttgacagttgctgattttgtatatggcctagtttagttaccaattttttcttcaaacttctaatttttccatcacattaaaacttttctacatacatataaactttcaatttttcatcacatcgttccaatttcaaccaaacttttaattttagcgtgaactaaacacaccatgtctgttctcttctgcgagtggctcttctttcaattatattttcggcactggattcttgatatttgacacaagctttaatatacggactacgtgttcatctcctcacctgctcaccagttttagcaggaccgacatctgctggggagccttggcgacaagggttgtgacatttgctgttgtcaagtccactttgaactaattcttttcttccatgttaaataaaagcacaaccttttcatgggccccccttgtgaaacatcctctattaaattctggtttcagctgctcaaggcacctagcaggagtacttgccctccaggaatccctccctgtctaaaaaagaatcattctacatgccatcactaaaacactatctgttattgtttatagcggaggcaattattaaagagtggtcctgttcgatctgctgcatttgttttacagcgattatacatcctcagagatcatttctttggacaaatatggtttacgaggtccatgacgtacatgtcaaggcagcaaaacataaaaactgacagcaactcatgttcactacagggcccacaaaatcatctcaaaccggatggattagcggcctcttgtgcgaactactactgccaatcgcacgtcttcacgatgtctgtctctactagggagtatactggtcttttcctggacagaaataactccctgtccatttcgctcctaatatcatacaatcgttttgacccttaatttgtagccgtcaaagacggctccaattcgcctaccacgacgatgacatggcaattatttacgggtaataattccatcatgctagcaaatccaaacttaaataagagtatagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17626 - DNA, 373 bp, Oryza sativa
tgtttaaacactttatttgagagtattggtgcatgatacaggtcgatttttctaaattatctccacaagtagtttggcggcattttgagaccttatgtacaattcctcgaccatctaaacatgaacaacggttaagacacatttaaaagattgggcagaacagcgcaatttggaaacctatgtcgataacattggtaacctaattattcgaaaagcggcaagtacgggtaaagaacaggctgctggtgtgattttgcaaggtcatctggatatggtgacacaagccaatcgtggtacccagcatgatttttttaaagatccaattcaaccagtcttaaaagatggttggctgattgctgaaaataccacgctt

SEQ ID NO: 17627 - DNA, 3364 bp, Oryza sativa
  unsure (1)..(3364): unsure at all n locations
acaaataaatatttacttacaccacattgttataaaaattacagtgcacttacatgttatatcaactgaatttacaaatgtaatttttgttatatatgactgaaattttgtatttatttttattttaggttcaattgagagagaacgagagagaacagcgtgtatatcaattttttagagcgcaaaaaaacaaattagcgcctctaacccgtccgattgaatcctatgcggattcccagcgctatatgtgcaggaatcttggcacttatcgaacagcctaaaaaacgacaaatcctatagaaaaaatcacacgacaaatctatagcaaaatcgttgctaaaaaacttgcataatcttttctctccaaaaatttcgaactttttaccgttggaccatcttgagattcatgacgagaggaaatctttttttaaaaaaagatcacacacagcacgtactaacgagtggtcgaatacacgattggaagattgatagccaacagggctacacaacattttttgatttgttatatatgaacgagaattacgtacttcctccatttcacaatgtaagtcattgtagcatttttcacattcatatagttggtaatgaatctagacatataagtatatctagattcattaataactatatgaatatgagaaatgttagaatgacttacattgtgaaacagagggagtattaaacaaatacagaatattgcttttgtaattacagtttaattataatacgtttacatctgaaagtttttcatctctactattataagatgtttctgctgatactttgatacatcgactctatttaagtcggtttttaaatccgttcgcttttgacaacacataacgagtccctataagaaattcttttaaaaaacttacatctcacttaggatgagagtcgtacttttaattgcttcagaatttctaccaagccataggaaaacaatatataggatacggccataatccctacaagggatccgaactgaatatcaataatatctcaaaataaaattcccatatacttttttagacaaaaaaaatatctaacaataatacgattaaaatagccttcacccgtagtaacgcacggacatgttttctaatcaaaaaatatctaatgttatatcgctactcctttttttttttggaaaaatatccaaaaatccctatctgcatccaccttaattttatcccactcactatcctactatctcactttctatccatcccctctgcctcaaatatgagtcaaaagtgtatctctatctccattgctctcccatatggtgtcttcccctgcttttttttcttgggagtataagatcgataagatatagaaggatgagatatatggcacaaaattaaaatgatatctgaagcatgcagagaaatatggagcctttaaaaaaagtattatctttcttcagatttagggagttaaaaatagggagatcgatgaagataccttataggataacaaaaagcccgtcaacgccggacatacaggagagaagagtcttgaagtcttaacaaggtgatagtgatttgcgcacaacttgcttgagagagtaggtaaacaacctagtcagtcaatgcccccctcatcaaggcccaattgtcagcagtacggtctccactatacatcagtacatgaatgttcttatctgtgcgacagtgggagtgtgggatgatgtgtatatataagcttgggcattgtcatttgcaggggccaagttgcgcggggttgtattgactgaatggcgctcttggcttacttcaccgttttcgtgttagcagcatctgttcctgccaccggccaacaaggtatgctttttcgttcttcctttttccgtcgattgcgcaattcagcccggccctctctagttttattgttgcacgcgtgtttcagtaagcaagacattcaaaattattttcggtgactactgtttctatcatctatggaggtgctctggaatctccgaaatataaaaccatgtcgattttgggtctggccatctctaagctaaatttgggtaaacttaagaaaacctctccaaaccatccgactaatcaaactcccctacaatctggccaaatgatgagcccaggggtggagctagagcaacatgcatggaggggaggggaggggggtgtgcaccgctatatattgtatagtatttttttttgttagcaaatggagtagtagaacactactaatttttggcatcaataattcaacataagcaaaagtaaggaaaagaatattcttaccgaaatggagaataccagtgacaatattgttcagtaacttatatagtgcaatagtgaagatggtaagactaaaaatcacaaaacagttttgctcgaattatagaactacaaatctaatactacctcatttaatgaatgaaatcatccattatttccaaaacaagaaataatatctcatcatcttaataagtgataaaatggcctaatttctaatttaaaaacgtcaacatatagcctccagatccatagctcttccgtcccttttgctgctcctttttgctaccggccgaggtcgatggggctcgcatagtggcttctagatcccgaccatctcgttgctctcctctgtgaccaccatgtacggccatgtcactaaaataaagctcaaccccctcttctagcccttcccactactacaaaacaccacataaagactgaccttataggtgcctaaaatcggcaccaatagtcttccaaatcatcggtgctggtttttataataaatcggtacctatgaacattatataggtgccaattcatataataactggcacctacaagtgcggtgccatatgtaccggtttttatcatgaatcaacacatatggacttcacatatgtttcgtttcttaattaaaaccggcacttatgagcccataggtgtcggtttatgatgtggaactcatatatgtgcattttttatctattgttttcatataatggcggatgaaaacaaactttatattaactgtagagctcaatgagacctacaccttttttatgactttttgatttatggccgtttcgatggggatctgaacatatgttgtaaggtcttggatctatttgcgtaagtgaatatttaaaatttataaaaaatttcagatggagacgtaacctatatgaaagttgtagatctaaatgggatctacaattttttagttgacaaaattttcatctaagttcatatattgtgttaaatatgttcggatagcagtactctcaaaataatatnnnnnnnnnnnnnnnnnnnnnnnnnnnnnnnnnnnnnnnnnnnnnnnnnnnnnnnnn

SEQ ID NO: 17628 - DNA, 5877 bp, Oryza sativa
  unsure (1)..(5877): unsure at all n locations
nnnnnnnnnnnnnnnnnnnnnnnnnnnnnnnnnnnnnnnnnnnnnnnnnnnnnnncatctgcgatgagtgcgctcttctccatcatcttctacaatcggctccagtcttgggaattcggcttctgtcaaagatggccgattgacaactttcatgaccatcagatttaacgaagtctgcaatagccaccatggtccacctgctccaactactgatctgatagctatcttagctgatgcattattcaacatttggtatagatagccgagaaggattttgcctagaggaaattgctttttcgattctagggcttcggctacaaattaccaattggttgtaggaccacaactggatccacagaagaggaacttctctagccacattagcaagaaagctacatgctcccgaggagtgacagggcctttgcccatatatgccgctatatagccagactaaccccctatgcttttggtcttgaaatcaaattggttcttggtgttcatactcatagggttagccgatgaggttacatctaatccagtgatcatggtgatgtcgatcagggttggagtcatcggcccttggttgaacaaaaaggcattgatagtgttggaccaaatataagtggcggcggccatcagaggttcatctttagctgaattggctatggtaagggcaagcgcttggccgattccaatctcgtcctagtgaactttcttgctagccgatacgcgcttataccatgtagtccaacttttctcgggtggagttttatcgagagatggccaagatttgaaggtatttttctagtgacctagatttgggttggccaatctgaaaggaatcctattggttttgctgataatgaactcggtaggatcagggttgccgactgcgccgaggaaatagtaattttcatgcgacaggttgggaattgcaactaggttggagagatgctacaaatccaaaggaaccgagaaggagaaaacaagatgagttggaaaatgaatctgttgcgaagaaaagggatctagccgatgagaacttacctcagcatactcggccgacgatgcggtagacgggctcgcatagtggcttctagatcccgaccatctcgttgctctcctctgtgaccaccatgtacggccatgtcactaaaataaagctcaaccccctcttctagcccttcccactactacaaaacaccacataaagactgaccttataggtgcctaaaatcggcaccaatagtcttccaaatcatcggtgctggtttttataataaatcggtacctatgaacattatataggtgccaattcatataataactggcacctacaagtgcggtgccatatgtaccggtttttatcatgaatcaacacatatggacttcacatatgtttcgtttcttaattaaaaccggcacttatgagcccataggtgtcggtttatgatgtggaactcatatatgtgcattttttatctattgttttcatataatggcggatgaaaacaaactttatattaactgtagagctcaatgagacctacaccttttttatgactttttgatttatggccgtttcgatatctgaacatatgttgtaaggtcttggatctatttgcgtaagtgaatatttaaaatttataaaaaatttcagatggagacgtaacctatatgaaagttgtagatctaaatgggatctacaattttttagttgacaaaattttcatctaagttcatatattgtgttaaatatgttcggatagcagtactctcaaaataatatcagttgtttttaagacatgtgtttgtaggttcgatagtaaggatgctttcgatggagagagatgtcttgcttgagtcatatgtatgaatataggtgccttgtgggaagtgaattgtgaccatataggtgcctaataaaataccaaatatttattcagatttttttagcaccttcaaaaaaaagccgggtacacccctatataaactggcacctatagtgtgacataggtgccttttcaagaatcagcaccaatgactatccaagtcattggtgccgaataatttgtgtggcactgaaatcggtacctactagaaaattggcgtgccttttggcatgccggctgattagctggtttctctttgtaggttttactaaattttatttattttatataagattaattaaaaatgttatatttggcagggcctccaaaaacgttgtgagtagataaagagaggaattattgcattgggatttgataactgcttatatctacggtgttatgtcagccggtgaatatttcgaagtatgggtgtgaatgttgggtgtttgggatgatatgtacatatattgggtagagcttggttcatcaagtactctctccatctcaaaatataaacatttctgaaggcttcgtgagaattaaaaaaatatgtgaaataaaatatgaaaaaaattaattgttgagaagataaagtaggtgaaaaattaaatgggagatggttgtgattggcttcatgggaattaagaaaatatgtgaaataaaatgtgaaaaaaaataatagttgagaagataaagtaggtgaaaaattaaatgggagatgattgtgattgaatttattttttttagaaaaaaatattttttaggtatattttttataaatgtgtagacttaaaagtaaatattggaaaataaattacaaagaaaaaccatcgaattcaactacaaaattatgttttgaaattcaaaatttatttgtggctaataagttgaagagcagacgaattttgcaattattttgttgtttatgctatcttatatgttatttacgctaataccatacatgcaaaactcttgtagcaacgcgcgatgtttcatctaaattataatcaaaacaagtaacaggtatatgaattaatgatggttacttcaagttgattactccttcagttctattattatacaaaatctaaatttcatatggttatggcaacaaatatgtaagtcataaatgaatctatataggggtatcaaaatttgtaagggtcagaattataaaaatgcaggagggtgcatatcagaattttgtggggtcttctttttccattcaagccgaactgttgcgtgtggtcttttttttttttcttgggactatttatatttatatttatgacgtcatattttttatggaaaaatagttaacatgtttttacattgtaattgtaagttactaaattacatatgtaattttattgtatttaccatgtaggttttaaaattacatatgtaattttcgtgtatttacaatgtaagtataaaaattacatatgtaattagtctaatcacataatgtaattattagtctaatcaccttgtattaccatattgtaagcctgtttaataggtccaaccacgtgaggcccaatacgaaaaccgaatagtcctacaccagcaccgtacctatctccacgcgcatcgaacggttataaaaaagtggcgacagaactatagcaacaccgttttttatatccgagccgaactgcttttatctctccgcgtggcgttcgccgctcattgcgagtcgatctttttatctcttcccttgcccactctttttttctctcagttccttcgctcgccgtaaaaatcgccatgggccatggctgctgctctctctccctatcgcttgcttagcttgtgctaatagctcgaacttgattcagcgatggtggaggatcaggcagcggtgctcggtggcccggcatcgttcattccctcccttcctctttctttctcctcaccagcttttccttcagccacgttggcccagatctggcggtggatcgagtcaggggatagctgttgagaggtggcgagggtggtgttcgctggatccgggccaaagatcctgccgtcctttcctctatccttgtcggattctccatagtccatactcggtgacggcatggtgatcaagcaaggggaatctatgttcttgatgtttttatttcttttgcttggattctttttttttaatttttttcccctctaatcccgactgttctagatgagattgcacattttgtgaaggatccgttgaaggttttttcaccattgatatattatcggacggctgcaggatggttgggaatacgtggcacgttctccggccgagaatccggctggagctctgggcgtggtgctacgtggcccaatgaggagtcagggttgtaaccctgaaatcggtttataagataggacctttagaactggcgcctttgggcttttctgtagtagtgtccgcctacctccgtcatagcccatgatgtcatggatcacacaagagagaaatagaggtagacacatgacggagagaagaacaggggaggagacattgacatatgggatctagaagatttggagaatggaaaatgaagatgctggttgagtgtgtaagtaatatgaagagaaatttatttggctgttgccaaatgagcacatagaaagttgttttatgtgacttacatgaggaaaaagtttgatttgtggcattcaaaactgtctcaaaataagttgatctagagctttttgccttggtcctatttgagaagcttaagattttaaagaacagctagtgagaaaattggaaaaaaagatgatttttttatctttaattttctgctttctagttcgttttctggattctataactatacccctcataatctgattgaaaatatgaattgtttaaaaaactaaagattttaggaagaacatataggtatgcatgctactccaaacagacctagtctctagatagagtccaaaatgatttttatcccttgcagccaagccaggatttcgactctgaaggatcccccagcaagggatttataagaacatacataagaatattcccgaaagaaagacatacataagcatatattgtacaaagtaatgactaatctacaaaatcaacactcatgccataaccttttgtcgtaacatgagaaggtaagcgggcgccattgttaattgacggtgcacccacgcatgcaaccgccgcctcctccacctgtacatgtccatcctatcgacgcatagagcctcggctgggagtagcacctggtggtggccatgacaacggcatcgaacatttcctccatctccaccttgcggtcgcgcttgcttctcaccgtccatcgcaggtccacagcgagccatcacgctgccgcggcagcgcccactgcttggggagccgccgccgccggatctgccactcaaaaacactactagaaaaagcatttccatagtcggccaaaacagtttttgacatgcggctagtcgcgacaactgcaatttaaggcctaaagtgatctgcctatgaaaatgttttcagagtgcaaaaaaaaacctgctgattccaaaatatccccctatggtagatccaaattcctctattccccttgccacccataatccattcacaaacttatcacaatcctcaaaatccattcaataaattgatcacaaaaaggggtcaaagagtaagattccgaggctggaaagtggatccacgcttccaaggctggcggttggtggatccatgcccctgaggctagccagtgctggatgatccggtcccacaaggcctggtgactgcaggcagggtcgacggcaggagctaaggagaaatgccaggctcggtggtgtggatgcaagctcctgaggcctagaggcgccgtggccggtagcaaaagtcatattgtggatccgtgctccctatccatcacgtgcatgggtataggtgtccaaannnnnnnnnnnnnnnnnnnnnnnnnnnnnnnnnnnnnnnnnnnnnnnnnnn

SEQ ID NO: 17629 - DNA, 1111 bp, Oryza sativa
  unsure (1)..(1111): unsure at all n locations
nnnnnnnnnnnnnnnnnnnnnnnnnnnnnnnnnnnnnnnnnnnnnnnnnnnttcagtagtcttatagcctgtttgcattgtttgccttgtatgtcgttagattccggctcttccgacgctccggtgtacttcgaaatagtcgctgaggttccttcagcagcagagcaaggcaagtcatacttgtcacttgatcatgttgatcctacattgcaaatgttctattgttttccttcaaatactgcatttgttttgcaataacactatgggatgtttacctattgttacagccatactattttggtaccttgctcctttgttagctcgggttataacatgaatagattttggactaggagttgcttagccatgcttagttcaactagcacacaatggggaaatctcatttaaaatatagcctgtaggtttatatgataatgttggattagtaccaccgctttggtgttagttaattaaaatgaatcacatggtgggctgtgggtgcatagttctgctagtcgcacccatggcaagtaaggaccggttcgcgggaaaccctggaagaactcctcgtacttaccacaagccagcgtgggcaacggctgggcttgtagtgtagcttttctctagctgacgcatcctggcaagggtgggcgtgatggagcggggtgggccctgcgacggcctctgtcgcttccggattcacctaggtatgagaggggactgcccgtcgcccgctggggacgggggtgaaacctgaggtgtggtgtacttggctagagggggttatgcgaagggtcctgtcacagtctctttccgatatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcaccgtgattagactcatcttagtttagtctaatgaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17630 - DNA, 801 bp, Oryza sativa
  unsure (1)..(801): unsure at all n locations
nnnnnnnnnnnnnnnnnnnnnnnnnnnnnnnnnnnnnnnnnnnnnnnnnnnnnnnnnnnnnnattttggtaccttgctcctttgttagctcgggttataacatgaatagattttggactaggagttgcttagccatgcttagttcaactagcacacaatggggaaatctcatttaaaatatagactgtaggtttatatgataatgttggattagtaccaccgctttggtgttagttaattaaaatgaatcacatggtgggctgtgggtgcatagttctgctagtcgcacccatggcaagtaaggaccggttcgcgggaaaccctggaagaactcctcgtacttaccacaagccagcgtgggcaacggctgggcttgtagtgtagcttttctctagctgacgcatcctggcaagggtgggcgtgatggagcggggtgggccctgcgacggcctctgtcgcttccggattcacctaggtatgagaggggactgcccgtcgcccgctggggacgggggtgaaacctgaggtgtggtgtacttggctagagggggttatgcgaagggtcctgtcacagtctctttccgatatgtcgtggtggcatgtcggcgcacggaaacgtgtcgtggggctgtgtcttgtgggtacagttgtacacctctgatcagagtaaaactattcgaatagccatgcccgcggttatgggcggtcaaccagattcaccgtgattagactcatcttagtttagtctaatgaaattggatggtataggggtaccgagctcgaattcgccctatagtagtc

SEQ ID NO: 17631 - DNA, 2100 bp, Oryza sativa
  unsure (1)..(2100): unsure at all n locations
nnnnnnnnnnnnnnnnnnnnnnnnnnnnnnnnnnnnnnnnnnnnnnnnnnnnnnnnnnnnnnnnnnnnnnngcagatctcaggtgaaggtgtggtttcggaggcactgctccttccaatctctcgtgctcgcaagagatcagaagcgaggaagcgagaacagcataggcgcggaggaggaggaactaacaccgggaaagaagcaatcgatcagaacagatcggactcgcggcctccttatctatcaggagagagaggcaatcgtgaaaacgtggacgcgctgttgcggagagagtcgtgggaacgtcggttagtggctgcaaaagaatagcgacgtgacgcacacacgccgctagccagccacgcctcgccctcgccctcggccacgccccggcccggcccgcgcgcgcgtgcgtgtggcattccgacccccacctcaaccagtcaactgggagcctccaataactccctatttaggttgagatattcctcgcttaaatcctgaggtggtattattatccttaacatttattatgggcctttgagatttaataggataagttgggcctagcccaattattctaacaataatttcatttcacagcttgtctgtgaggatgttttgatttgagtaatatattttcccttcccaaaaaataatattggtcaaatatttaaagagttgaattttaataagatacatgtgcatcctagtgagggtgacgaagggagtagtatgcataatacacatcgctgaaaatcttgtcaagtttatttccaatgcaacaaatagtgtcatttggatttcccaataagaagtaaagatcaaattactgaatggcttcgcggaatccaaatgcgaattgatttcgggatgaccttcgaactagctgtctccagcaatttcacagccatttcatcacacaactaggatggttgttcttagcgtaaatatccctggtatctaagtacttgatagactatgttgattcaaatataaaccactttttgtcagtagtgtgatactctctccgtttcataatataaggcacaactatttttttgatgtttcataatataagacatacatgcatgcatacaattaattaggacctcttctccattaaattattgcttttttaaatcatccacccttaaaatttctaattctattggatgcatgcattacatttattagggggatccaaactaggagataataataattgtttcttgatctttgggttatgggtggttgtgtcttatattttggaatggagggagtaataaatatttgagaaagatctctacacctttctcttgtgattgcttgcagtattactaatatttgatcactcttcttcataagtgacaactattcaccacgggaggattactgaccaaggaaaccggtcttcaagccattttcggttaatttctaagagaaaagaattagagggatttattttacaactattatgatgtggaattattttaccttaagccccttcaaacggaatgaagccttacctggatctaccactcttccgtatagattcagatccaaagtctaacttcaacagcggaaaggcaaataatgtgaacagtgtagtcacttcaagaagagtttgtaattaaccatttaatctatccacatttgtaacgatcccatattcccatccacaataaacagacaagaagaccgattctgatatagtgcaatttatactatgctacctacatgttaatgtagcatatctctctgtttacccatctgaagtcggaggattaggttccctttcgcatcagctaaaaatccttagtctatatcttatttggcaatttgtcaagttggcagttttgaagttttcgaagtgttaattgtagtagttacaggtacagatctagtagtgccacttggatgcaccattttcctacacagatgtataaatcgaaaactaatttaatagtgctatttttctagaaaagtctattttacacaatcctaaactgattcagatctactcaaggagctggtctgaacagggtaacaagcagagtggatagaagtagttttaggaaagggttaatttgatgcatg

SEQ ID NO: 17632 - DNA, 3426 bp, Oryza sativa
  unsure (1)..(3426): unsure at all n locations
aagtagttttaggaaagggttaatttgatgcatgccactataaatatgacatattaaaaaaatagcattacaatttgtgttatcgactgggtgccactcaaaatttctaaaattaaaaccatgccactctcgtaactaatttcgtcctcctctctcaggtcgccttcctcacccgtgacatcatgcacagggctccaacggcaaggtagggacatcgtgcaccgggctccaatggtgagcttcccaaggagggcggcggcgtacatgcgcgccatcaaaccacggcccgccggagcacgaagcactcaaggtagggtaccatgaaggccacgcgcgaagcactggttcctctcatagccggacaggtcactcccaatcagctccttgatttgggacaggccgtgcgacgggccggacaccgaggtggtaagcacgtccaggtccacggtcgccgtcttcctgacattggtgagctcggcggcgagccccgcggcaatgtccgccgcctcggcggcgctcgacagggtcatctcctgcactacgaagtggagcagcgtggcttcccgtcggtgccctcgacataggtgaatttgagcagcgcttcgagcttgaacgccatggcgccgccgcaggaggtcccaacgttcatcctgttcccggtcttgagcatagcctccagcagcttcaggaataacttgctggacattagctccctgcacgcgtccttccagacaccaagaacagcatgccaattaaactccgagtataataaatttacaattacaagcaggatcgctgagaccggcggccattgcgacgaacacccaagattcacctcgagcatctcgaacgacttcctgatgtgtccgacctcgtcggcgaaggtctcccggtacatcatcgtgattaccaccttcagcagcctttccgccgagaccaggccgtcgacgtcgccgtcatagccggacaatgtcgacctcgtccttccagctgctgtgccgacaggccgttccctgcgaacaattgttatgtggggaattccctttcagcggcacgggcgaacggacgaacgccgtgcctgacgggtgatctagcgccaactgaattcggtggattcggatttgcttcacagtttgtttctgttatcccttttaattagcaagtttgttagcatgtaaggctactattgacgtaaaacacgtggcctgggagatatgcttaactctagtgcaggtccaaaactcgccttcgggtatgctagcgtgccagttgatttgatcctgcaatcaataagaaataaagacaaagaaaccgcggttaaacctataaacgatagccgatcggcttgagtgccgatgacatatcatttatctttgagccgatgtcatataggtatcgatcgacaatcatgaataaataagaaggaactaaatcaactcgatcggatgtagatattaacaatatatactccttatattgatatatacttaaatcaagtgattgggatagatcggtcgccatgccgagacaatataaatcgctttgatcgaaatatatattgataatgggactatatatgttcatagcatagccgatcagatagatctaacatgtatcggctaatactccgataccactctatattaagatattaaagcaagtagaatatatcaaacaaaggcctaataaacttaaatgcaacgagatcttaacataaaggacagatttaacatatcaacgaagcatatagagtaaatatagttaaatcaggtaagatctgatgaaaccctgatatatactatcctaatcggcaaccaagaagcaggccagatattggaattttaatcacgacttataagatcaaactcaactgatgcagctatcgagttttatagagtggtggataccttatataatctaagtcaacatcgatatctaacctaatcggctgccctctaccgacaaatgttagccttttgtaggttagatagcaatattgccagagattatgatatatgataactcgatgaattacataaacaagattagagtatcataaagatggaagcactaatcccgagaacgcaagccgccataacaagttttacctcttgttgaagatcgaaaccgatgcagctcaacctgaaagcaaaaactcgtcgaaacacaacaaaagtaaaagggtggcgatgcgcagagattgtattgaacatgtattaattaattacatggggttcggggtctatttatacccgagaattacaaactatgtccatatcagacacgactcttatctctaacaaactctaagataccataagtctttacggcagacttttgcccaaacatatctctaaggaaattacataaaatatcctaattaatagatacaactgccttctcaggactctatccatgcacagcaatcatcatgaagctcatcaacctaaaccgacaacgtttgctgtgtcatatcgtcggattcagnnnnnnnnnnnnnnnnnnnnnnnnnnnnnnnnngtcgatcttagccgtagccgattcggactacagccgatcttactatgttctccgatcaatttccatctcgaattctactttgattccatctccatctctgatacttagattaccaaatttggtcgttaacacatgccccccaagtccggaatattggataatgttttggatttgccatacgtcaattccgagaaaactccgttctcgccgtttcccgaccgttattcaagcgctttaaatactaaccattacccccaagaaatctcacaccgtcttcttccgtttccaccgctgaggccaacactgtcctctctctcttcggcgatttctccgacgcacaaggcgatccccaagcgacttcatctccggctagatctccgcccgcggcgatgtcatcctctgccggcccgtctaccgcatcgtcggccgagtatgctgaggtaagttctcatcggctagatcccttttcttcgcaacagattcattttccaactcatcttgttttctccttctcggttcctttggatttgtagcatctctccaacctagttgcaattcccaacctgtcgcatgaaaattactatttcctcggcgcagtcggcaaccctgatcctaccgagttcattatcagcaaaaccaataggattcctttcagattggccaacccaaatctaggtcactagaaaaataccttcaaatcttggccatctctcgataaaactccacccgagaaaagttggactacatggtataagcgcgtatcggctagcaagaaagtcactaggacgagattggaatcggccaagcgcttgcccttaccatagccaattcagctaaagatgaacctctgatggccgccgccacttatatttgggccaacactatcaatgccttttttgtcaacca

SEQ ID NO: 17633 - DNA, 3077 bp, Oryza sativa
gacctcctctgggcagcattgaaaatatagggctggcaaagttcaggagcaaaaactttgacagatggtagggtgaatggaaactgcatctattccatcaatcggcttctatgtacatgacagatctctttccagatgttatcccttaggtatgccttcatttaattaactccgtttaaataattgcttagccgattcataacgtaattaattttctttcctgacttgcagataagggagttcttccttcctcaccagagcaatagtggcagggacatagagtatgctctaggccttattccaaatggaggtggtccatctcctcctgtcatcggctataatgcccccgagacttcaactcttcttcaagggctcatcagagaaccagccgatgctagtaaaaagagaagaaccagattatcggctgtggatacatcggctcctgctccaaagaaggccaaattaaagaagcctaaaccaaccgatgatctgcctgccctagatccatccatttaacaagctctggatgaagaagaaatcggcgaggatgttgatcaagccacagatgaaataagcaatactgaaataactccatcgacttcacctaagctaactcctccgaccccctctgctccagcttacttctctaggttaaatatctttccttgattctctttttataactattcgtcctcacccgatttctcactaatcttttccttgcaaaaaaagagaattgctgtgaagaagaaatcggcatcaacaactctaaaaccggctccaccaataagatatctttaatgctttcactagttgatctcagccgattttgtctaacacttgtctcttttacagcctcctcctcctccttcttctcctgtacaacaatcatcgagtgaccaaactccatcggccgtagagagccatcatattgaagaagaagaacaaccaactgcttctgctatcccagtaagtttccttttgacacaagaatttagatcggccatgtctatttagctctaactccctttaaataattattgcaggtcttagccaatcttttctcttttgacataagggactatcttgacgagacagaagaggataccacaagcaaagctttagcccccttatccgatgatgtgaagaaaattcttgaagatatctctcatcggctagaggcaacatcgttagacagcttagtggttgattgtggctcaattagaactcggctacatgaggttcaagctctgatcccagatgagctagccgatgtccttactccagccgtctatcttgagcagcatcaattcaagctggagaaagccaagcaaagattagctgaacgtcaggggcgcaaggatatcgaggccacaatccaggcaaatcgacagcttgttcataaagagaaggccaaacatgatcagctatttgagggcccgattaaatctaatattgatcggctcgaagctcgtaagattgagctcttggcacaacttgaagaatgcaacgccgagctggatatggaacataaaaagctagccgatctcccaaaatctatcgaagaacataaggcaagactaaaatcggctatcaagaatgttgctgatcttaccaagtctttaaaagtcatccccagaaccaacgctcaagatccaaaagccattgaagaagtagaacaaatcaggcaaagggctatttcagctatccagcaatatttgtctcagtgatatcttgtgtaatatgtcctagaaatgttttgtaatcggctaagaaactttggctctttatcgaacttatcttaataacttttatgtcgattcaatagaactccatattgtgctcaaaaatctgcagttttcatatatatgctgtcgggtcccaaaactattaacttggatccgattgagattaatatatcaatccctggatcagtaaatattgatacatgtaatacagctggttcttcattgcatacgataaagtttacaatactaggggttttacaagggtaggtactcacctaattaaacatagatgctaatattacacagcggaagttctagtacattctaactaggaaggtataacctctaaggattttctaagttatcagggtcatcatagtaatagtcataggggtcctcctcttcacccaaatctgaaaaagggttaataagagcaagggtgagtattcgcaatactcagcaagttaccataaaaatatgttatgcgttggcaaggagtgaagttctttgcagaaagcaataatagacaatctggaaatattaaagcaagagtttgtaaaatatatactttaggtttctaaccagggtaccatatgagtcccggtactcaattccgtgagtacggctattcgaatagtttcaaagatattctactgcagcagatgtaagctttacccgcagtccatgacttgctgataatcatcagctttagttatggcccagtattaggttattaacaattgtggcacctattccatgaacttatatcctcatatgctctgaacgtaatgttaacagcagcaagaggagttctggcgttcccgaggtatttaagaggaactggtcgtatgacaccacgtcatctcggtcagggtttagaaatataccatataatttatagtcgagtatcacaaaccattcacctgtacatggtaatggttaaatttgcctttcgcggctatagttgcctcctgcgcgaggacttaaaaataagaaccactatacagaggtaccacattgctaattaacataataactaggtctgtccccattctacaaactgcgttgtacccgttcgttcgacataagtacctggtgataactatatcgatcgagacagtactagccacccgaaaattatccaattcttacgtactgtcccaatctaagtataaaatattttaaccagattgtaagcaagataagcaatactaaattatctaggtttctatggttgaattatgcatataaaatagagtattgaatagaaggctataaataaataatttgtaaaatataagcttaaaagatcaaaaggtagatagtaac

SEQ ID NO: 17634 - DNA, 670 bp, Oryza sativa
ggtagatagtaacttgccttgctcgatatcctgagattgattgagattatctaataggttaggagactcctcaagatttagggttaaacatgtaaaattcaaattcaaaagagattcgaataaaatccaaaaataagcaaaataaaataaaataataaaatagcaaaagtagcctcaaaagatagagaaagattttggtccaagtttcattggaattgggtttatattttaaaagatatgggcttctaaagattgaatttgaattaaattgagaaattagaaaggttactgtagaggggcccacccgtcaatcttcctttctttttcttattttcttcttcttcttccttcgtttcttctcttctgtttcttccagggagctgagtggagcgagagaagggcgccggtgttctagttgacgggggacggcaacgtcggcggtgaaacatgttcctgagcgacgcgcatccagggagggtggtgatcaggagagggagtgagggaggaggccggaacggcgatggctagggcttagctccggccggtatgggaggtgccggtggtggctagtctcagagggggaaaggcaggggaaggttaggaaatggatttgcctcgtcgaggcgaaggtattggcgagagggcttggccggtaatgctccgataaggg

SEQ ID NO: 17635 - DNA, 1486 bp, Oryza sativa
gaaggttaggaaatggatttgcctcgtcgaggcgaaggtattggcgagagggcttggccggtaatgctccgataagggagatcgaccgacggccggcattggaggagagagagagctcggtttgatttggggaaaagaggagggatggccggctacttataggcggcggacgtcggtttgcgaaggtcggttcgccggaggaggacgaggaaggcacgacgatgaccttagtgaaggaaaaggggacggtgccggcttccgctcgtgattggctggtgatggcggctgcgtacacgcggcgacgccagggatgttgggcggcagaggaggagaagcacggcacaatgatgacgtcggcgcgactcggtggcgtgaggaagagggacacagcgacggctgcttaggggagaagaaaacggcgccggcggcggcgcgcgtgttggacacggcgacgcgcgcccagagagggggcggctgcttctgccagtgggaccggctgggccaattgagccgaagggagagaaaaggattcggcccaaaagaactattttggaattttgaatattttgcctaaggagaaagaatttatctagatatctttagaagagttttgcaaagattatgcactataacaatgtctcactaatagaagggtaatctagagaaagtttctaaattttggaatttgaaggaaatttgctaaattcactaaggtttaggatagggcaataatctagggtttattggtaaactagcttaaggggcttctaggggtaatacttgaaccaaaatcaagaataaaaagagaacttttaaagagaattttgattttgctagtctaagattaaaaccagtcaaaagccagcatgatgcagtcaaattttagtttaaaatttgagaatgttacaaacctaccccccttaaagaaatctcgtcccgagatttgcttaggagtcttcaaatagataagaggaattccaattgtaaataatattcccattcccaagttgcttcatcctctgtacgatgattccattgaactttaaacattcttattgccttagtacgagttgttctctgtgcttcttccaaaattctgatagggtattctggataggttaagtctttattcagttcgacagtacttagtgatatttctttctctgggatacataaacatttctttaattgtgaaacatggaatgtaggatgtacatcagatagataatctggtaaaaccaattagtgctcatccataaacttctccatcgagtccttgcaacatgtaagctcccttagacacaactctatagatttggaacagtccttcccaattcggcaaccacttcccgaatttgctatcccgagtcccaatcggcaaaatcaacttccatacaagttcaccttccgaaaaagccttgggcaccactttcttgttgtaatgccgagcaacacgttccttatccttggtaacctttgcaagggc

SEQ ID NO: 17636 - DNA, 1177 bp, Oryza sativa
  unsure (1)..(1177): unsure at all n locations
nnnnnnnnnnnnnnnnnnnnnnnnnnnnnnnnnnnnnnnnnnnnnnnnnnnnnnnnnnnnnnnnnnnnnnnnnncccaaaagaactattttggaattttgaatattttgcctaaggagaaagaatttatctagatatctttagaagagttttgcaaagattatgcactataacaatgtctcactaatagaagggtaatctagagaaagtttctaaattttggaatttgaaggaaatttgctaaattcactaaggtttaggatagggcaataatctagggtttattggtaaactagcttaaggggcttctaggggtaatacttgaaccaaaatcaagaataaaaagagaacttttaaagagaattttgattttgctagtctaagattaaaaccagtcaaaagccagcatgatgcagtcaaattttagtttaaaatttgagaatgttacaaacctaccccccttaaagaaatctcgtcccgagatttgcttaggagtcttcaaatagataagaggaattccaattgtaaataatattcccattcccaagttgcttcatcctctgtacgatgattccattgaactttaaacattcttattgccttagtacgagttgttctctgtgcttcttccaaaattctgatagggtattctggataggttaagtcttattcagttcgacagaacttagtgatatttctttctccaagaaacataaacatttctttaattgtgaaacatggaatgtaggatgtacatcagatagataatctggtaaaaccaattagtgctcatccataaacttctccatcgagtcctttttttgggggcccccaaaaaaaaccccaaaaatttgggttaaaaaagggctcccttagacacaactctatagatttggaacagtccttcccaattcggcaaccacttcccgaatttgctatcccgagtcccaatcggcaaaatcaacttccatacaagttcaccttccgaaaaagccttgggcaccactctcttgttgtaatgccgagcaactcgttccttatccttggtaacctttgcaagggccctcaatctggactgaaccaactcttccctttcatctgccatgaggttataatactcatcggctgttaaatcattttgcaactacgttctccttgagccgattctaatctcccat

SEQ ID NO: 17637 - DNA, 654 bp, Oryza sativa
  unsure (1)..(654): unsure at all n locations
actatagggcgaattcgagctcggtacccattacaatttacacacaccgcaagtaagcaagctacaacaaaaactgaactccctcttatctaaaacatattttgatatcggtgagaattatatatatatatatatataattacttaaatctgggaatttgatcgtatttgtgttcacatttaaagtggacatcttagatgttaattaatggagaacttgacgatcaagctaaggatggattacatagagattacgtacccctgttcagattcgttgtactaggatgtgtcccatccactacaaagtttgctatatatattttgggacggagagagtaattcggtttgtcaccaagctccgaaggcccctgcaccacactgggagaaaccaaaaaggagatcgagatgaagctaaatatcgatggctcttttgatccagtggaagagcggggggaatcggtatgatcctgagagatgacaatggggccatggtcttttctgcctgcagatttatggagcgctgtaatggggcgcttgaggcagagatccttgcctgcgtggaaggaattgcattagcgcttcactggactatgnnnnnnnnnnnnnnnnnnnnnnnnnnnnnnnnnnnnnnnnnnnnnnnnnnnnnnnnnnnnnn

SEQ ID NO: 17638 - DNA, 559 bp, Oryza sativa
  unsure (1)..(559): unsure at all n locations
nnnnnnnnnnnnnnnnnnnnnnnnnnnnnnnnnnnnnnnnnnnnnnnnnnnnnnnnnnnnnnnnnnnnnnnnataggaagcttgatcgggaacaattctttttctgccagttgtgccaacacttgccaaccttccttcgtggcgagacgtaggaactccgataggattagtctcagccatgtaatcgatacaaaactcaatggcttcctcggtcatgtaaccttcaatgatgctcccctctggttttgctctgttccgaacgtaggacttcagaattcccatgtacctctcgaatggccacatttctctcataaaagctggcccacatattttttttgcttcactaggtgaatagtgagatgaaccatggtatcgaagaaagctagtggaaaatacatctccaactgacacagggtactgacaatatcggcctgcaacccatctaggtcttctggatctataatcttctgaccgattgcattgaagaaggcacaaacccgttggatcatgtgacggacttgtggnnnnnnnnnnnnnnnnnnnnnnnnnnnnnnnnnnn

SEQ ID NO: 17639 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctagctcgagccagcttgtttggctcgcgagctcaaccacccaaaatggcgactgtgggtctgcaatggtggaagctccaatccagggcattgtgccgtcgatgggtggcgaggaggcatcgtcgataatgcgtgcggccatggcaagcgatgccatgagaataccacatggacgcgcgggcgtgggatgcgacgagttgaggccgacaggtgacgggtgggcgggcgagctcgtgcaaccactgatatcccacaccaacgagaacatgcgctcacatcgctgccaatgtaagggcctgcactcgcttccgacgtccccgtcgagggagggtgacagggacgcttcctctgagctcaacttggcgagggcctgtgcgaccactgagctcctgcttgccgagttgccgtccacgctcccaccactccactcatccgatgccgctgcagcatcgccgtcctttgtgtgagaatggaggcactacacatttgacattttgacttatccaattccaatttgacgagtcacgagtttttcgtgnnnnnnnnnnnnnnnnnnnnnnnnnnnnnnnnnnnnnnnnnnnnnnnnnnnnnnnnnnnnnnnnnnnnnnnnnn

SEQ ID NO: 17640 - DNA, 819 bp, Oryza sativa
  unsure (1)..(819): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctatacccatgcacgtgatggatagggagcacggatccacaatatgacttttgctaccggccacggcgcctctaggcctcaggagcttgcatccacaccaccgagcctggcatttcctccttagctcctgccgtcgaccctgcctgcagtcaccaggccttgtgggaccggatcatccagcactggctagcctcaggggcatggatccaccaaccgccagccttggaagcgtggatccactttccagcctcggaatcttactctttgacccctttttgtgatcaatttattgaatggattttgaggattgtgataagtttgtgaatggattatgggtggcaaggggaatagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17641 - DNA, 859 bp, Oryza sativa
  unsure (1)..(859): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccctcgcccatgccggatctagcggccggaccgccgccgcgcctccccacccgcccctgcaggatctggcggccgcgccgctgccgccgccctcgccggctccgcgccgccacgcctcccctcccgccctgccagatctggcggctgggccgccgccgccgcccccgctggctcggcgccgctgcgcctcccctcccgcccctgccggatttggcggccgggccgtcgccgccgccccagccgccacggcatagagaaagagaggagagatagagaagaagtcgaagagatagaggagaagtggagaagagggagccggccgaccttatgtcctcatgtgggcccccgctgggagaggagacatatatatatacagtggcagaagtcatctcaaacgggctgggacttaaagccgtttgaggtgagtaaacctcacctctgacgggctgttcggctgcgacccgtcacaggtaactagtcacctgtaacgggttaggacttaaacccgtttgaggtgaggtaacctcacctgtgacgggttctatttttaacccgtcacaggtgactagttacctgtgatgggtcgtagctggatgcctcaccgatgacgacatcccgtatgacccgtcagaggtgacggtcatcagtgaccatttcgtttgaccgtcacaggtatcccgtcagagatgtgaggatctgg

SEQ ID NO: 17642 - DNA, 722 bp, Oryza sativa
  unsure (1)..(722): unsure at all n locations
nnnnnnnnnnnnnnnnnnnnnnnnnnnnnnnnnnnnnnnnnnnnnnnnnnnnnnnnnnnnnnnnnnnnnnnnnnnnnnnctctgatagatctaggaggaagaggagtaaggtcggtggtgtggacgcctctagattcagcctacgcaaggtcggggacggctagatccatcaaccatgaaactagggattcgtcaaccatgaaaccggtggcaacataagtcccatgatttttctcacctttttcttatctctctccactctataccttctcctttcatagatccaagcagaagatagaggagatctgcacgacaacggtctcgagtaggcggtagcagtctagggcggattcttgctaagtagtgtcaaagagacattgggtgcataactgggtcgcgattcggttggacttggctttgtgacatataccacgttacttgtcctggtaacatcgttcctatcctaggaccacgcgaacaatctcatccctcctgtgtaaaaacctaaaaaaaattattgtctcacatgcattgctcgactttgtgacatagagtaacaccatttgccatatgcagtactccctccgtttcatattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17643 - DNA, 1466 bp, Oryza sativa
  unsure (1)..(1466): unsure at all n locations
nnnnnnnnnnnnnnnnnnnnnnnnnnnnnnnnnnnnnnnnnnnnnnnnnnnacagaaactccagccgaacattgtacttgtccccttttttggtgggtagcgagtagcagctccgttcaccggtaacggatgttgggaagctcctgagcgtgtagagtgtctggtagcgagggcccttccagtcgtccttgtacacggtggtcacccttctattttcgccggcgtcgacgtacgcaccgtcggagacgtaggtgattccgccaaccaggctgtctgttctggaatcttgatccaggccacagtcgatgcttaggaaacctaatacacacagaaaagaaaaatgacgttacacacaagtgatcgaacggaagaatcaaaatagccaaatctcgtcttcattttgaagcaaaccaagacaatacccactggtgtacagggcggaaaaatctcaggaaattggtatggaacaagaggggttttttcatctcaagattttttttcaaacaccgtgttttttgtttataagagcaccgtgttttttgtttatgcgcttgaaaaagcatcgagaggtcttatcgtctaaatttgttgtgcagaccataagagatcaccaaaggaaatagccatatttttaccaaagaaaataaccgtattttcacacgcagttcttttaccaaagacggctatacaattcaggagacactaaaaaaacggccagcccaaccagctatggttaaatccagtcccttggactctcctcgtccgctccctcccactcccaggcgtcatggcaccatcattgtcaaccacagctagaaagctgcatactttccctccactacccagccagagtgccacactgattcagcagcatcggcgggcctagacagcaacagtgagcaacagcttccactactagaaaaatggttattaccaataccaggcttttatttctatatggagtaaaaaaataccctctggttactgcttacaaaaatagccaaaggcccccatgatttagtcccgcttggtcgaattttacagtcggagccataagaggttcgcttacgaaaaaagatgaacgaattatcataggtgagatgtaaagatgttagcatgcgaaaaggtacgagcgctcaaaaaatccacgcagctaagtctccatctattattttatcttcatcccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttagnnnnnnnnnnnnnnnnnnnnnnnnnnnnnnnn

SEQ ID NO: 17644 - DNA, 1594 bp, Oryza sativa
  unsure (1)..(1594): unsure at all n locations
nnnnnnnnnnnnnnnnnnnnnnnnnnnnnnnnncccctctctttcacctctcctctccctctctttttattttgtcctctccctctccctctatgagagtgggtgccggcagccgggagcaagggcggcggatcagcggcgcctccttcgggaaggtcagattcgtcaccctagggagcggctgcagctaccgcgacggcgggcgcgcaattgggacagtggatccagcgagtgggcggcaacgcgggcagcggcgccaccgccatccccttctcactgccaacgccgacaacgacgacgaggcaaccctccccccctcacctccgccatctcctccagcagcggtggcggcaactccagacatggcgagcagtcgtgcgggaggtactccccaaaaacctgatcacccgcttacccggtgtagatctcaggcgaaggtgtggtttcggaggcactgctacttccaatctctcgtgcgtgcaagagatcagaagcgaggaagcgagaacagtacaggcgcggaggaggaggaactaacaccgggaaagaagcaagcgatcagaatagatcggactcgcggcctccttatctatcaggagagagaggcagtcgtgggaacgtgaacgcgctgttgtgaaaaaaaaaaaggggaaaaagggaaaaaggggtttccccggtttgggggaaacgtgggttagtggctgcaaaagaatagcgacgtgacgcacgcacgccgccgccagccagccacgcctcgcctcgccttcgcccacgcccacgccctcggcctcagcccggcgcgcacgcgcgcgcgtgtagcattccgacccccacctcaaccagtcaacagggagcctccaataactccctatttaggttgagatattcctcacttaaatcctgagatagtattattatccttaacacttattatgggcctttgagatttaataggataagttgggcctagcccaattattctaacaatccccaccaaatttcaaggctcataagaaatgttctcaaatgttgtgcctgtgttgatacccacggttttggtgagactgttaagttgaacttccccctaggaaatgagctacatcagacccattctgaacaatggatctgtgccttgaattgtcagttttgtgtgatcaggtttcactcagaaccttgactggtactgggctgccgttcgcatcccctctgtttgggggaaaaaaggggggcccaaaaatttaaatttaaaaaagggttccaaaanctccaggcctttcatgagtatcttgagatcgcccaaacctcatagactgtgactacagtcgaactcatataggtgtgttccttctgagatgttctgcaagtcaatagctctgcttggaaaagccactcggatcacattaaggcatgagccatcctaccatgcaggaaagaaaagaagcagcacatcatgaaaatgagcccttttcaagggtctcttctctcagtcacacaatagtttgtttcgccatccaaattcacaggatctccgatcacaatggacaggtttccactattgtgcaaccttaggtgggtaccgagctcgaattcgccc

SEQ ID NO: 17645 - DNA, 503 bp, Oryza sativa
  unsure (1)..(503): unsure at all n locations
nnnnnnnnnnnnnnnnnnnnnnnnnnnnnnnnnnnnnnnnnnnnnnnnnncacacaactttgagctgaattataagatgctctattgtatcttttgtatattagaatataggtacagagtgagtggaagctctcgaggaatgcccggaagtttggtgctttcttggacttctacctcgacgagtgtagctttgtaggaggaattcaggaggagtaccggagctcggtacactctgctatgggttcggagaaactttacttagtataagtgagatatatttccatctttgcgtgttcattgtttagtattcgttctaagtgctctattactaggactctggataaagaaggaagttcatgtgtaagtattagagtagtaattaagaacttaggcgtggtgtctaggtcagaaattacctatatttgttgtgtatcccatggatttgttagaggtagtaatcctccacgttaggatatatcatagagctatagccgaaaccacac

SEQ ID NO: 17646 - DNA, 581 bp, Oryza sativa
  unsure (1)..(581): unsure at all n locations
nnnnnnnnnnnnnnnnnnnnnnnnnnnnnnnnnnnnnntttaaccatagataaaatcaatctgttttcagtaaaaaagattcaatacttagaatgccatatatgtgcatgtaaacttagtcgcatccactgtgaggtttcatacgcatcaagatatttgaccatttgttttgtcccattacataggttcagagcttgaccaaggtgaatcacaggaatcttgtttctttgattggttactgctgggagaaggatcatttagcacttgtctacgagtacatgtctagtggcaatcttagtgattatctgagaggtttgtccattgcaatctttaagtattgaatatttgggaaatctgagggaggatactgggcatatacattacgtagaccaactagtcattccttccttacaacttaaatactctgcatgaccgaaccagctcacagcgaagccaattaactcatgttgcataacagtttgcagaactatgacaagtagtactgcttacctggagagtgcatagttagacattttgagaaaaaaaaaagactggagagagcatagttagtctctacctaa

SEQ ID NO: 17647 - DNA, 559 bp, Oryza sativa
  unsure (1)..(559): unsure at all n locations
nnnnnnnnnnnnnnnnnnnnnnnnnnnnnnnnnnnnnnnnnnnnnnnnnnnnnnnnnnnnnnatgcaggctaattccatagaagttcagagttcctcggaaaaatcctgaagttggaagagaaaacccgccataaaagaagtgagaaaataccacgacttcgtgtgtatagggggtcgggaacgcctcgctgaacgctggtcaccacccgatgatctccttcactggaagaacgccgtgtgctaccatttctttcagattctcctccgtcacatcggagggcgcccactgactctcaaaactttctctctcttccgccatggatgcgtgtggaatggtttgatttggtccaagatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17648 - DNA, 8012 bp, Oryza sativa
  unsure (1)..(8012): unsure at all n locations
nnnnnnnnnnnnnnnnnnnnnnnnnnnnnnnnnnnnnnnnnnntcttttcattcattagatggatgttaagacagctttcttaaacggagagctggaggaggagatctatatggatcaaccagacgggtatgtattaaaaggtcagaagggaatggtatgtaaactgttgaaatccttgtatggcctcaagcaagcacctaagcaatggcatgagaagtttgacaccacgcttacatctacaggctttgttgtgaacgaagctgacaaatgtgtgtactatcgctgtggtggggagaaagagtgatcttgtgcttatatgtcgatgacatattgatctttgggaccagccttaatgtgattgaggaggtcaaggactatttgtacaagagttttgaaatgaaggatttgggagaggctaatgttattcttaacatcaaactacaaagaggagatgagggtgggattacacttgtgcaatctcactatgtggacaaggttttgagtcgctttggatatagtgactgtaagccagctcctactccttgtgatcctagcgtgctattaaggaaaaaccgaagaatagtaagggatcaactgagatactctcaaatcattggttcattgatgtacttggctagtgcaacgaggcctgacatctcatttgctgtaagcaagctgagccggtttgtctcaaatccgggagatgatcattggcaggctctggaaagagtaatgcgctatctaaagggcactatgagctatggaattcactataccgggtattcaaaagtactagaagggtatattgactcaaactggatatctgatgctgatgagataaaagtcacaagtggatatgtgttcacacttggaggtggtgttgtttcctggaagtcttgcaagcagaccatcttaacaaggtcaacaatggaagcagaacttacagcactagatactgcgacagttgaggccgagtggcttcgtgaactcctgatggatttgccggtggttgaaaaaccagtgcgcgccagctatcctaatgaactatgataatcaaacggtgattattaaagtaaacagttcaaaggacaacatgaagtcatctaggcatatcaagagaagactgaaatctgtcagaaagcaaaaaaacttcggagtgatagcattggactatgtccaaacggctagaaatctggcagatcagtttaccaaggggctaccacgtaatgtgatagacagtgcatcaagggaaatgggcttgatacccacctaaggttgcacaatagtggaaacctgtccattgtgatcggagatcctgtgaatttggatggcgaaacaaactattgtgtgactgagagaagagacccttgaaaagggctcattttcatgatgtgctgcttcttttctttcctgcatggtaggatggctcatgccttaatgtgatccgagtggcttttccaagcagagctattgacttgcagaacatctcagaaggaacacacctatatgagttcgactgtagtcacagtctatgaggtttgggcgatctcaagatactcatgaaaggcctggagtttgacttatatgctccaaacagaggggatgcgaacggcagcccagtaccagtcaaggttctgagtgaaacctgatcacacaaaactgacaattcaaggcacagtccattgttcagttgtggtctgatgtagctcatttcctaggtggaagttcaactcaacagtctccaccaaaaccctggtatatcaaacagccacaacattgagaacatttcttatgagccttgaaatttggtggggattgttagaataattgggctaggcccaacttatcctattaaatctcaaaggcccataataagtgttaaggataataatactatctcaggatttaagtgaggaatatctcaacctaaatagggagttattggaggctccctgttgactggttgaggtgggggtcggaatgctacacgcgcgcgcgtgcgcgccgggctgaggccgagggcgtgggcgtgggcgagggcgaggcgaggcgtggctggctggcggcggcgtgcgtgcgtcacgtcgctattcttttgcagccactaacccacgttcccacgactctcttcacaacagcgcgtccacgttcccacgactgcctctctctcctgatagataaggaggccgcgagtccgatctattctgatcgcttgcttctttcccggtgttagttcctcctcctccgcgcctgtactgttctcgcttcctcgcttctgatctcttgcacgcacgagagattggaagtagcagtgcctccgaaaccacaccttcgcctgagatctacaccgggtaagcgggtgatcaggtttttggggagtacctcccgcacgactgctcgccatgtctggagttgccgccaccgctgctggaggagatggcggaggtggtgcgccgccgggagctggagccggaggtggtgcgctaggagctggagccgatggcgcgaacaacaacatcaatggaggcaattctgcctcacagtctagcggaggtccattctcggggtatatccttctcctgttcctgtttccactgttagcgctttactgctatgtgcgctatgttcctgttcctgatattcatgatgcctctagcatgttattgcgttattgtaatgttcctgttcttgacattcatgatgcgtatagtatgctactggttatattaagatcaccatacactgcttatgtcatgattattgctttaaagttttggattaaaatatgccgattcatgaccatatttccaacaattacaaccaccttccagccagaattcatttagaacctcagaccaggctttattggctaagctatgactaacctggttctgagcgtgatggatcttcctgacagagatttccctgtccccgtcaatgagcctccttatctccctgactaggtgcgcagaggccgacaggtctttttctcttgattgcagcatctgtgtcagcgttaaccaatctgtttccacttcaaaagggagcatagtccagtgaagcgctaatgcaattccttccacgcaggcaaggatctctgcctcaagcgccccattacagcgctccataaatctgcaggcagaaaagaccatggccccattgtcatctctcaggatcataccgattccccccgctcttccactggatcaaaagagccatcgatatttagcttcatctcgatctcctttttggtttctcccagtgtggtgcaggggccttcggagcttggtgacaaaccgaattactctctccgtcccaaaatatatatagcaaactttgtagtggatgggacacatcctagtacaacgaatctgaacaggggtacgtaatctctatgtaatccatccttagcttgatcgtcaagttctccattaattaacatctaagatgtccactttaaatgtgaacacaaatacgatcaaattcccagatttaagtaattatatatatatatatatataattctcaccgatatcaaaatatgttttagataagagggagttcagtttttgttgtagcttgcttacttgcggtgtgtgtaaattgtaatcggtcagctcttggctctgcgtaattggttgttgagtatgcgtgacctctccatttgatggttttgggcagcgacgatgcttcttaatttacacggcaatatatgatcaatgattacttcgtaaaggcagaggtgttggcggagtaatctgtgtcaacagctctaaatataagatagaaaaatacaatttattgcccctttttatctagtcggtataaaaatgagtaaacctcgctgaaaactattaaaaaaatatctttcacctatttaatagcgatattgacccgtatagatgataattctactttttctagagagttgttaacagtgaaatttggtaagcccctaagagagttatcacgtcgccaatagtcggattactgttatattcggttaaggaaattaatctgttaaagaaagcttatctaggagtcaccgagttcaagtaagatgcgacatgacagtttatctattaattaggcacaatttgttagtttcttttatctttagaaacgtgtgtttagtgtcctataaggactttatgctttccttttatcttttaggaaagtttctttcttgtcctacaaggactagtatgtccccatgggtataaatatgtacatccgggatcattgtaaactatctcttgatcaatactactctcggcgcatcgccaccctctattctgagggtttttacttatcaaccagtggaattaggcacctgacgcggggctgcatcggttcaaatcgatctccggcgaaggggtaagttctacgttccgccggcccaggcaattgtctcgtctatgtcggtgtcgttcaatgctgcatcagtgcattcaacctcttggatgctcctgtttggatgatatatttgtctgcctatttatcatatgtcttcgttaatctagtcttagtatctcaatttagctttattggttgtctctcgctttagggtttctgctggtatcggctaaattgttttactatattagattacttaaggcatctaccaccctgaaaaatcagtcaacggcttgattgtctagatattatgtttcttttcatacttagtgctgcatcagttaagtttatctgctaagtcatgtttagaaccataatacctagcctgctttttttactgccaataagggtttcatcggggtttcagccgacgagttatctagatgttgcttcggcttacaaggattgcatacaagttggatttagccgatggcaacaaagatttcattgtttaatataatcttgtggattttatgaatcggacctccagccgatgcatgctttaaccttcggatcagtgcttattctatcatatcattattaggcgattggtttctattggattatattgttgttatattttaccatcattagctgattgtctttatatcattatatacattggatatatagccggttgtttaaaaccctattgctatcagctggtatcggcatcggttagaattatcccatcggcttgtcagccgatcggctcattgatctgctatttttgtatcttgttagttgtaggatcaaactgactggcacgcctacacctcaccaacctttggtcctgcactggagctaagtagatctcccaggccagtgtgtgtttttcgcatcagcaagagtaaggaacaaagtagaaacagtgcacccgcatagccaatggcagcttgggggagctatggctcatggataggaaagattgacctttgttgtcgaaagacgcaacaattttccttaattaaaacactaaagtataatattgaatttcgaaactctgttcttacagcctaccccttcggaaattctttggtacttgattaattgctttgacggggaaatggggaccccccattcccatttcattgacaccgccgcccgccggatctgcactccaaaacactactagaaaaacattttcatagtcggccaaaacatggcttgaacattttttgacatacggctagtcgtgactatcgacgatccttaaatcatagtatatgaccatcaatacctacatataatagaataaaatatggtattcaactgagtggtagggtttattactaatcatttccactagcgttggtatatatttggatgcatgcaacaaacaactaaagttgagagggaataaacaagaagaaagaggagaaccaaacacatatccaaactaaaggtagttttggacccaaaagcccaattaaacacctccaaatgggcccaaccaccatgcccatggactaagggcctcaaaattagtgtccatgagggaaaacagggtcaacggagccatctcgggttcggccgaacctatttgtaggccgttgattgccaccttccacgtggacgctcctaatttcatcccaacgacggttggatggtagtttggtcatttcccatagctgtaaccatcatttggagcctataaaaggaggagctcactctcattcatcacacacaactttgagctgaattataagatgctctattgtatcttttgtatattagaatataggtacagagtgagtggaagctctcgaggaatgcccggaagtttggtgctttcttggacttctacctcgacgagtgtagctttgtaggaggaattcaggaggagtaccggagctcggtacactctgctatgggttcggagaaactttacttagtataagtgagatatatttccatctttgcgtgttcattgtttagtattcgttctaagtgctctattactaggactctggataaagaaggaagttcatgtgtaagtattagagtagtaattaagaacttaggcgtggtgtctaggtcagaaattacctatatttgttgtgtatcccatggatttgttagaggtagtaatcctccacgttaggatatatcatagagctatagccgaaaccacactggcagaacagcaggggtcggcgcccgaaacaacagataggaaattacctttaacttagcttagataattaaaatacatagaaagtcatctttagcctaactagcctacctatagttgttgtccttggatagtcttagctttagatagattacacaggtgtattcgatatccttttggggtcacccgaaggtgaagtgctacaacagtatttcgtgcgcttgcagatttatttgtggttgcaagaattaccaaaagcgacgactaaaagcgacgactgtaatttaagacgtaaagtgatatgcctaagaaaatgtttttagtgtctaaaaagaaatcctgcagattccaaaatatccccctacggtatatccaaattcccctaatccccttgacactcataatccattcacaaacttatcacaatcctcaaaatccattcaataaattcatcacaaaaagagatcaaagagtaaaatcacaggctagcaagtggatccgtgcttccgaggccggtgggtggtggatcaatgctcctgaggttagctagcctgactcgaagccgttggcagatccgcatgcttggggggtggggtgggggtgggtgtggaaaggcagcagtatctgtgcggaagggaagggggtgccggatccgcccctcgcgccgttgtcggcggtagggtgcctctcacccgagcctgcctccaccagagcccgagcccgctgttgcctcattgggtgaggaggtacttgcagcaaatctgcacccgtcaaggtcccccttgccagatctgccgcctccaacgagctccccgccgcctaatccactgccatggagcatcctgctgttggagtctgccagtcaaactctgttttatctagttagaccagtcatttgtaggcggtcacatcaggcctgtataggtgatcggactagacactaacgtagaggttactttccaaatttggcttaagcttgatattatcttgtccaagtgtcaaatttgctcatccacacgaagatgtagggagtgggtagcgggaaatggaggatggcttaggatggtctattctcgttctgttcctcctcccctctgtccctttaaaaccttctcctctctccctctctgatagatctaggaggaagaggagtaaggtcggtggtgtggacgcctctagattcagcctacgcaaggtcggggacggctagatccatcaaccatgaaactagggattcgtcaaccatgaaaccggtggcaacataagtcccatgatttttctcacctttttcttatctctctccactctataccttctcctttcatagatccaagcagaagatagaggagatctgcacgacaacggtctcgagtaggcggtagcagtctagggcggaatcttgctaagtagtgtcaaagagacattgggtgcataactgggtcgcgattcggttggacttgg

SEQ ID NO: 17649 - DNA, 1156 bp, Oryza sativa
  unsure (1)..(1156): unsure at all n locations
nnnnnnnnnnnnnnnnnnnnnnnnnnnnnnnnnnnnnnnnnnnnnnnnnnnnnnnnnnnccacctcccacctcccacgtcgtcggcgaaatcgggagcacctaggccgttcccgaccttcccgcccctataaaatccatccccgcgtcctcctcctcgcttttccttttgccgccggcctctcccgagctctccatcgcccccacgccgtgtaaccactcgccgccgccgctcccgctactccggccgccgctagccgctgctagggtcgccgccgcaccgcgccgtcgctgccgtcgggttcgcgaggccgaactccacctcgtccgccgctcctccgtcgagattcgtcgccggaacccgcatcccctcgcgctcaggtgagccctacccctaccgccgccttcggccatggatgccggccgccgtggttcatctccctccctctaatctctctctcttccttccttagggcatcccgaagctcgtccgcccgtcgccgccgtcttcccgtggctcgccgtcgccgttagccatcgtctcccttagcgccggccactcgcggtgaggcattcatctcctctattccccttcctctccctcctagtgccaagccgccgcttcaaatcgcgcgccgtcgctttcgaccgccaccgccgcctcccgtgccgccggtcgccgtcgccgtcgaccgcgtgccgccgccgctagccatggccggccggccggctttggagccaagccaagcccggcggccacttctgccgccaccgcccgatcggctcggggccgatctgggccgtcagtcccgtggaccggtggtggaccacccgcgtggtcccggtccatggtggaccggcccccttgagccgctgccgagtggggccgtgtgccggcgcccttcccctctcttccgagccactgaccagtgggacccgcctgtcggcgccgccccccctgatgacgtcagccctgggaattatggcgcaataaattatataagggctttctgttatagtaataaacacagtgaatcttctaaaattcatatgtaattcatccgagctccgtttaagcccattcaagtcgcagtaaatcaagaaaaatgtgtagaatccattaaaaatggttttgttctctgtttcagtagtcttata

SEQ ID NO: 17650 - DNA, 721 bp, Oryza sativa
cggctcgggggccgatctggtcctccagtcccgtggaccggtggtgaaccacccgcgtggtcccggtccatggtggaccggcccccttaacctgcttccgagtgggcccgtgtgccggcgcccttcccctctcttcctagccactgaccagtgggacccgcctgtcggcgccgccccccctgagacgtcagccctggaaattatggcgcaataaattatataagggctttctgttatagtaataaacacagtgaatcttctaaaattcatatgtaattcatccgagctccgtttaagcccattcaagtcgcagtaaatcaagaaaaatgtgtaaaaaaaaaaaattttccccccccccaaaatttttttaaaaaacaaaaaaattggtttttgttctctgtttcagtagtcttatagcctgtttgcattgtttgccttgtatgtcgttagattccggctcttccgacgctccggtgtacttcgaaatagtcgctgaggttccttcagcagcagagcaaggcaagtcatacttgtcacttgatcatgttgatcctacattgcaaatgttctattgttttccttcaaatactgcatttgttttgcaataacactatgggatgtttacctattgttacagccatactattttggtaccttgctcctttgttagctcgggttataacatgaatagattttgggggtaccgagctcgaattcgccc

SEQ ID NO: 17651 - DNA, 745 bp, Oryza sativa
  unsure (1)..(745): unsure at all n locations
nnnnnnnnnnnnnnnnnnnnnnnnnnnnnnnnnnnnnnnnnnnnnnnnnnnnnnnnnnnnnnnnnnnataagaggaattccaattgtaaataatattcccattcccaagttgcttcatcctctgtacgatgattccattgaactttaaacattcttattgccttagtacgagttgttctctgtgcttcttccaaaattctgatagggtattctggataggttaagtctttattcagttcgacagtacttagtgatatttctttctctgggatacataaacatttctttaattgtgaaacatggaatgtaggatgtacatcagatagataatctggtaaaaccaattagtgctcatccataaacttctccatcgagtccttgcaacatgtaagctcccttagacacaactctatagatttggaacagtccttcccaattcggcaaccacttcccgaatttgctatcccgagtcccaatcggcaaaatcaacttccatacaagttcaccttccgaaaaagccttgggcaccactctcttgttgtaatgccgagcaactcgttccttatccttggtaacctttgcaagggccctcaatctggactgaaccaactcttccctttcatctgccatgaggttataatactcatcggctgttaaatcattttgcaactacgttctccttgagccgattctaatctcccatggtaaaacagcctcatgtccataaacaagcaaataaggaggg

SEQ ID NO: 17652 - DNA, 4387 bp, Oryza sativa
  unsure (1)..(4387): unsure at all n locations
nnnnnnnnnnnnnnnnnnnnnnnnnnnnnnnnnnnnnnnnnnnnnnnnnnnnnnnnnnnnnnnnnncgtgacactttatattagttcccttttctttctaaaattttgaattaatgaacataaattgtatctatttgaacttagttaacactttcttagttaaatttttgaatgcaaaatttgtagttacaaatagtgactaacatggactatttttgcatcgtaatatgctataattttgacaatgtaatttccgaactaatttgtgcattaaaaccctcatccaggaatcagccgaggtacacaaactgataatttaatgtacagattcatcaaaataactaaaacgataaatacttacataagaggcacttagtcctcaccatgaagaaaactgcagcggaaaataaaatctagcgaagcttcagctccactcccacaggcagcacaactgggatctaagccaaaggtcttctccttctggatcctttttcttcaactgaggtttgatgattattgcaagaatgagcatatgacatactcaacaagccacacagtatatatgcaagtgcataagaataccaaaggatggcataatatatggttcatttgtgaaagcagcatttagcaaagagttgagaatttgtaaaacagtagagtaattaatcatcaatattaatcagcactgaacagcacacccatgctgcataggcccaaccaaacctgaacaaccaaccctggtcgtacagatcaaacctccaaaccaggaattatccattccaaaccaggagtcaaattaattatcacattattatcattaatgagtagtgtgagactaatcacgaaaaatattgttagacccgcccataaccgcgggcacggctattcgaatagttttactctgaccagagatgtaccactgtacccacaagacacgattccacacatgttgccatgccctgaagtaccaccacggcactgcaaagggggaaatcgtgacagtactctttgcacaacacaactcaccacagcgcaccattcctggatcataatcaccccataaaaaaccagaggcatggactccccagtgacccccacggacttctcgccgcttcacagtctggcacaccataatgaatcatgctatacaaaagataaagccgttgcccacgctagcttgtggttggtacgattaatgtctcacaatagtagctcgcgaaccggtccttaattgtcatgagcacgaccttcaaaaccatgttctcacaacccaccattaatcatattttaattatcaattaattatcataacacgattgaccatcgtgagctaccattaaatataaccataaataataatgtagtatatataattcatcccattaatgagctaatgtttctaagcatggctaagcaattatatatatatagcatttagctgaaccaaaccaatatataaggttctagctaatcgaattataacccataggaaaataaagtcatcttcgaccattaattaattgggaaaggctcaccacccgatgacattcaaaaataatgcataagttgaaataaaacaatagctttaaacgggttcaacatgctcaaagggttgtttgggaactgtgtgacttgcctttgaaacaagcgtcttcaattcgtctttaggaacttctccaacgaacgaacgatcctccgaaacaacggaaaacaaaacctagaacgcaaaacgagaaaaaaacactaataaaaaccaaataaacagtacaattaaagttcataaataggtagagcttgaatttagatgaattatgagacttgaacgacctcattccgagttcgtatgaattaaatatgaattttacaaaatttaatttcaattaaacctattaaagaaaagactattccaaattgattaaacaatttacaaatgacttatagctgtgacaaaagattaaaacatcctccggaaatagattaggtcatatttggtagatgacatatattaaaaaggaataatatgccattgaaaagaaagaacagatttatatcgattttggacggctgagattaatctcgaccgagtcgaccaagatcggatggcttggattgacacacggcagcggcacaacagcggttgcggtggcacacatacagcagcagcacgacggcgacgtacaacgtctaaacagcgacgcggcggcaacaaggcagctagcgcagcggcgacgctagggcagcagctagcgacacagcaacggctgcgctagggttagagcaacagcggcggtgacacgaccaagggattgaaacctaacccgaggggacacggatagaagtctcaccgaaccaaagcgaccggagagggggggtcgacgatgacgatccggcgacacacacggaaacgatgacgacgctagggccaaacaacagattggattagattagattaaatccctagggataaactacaccggtaaacgacatgggagagaggagagctcaccggagaagacgacgacgacgaccaagacgacgacggcaaggggtgacggctagcggcagtggcgactagggcagcggcggctagggtgttggaggaggcggctaaacaggaggaggaggaggctaggggtggctgcaacacaaaaaaaaaggaaacaggaggggagaggacggcttatataggggaagattgaataggattaggtgggccaagggaggcccggcagagggggagagggagggactcggaggggagagggcagaggaggagcatggctgggagaggggggaggcgcacggctgggaggaggccgagagggggaggggaaaaagatacgggaggaggggttgcctagaaaggaaaggtgcgggaaacagatgtggtgccgttttgggaaaggaagaggaaacggaaccagaaagagaataggactcggctcgtcatacaaaacgaaatcgtggcggcaaagaggtcggcggatacaatgaaccgcagacagggagagtgaactgggaatgattcacaaccaaaggaggaaaaagaaagaattattaattacttttccaattaaattaatcactgaatgatctttcatttattaaaaatgcttccaatgctcaaataattctgggaaaaatctagaaaatacttggacattaaaaatatttaatacaattttatctatatcaacttaatgttcaaaattttcatagattttattcacacacttgctttaatcattaaataatttctaaaaattcctttttcacaacgatttataatttagcgatttttatggtgtgacaatctcacatagagagttaggagttccaatggacaaagatgaagtagaagacgagagcattccagactgggctcaatatggtggatttgatgaaaatacaaaaggaaggtggacagggctgttgaagataacgttggtgcgaatgatcttggtcagaagttgcgtgacgtaaaggaggacggcaaaagtgaaaaggaggtgcagaaacttgagcgcatatcagtggaccacaaaatgtcgttgtacccaggatgcgatccggggcacaaaaagttgggtaccacgctaggcacaaaattagagcgtatgttaacggaccacaaaacgtcactgtaccacgctggaattctcgcaatggaataccaaaattggtgtgagtgacaaggcatttggcgagttattgaaactcataaagaacattcttcctgaaagaaacgaattgcacgaaacaacgtacgaagctaagaaggtagtctgccctctatgactagaagtatagaagaaacatgcatgttcgaacgattgtattctctatcgcggtgaggagtacgagaacctagaagaatgcccgttttgtaaagcactatgatacaagattagacaagatgatccaggtgatgtcgacggacagccttcgaagaagagagttgctgctaaggtgatgtgctatttccctataataccacggctcaagcgttggttcaggaacaaagcgcatgctagaatgatgcgctggcacgcagaagaatgtcgacaagacgggatgctgagacaccccaccgatgagtcacattggcgaaacatcgatggaacatttcaagacttcggagtggatgcacgaaacattaggttcggtttaagtatgtatggcatgaatctatttggagatgagcagcagccgtaacacttggcctgtgaccatgtgtatctccaacttcccccctatgaatgaagccgaagtacatcagggtgtcgatattattgaaggcccaaagcaacctggtaacgacattgatgagnnnnnnnnnnnnnnnnnnnnnnnnnnnnnnnnnnnnnnnnnnnnnnnnnnnnnnnnn

SEQ ID NO: 17653 - DNA, 1707 bp, Oryza sativa
ctatgatacaagattagacaagatgatccaggtgatgtcgacggacagccttcgaagaagagagttgctgctaaagtgatgtgctatttccctataataccacggctcaagcgttggttcaggaacaaagcgcatgctagaatgatgcgctggcacgcagaagaatgtcgacaagacgggatgctgagacaccccaccgatgagtcacattggcgaaacatcgatggaacatttcaagacttcggagtggatgcacgaaacattaggttcggtttaagtatgtatggcatgaatctatttggagatgagcagcagccgtaacacttggcctgtgaccatgtgtatctccaacttcccccctatgaatgaagccgaagtacatcagggtgtcgatattattgaaggcccaaagcaacctggtaacgacattgatgagtactaaagaccattggttgaagttctgaaactgcgtgaaagaaataaggtgtcctcgtgcgggatgagttcaaacagaagcaatttaacctacgagcgttgctgttcgttaccattaacaacctatctggacagtcaaacaagggatataaggcttgcaccctgttgacggaaaacacagtggcctaggggatctgcctaactttagtgcaggtctaagacttgtatcgagtgtgctaagggcgtgtcagcttgtttcatcctgcaaccagcaaggaaaaaagaaacaaggtgagttagcggatagccgatcggccgataggctgatgacgtatcgttgatggtctcagccgatatggttagaccaaattggctatagactgagtagatcaaagaatataaaaccctacatatcgtctgcttagtttgataaaatagatttcagacgatatcatgagaatagccgatggaacaatttttagagaaagataggtaaataaagataatatactagctaatactctagtgcaaacttatataaacaaatcaatctatagcaatctatatttagactaattgggcactttctatgagctctcacgttaatcagaaatatctaactgttgattaggtagatagttttatcgtggccatcgatctaggctggataaaattattacggcttggagttgattgttaccgccgagataataacagataattaactaccataattagcgtgatgtgcggcatatatgcagcatagcacggcatattctgccgctagcaggcacgttgagcgttccatccccagcagcaatcaacgtgtactgcatcaaaatcacagtgcctttcatggatcgatgaaagcatgcatagattggcagggctattgctcacgtatgatattcctcatcactcgcatcccatacagcttgaagccatcctgatgcatgcagcgcacatgaaatttgtacaaaacaaatatgcacgcttttttccatctcatccttttttttatttcttttaattcttatgccatttcatccatgctcgagctcttaattaattatttgtagtgatgcaaaacaatgaaaatctaacaaatctgcagctttgtgtgcatgctattgattcactaaattgtactccctccgtcccaaaataaatgtagttttgcactagtcacattcaacgtttgaccgttcgtcttatttgaaatttttttatgattagtatttttattgctattagatgataaaacatgaatag

SEQ ID NO: 17654 - DNA, 696 bp, Oryza sativa
  unsure (1)..(696): unsure at all n locations
accctaatagtatcagagcttaacattatcgattaatggtcttgcgtgtgttcatatattttgctcttacttcaagctaaggctccctgtttaatgtctttgatgcgaagcacaaggcagcatggcaaatctgcttggcaaggtttatggtctgcccagccggcagcacttggtacgataacggagaagcgaagaaccgcgagaggagctcttctccgtctatgtgcgattgtcttctgttcatgtcaaagacgatggcgctttaagctggatgaacaagaagaagaggcgagggctcaactagttattagcggagtaaagaatttttttttttaaaaagtgaaaaaaacccccccccggggaaaaaaaaacatggtggatggggacttatctatgttatctatccatgacaatgatgggggctagttacctgacctaatgctagatagatcaattgaaagacagagctttatacaggtttgggccctttttctagaactaatagttctgttctggtggatattttctcccctattaattgtgtcgagttgtgtgttgcccctcaacgaacacttataagaagtattgtgtcttgatgcgtctatttacatgcatgtgtactgaccagtttctttacttncagaaaacaatcctttgcataataatatttggacccgatccattgggaccaatcct

SEQ ID NO: 17655 - DNA, 699 bp, Oryza sativa
  unsure (1)..(699): unsure at all n locations
nnnnnnnnnnnnnnnnnnnnnnnnnnnnnnnnnnnnnnnnnnnnnnnnnnnnnnnnnnnnnatgtggtccgttaagcatagtgcctgtttctattatgaatcagcagtgatattttcaatttataccactgttggttggtattttcaaatcatatcattgttggttcatatcgagaaccgacagtgataattgaagtatcattgctgtttattgttatgaacattagtgttggctcggaataccgtttctatgctataatgaggacatgttagtagaaagaaggaattgtaatggggttgatgaggtgggagaaatcagtaccattgagttgagacctaacatctggagagtgtagaattagaagagtaatagacctataattgggacatattgtatggaggctgccttaagaaattaaacaaagaagttaccacgttagcttctatactaacaggtggagattaaaaattttttatggcatttctctttgggcaataggtttcataagcattgactgcggcctggaggcagacagcagctacctgggcgacctgaccggcctcacttacgtcccagacggcccgtacatcgacggcggcgagaatcagaaggtgaccaccgtataccgcaatcgctggtggggccctgacacacgtactctccacacggtcaggagcttcccatctgccaagggtcag

SEQ ID NO: 17656 - DNA, 981 bp, Oryza sativa
  unsure (1)..(981): unsure at all n locations
gacatattgtatggaggctgccttaagaaattaaacaaagaagttaccacgttagcttctatactaacaggtggagattaaaaattttttatggcatttctctttgggcaataggtttcataagcattgactgcggcctggaggcagacagcagctacctgggcgacctgaccggcctcacttacgtcccagacggcccgtacatcgacggcggcgagaatcagaaggtgaccaccgtataccgcaatcgctggtggggccctgacacacgtactctccacacggtcaggagcttcccatctgccaagggtcagcgcaactgctactcgctgcccacccatatcgggtcgaagtacttggtcaggctggatttcttgtatggcaactacgacggcatggacaacccatcgctaaaattcaaccttacccttggtgtgaaacactgggacaccgtgagtatagacaccaccgacggaaatgatggttataatgttcacgaagcggtgttcgtggcatgggcgagctaggcgccggtttgcctcatcaacatcggccagggcacgccgttcgtgtccacggtggagttgaggcctctcggtatcttgccctacccggctgtcatgggcaatgtgtcactctccctctatgttcggagcaacgtgggatctagccctgacgatgacaatttagtaaggtatatatgttcttaatttccttggatcttgtacattttgcagctcagttagtcagttgtacgttaaccaatatatcacttgaagctattttctgattttattaatttagctaaacaacgcactacaaactgggcattactcgcggttccacattaccagctatgtttgggagacgaccagcagcgatactgatttttacaaaagaaaataaaatgattttaattcatacagacaaaaaaggatcctaaatnnnnnnnnnnnnnnnnnnnnnnnnnnnnnnnnnnnn

SEQ ID NO: 17657 - DNA, 686 bp, Oryza sativa
gggcgaattcgagctcggtacccctcatcgagcccgtgggacgatgattcagatcgcatcttaacagcaacctcggtattgtcttctaaacagccgtaatagacatttccaaagcctgcatgcccaattaaacatttgaagctatcagtgaacttcgctagttcctcatatgtgaatcgacgattctcaggtttttgtagatggtcccaatgatttgtccaatgtcctggaggacttatctgttctggtaccgtgggagaatcatctgtagaaactggtggagaaagaacatgtttagcagtattaaatgcagatattaaacaatgtgtttttcaaatgcccaaagggaaattttttaaattttttaaggggttttaaaaattttttacacacaatggggctttcttttggctctccagatcaaatatgctacaacaagcatggcgactacaagcactggagccgctacataaacagctaaggtagctgctctgtttcttgaggacgaagttattggttttttgcacatatctccgtagactcgtagctggaattacataaaacaataagtccatggttttaaattggtatgctcgccaaataaaaatctacaccaaaattaaagcacatcaatggggggaattaaaagtgatattagcagagtaattcccattaggaaggggcaa

SEQ ID NO: 17658 - DNA, 1792 bp, Oryza sativa
ttgaagtactaaacaatttcacctaaaaaagtcgtcaagaacaaagttgtatataactcatcgagatatataacttttattttggtcatttcttcatctgacaaagtgatagtaacattattcataaaatttacacatctcttatatagttttataaaataaaataaagatatgtaatttttggaaaatattactatcactttgttggatgaagaaatgaccaaaacaaaagttatagatcatgatgagttatacaactttgctgttgatgaccttttcagctgaagttatttactacttcaaaatattatttaaaattttaaattcaatttttttttttttttttttttttaaaaaaaaattttttggaaaaccaaaaaaacaaagttacaagaaaaaatggccaaaataatagcagaaagaacacaatgacatgatagagcatgattttggaaacatttagaaaaaatgatcatccaatttggagttcatgagtgagataaactggtttcaattttttaaattttatatgcaggctcttaagtggcccgtatggaaaaatttattttttcatacgggcgtgttaagtagccgtatgcgaaaatgccgctcgatttttttcagacgcggcaagttatgttccgtttgtaaaaattatagggtcttgtatagaaaaatcgtctgtgtagtagtggctgtagtcgtgttagaagcagcggttcgagcggacagccagacacaggtcaccttgatttttctgttctgttgtccctttcactgcaaaactcttactatctaattttacaaggcatgatcttaaaaaaaaatggtctacacatatacacataataaatgagtaaatttcataaaactatagatatttcttttgaaaaaaagataaaatatagatttaaggtggtgttgtatcacgaaactacatacatacatagttttcattgagttcattgtgaaaagtcgctgtatatatggtaaaactatagatcgatcgttaatttaagacaaacctgaagtggagctgttcggtgggacttgttgcagcatcctggctgtgctgttaaggtgatgacttcaaatgtaaatgttaaggttatcaactataaaattataaaattatatatcttacttactgtataattttgatatagagtttgcgtcgatttcaattcatatgaaaattttaaagcatttatcaattagatctgataacttctatcacacatatatatgatcacataaactatgtcaaataaaaaattgttcagcaaccacgttgtagatcttgtcaagaaatataactttggcagaaagtttatctttgatcatcgacttcatataaaaatattattaatttctttatcattttcacttcgatacgcagttaatggtgggctgtcacgcccagaaattcccgaatagaattccaagcagaatgtgcattaaaacccccgtccagtaccggccggggtacacaaacgacaatgttgacatacagatccacgtcttacaaacaatataaaagtcttacataaatgcagcggacaaacgatagataacaggagctaagccttgacttgaactgcagcgggaacaccactccacaggcatcctcgacggcacggacgaagcctactcctcggagaacccgccatcggacacatactcatacgctggggttgggggaaaaataaagcaagactgagtactatccactgtactcagcaagtcataccggaatggggggtatgatgcagggattcaacaagggatagct

SEQ ID NO: 17659 - DNA, 722 bp, Oryza sativa
  unsure (1)..(722): unsure at all n locations
actatgggcgaattcgagctcggtacccctattgccaaaaaaagcataatgcttgcagagtgggggatttcaggccaataagcttcattcatgctttcggcaaaatgttctctaaactcctagcaaattgattgacaccgaaactacaacaattggtatccaaaaatcagagtgccttcattaagaggagaaacataaaggacaactttcctgttgtcaataacatggtaaaagaacttcattcatccaaaattctagcgatcctcctcaagcttgataaagcaaaatcttttgattctgtcaactggccatatcttctcgaccgcttgagagatctttgggttttttttttggggggggccccccccccaaaggggggggtttttgggggataaattgggtcacctccattatagcaagcacgtcatccaaggtgatcctaaatggcagggcaaggaggcgtggcggcgcggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17660 - DNA, 735 bp, Oryza sativa
  unsure (1)..(735): unsure at all n locations
nnnnnnnnnnnnnnnnnnnnnnnnnnnnnnnnnnnatatagtttcataatttaatttatatgagttaaaccactgtaaataatattagttttgtaaatgatcaatccatgtcgtcaacaaactattggatagaatcgatattgatatcatcatcaaggacttcgtatctaaaaatatccgaaaaattttaagctaacaggttacaatgtttttatatattataatttatagacgcaatttcaatgttatcggcaatagcttgttgctgtgaaaactctggatcgaccctgtttagagctatggataaagattactccgccaacacctctgcctttacgaaagtaatcaattttttcccaaattttccaaaaatttttttggggggcccccccccccggggtgtaaattaagatgtatcgtcgctgcacaaaaccatcaaatggagaggtcacgcatactcaacaaccaattacgcatatccatcaggcaagagctgaccgattacacacacccaagtaagcaagctacaacaaaagataaactcactcttactaaaacatattttgatatccatgagaattatatatatagtacttaaatctgggactttggtcttgtgttcacatgtaaactggacatcttagatgttaattaacaaagagctngatgatcaagctaaggatggattacacaaagatgatgcctgattatctatacttattttggagttcacca

SEQ ID NO: 17661 - DNA, 669 bp, Oryza sativa
  unsure (1)..(669): unsure at all n locations
aacactgaactcttgtctcttgtgctttagagaagtggcaaagtccgaccaagaaggtggcaatttggcaataatgccacccgccacaaacttgtccggcaactaacagttgttgttctcaagttccttagctagcatctgaatctcatgagcttgttctactacagaacggtcatcgaccatcttgtagtcatagaactgctccatgacatacagctcactgccggcgttagaaactccgaacttggcctcaagtgcatcccacatgtccttcccagaaaggggccaattttggttttgggcccaaaaattttgggggttttttaaaacccccacgtccactatattgtcagcgagtacactgatcaatgctccacggaacagacaatccgatgcctcgaacttagcctcttcctcaggagaaagaggtggttcacttcatttgccacgtgaaacatagaagcactgcatcgctgtcaaccacatagtgcacgggctttncatctcttatagttagaaccatcaaaagcatgtggtttcagtgcagcagcaaagccaactaccgaaaatgacctatcaggtttttggattgttggaaatatggtcaagaatcggcatattttaatccaaaatgttaaagcaatatcatggcataagcagtgtaggttg

SEQ ID NO: 17662 - DNA, 664 bp, Oryza sativa
  unsure (1)..(664): unsure at all n locations
ctattttaaaaaacggaatctgtcggtcggagtttttttggaatttttcggaaacggaaacgaattcgaaaatattttctcggaaacggaatcggaaatgataaggccagtttccgtcggaactcggaataagtcggaaactttccagaaattttctaactaaaataccctggattcatttttaagcactgaatagtgaataccatggtgtttggctgttattctttaaaatatatttgttatgcaaatctgaagttatataagaatattttttttctgcattgggattaatcaacatcattactctcttaaacatagataatttattccatagattgtgttttgtgatgtactgttgagacttaaaaattggacttatatgattgtgttttatgatgaatcgttgaccgttgagacttgagaattggatttattggtttgaggggttttgtattctcataatttttcgttaccgtattcgcgttggttcgtttttgctccgttttcggtttcgataatattcgattccgttttcatatccggagtttccggttccgattccgattgcgaaaaaaaatgaaaacgaaaacgataatgatggttttcgtnnnnnnnnnnnnnnnnnnnnnnnnnnnnnnnnnnnnnnnnnnnnnnnnnnnnnnnn

SEQ ID NO: 17663 - DNA, 719 bp, Oryza sativa
  unsure (1)..(719): unsure at all n locations
gcgaattcgagctcggtaccccaaggaaagcttccgataccctacagaggccaaggtaggactgaagcggcaggctatccgcaagatggggaattgttggaaaaatttcaagacaacgctagtcacggagtacgtcctcaaccctgcccagccagaaccatttgtgaaatacccattcatcaccaaacccgtgtgggatgagttccatgccgccaaatcaacgaaagagtctcaggaaaaaagccagacctaccgtgatctgcaggcaaggaaccttcacctgcaccggcttggcaccggaggctacgcggggaaacaggcagaatgggacaaagggggaaggggggaatttttggtaaaaaaaagggagcccccttttttaacagcggaatctaacacccaaccagtgcttgctgatatcccggtctagcgggcaaggaactgggcaagggcaagggtgaagaagaatagtgacggaactctttcgttgtgaaatnccgaagatcaagcggtgtaccanaaaatcgnatgttgacacatagaataagtttaattatgcatgtatcttgttgttcgtctaacgcatcctaactgtactctaggtcgaactgaatgctgagagacaggcctcccaagaggtttgctcacaaaaacgcgaggatgacatnctcacgaaagcattgggaaacgaagaacaccgtggacgaacaaagggcatt

SEQ ID NO: 17664 - DNA, 638 bp, Oryza sativa
  unsure (1)..(638): unsure at all n locations
ggtacgtcaacactagggttccattgctccaatgtcggcctancggtgtcgtccaaaacctttaacggccgtggtcgggtggctntactttgtggcctgcgtcgaagactaagctgttccggaagtcagcgtcacaggcgccacaacccttcgcggtggctcggactctctagccgccgacgcttctcctgctggtggctatggctcagctgctcccggacccagcgactcgatgtcgggttctgaaggcaacaacagtcgccatttgcaaggtttgtccctcggatttgcttgcctccatcctccgttcttcttgattgtctcaatctgcctcatgccctcatcacctctcttggatctgtcattttgtacctgtcttgtttgtcatgcttggaaatttactagtaattttaaactaatctatgcattctattctcgttcaggtccaatataatactcacaaggaaacaatatgggaaagacgatctagcgatgtcttcaacttcacttccacaggtagctcaactagattataaaccaaaggtcttctccttcagagtacttctccaactgtggtttgatgattaaaggtgagcatatgaaatactccgcaagccacataacaaatatgcagatgc

SEQ ID NO: 17665 - DNA, 766 bp, Oryza sativa
  unsure (1)..(766): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatgtacttgtcgtttcttcttatcctacttctcctctgcggctttcataaaacttaatatgccatctctatactccttgtactgacgcctcaagccagtcgtgtacatccaactccgatctatcgctgaacaatggggaaaaaaccacccccccaaaaaaaaaaaaaattttaaatttttaagggtttaacatctcataacataagtactactaaattaataggaaatatttagtagccttttacttacttttatgattttcctgtttttgtttgcaaaaaaaattacaaaaattcgcccccttcaacctcccaccaaaatagtgaacagtgggataaactacagtcaatggactgctggagtatatatagtgtgcaaagtatatctcaatcgggccaaaaaaatgtcatctctaacgggcgcacactaatctctaacgggcacaaatagaagcccgacacctataagagtcatcggtgacgggcattaaggccatctcaatcgggccttctttggagcccgtcaccgatgacactcatctgtgacgggctcagtatttgggcccg

SEQ ID NO: 17666 - DNA, 3742 bp, Oryza sativa
  unsure (1)..(3742): unsure at all n locations
nnnnnnnnnnnnnnnnnnnnnnnnnnnnnnnnnnnnnnataggaatatgcaccccgacgagtacatctacaacggcaaaaatttaggcccgattgagatgacttcgttctaacggcccacgttgtctaggcatgtgatgagccatcacagatgagaggatctgtactagtggacgggagatgctccaggtttcatttgtcccgatcttcatctaatttcatcttttagatcgtgaccagatatttggtatttgagaacacgtacgtaaatttgttttccaatcaagtttagtttttttatgccaccatctaatcttcgtaattaccaataatactcaatcatattaatcactaatggtttgtgtaagcagaataatcacgcgtacacgtatggcagagcctctacagacgtcaaaagagctagctttctttgggatcaaactagcttgctacacacataggctgttgatatcgcttccattgcactaaagatgattagagcaagttcaatagtaatctatagccaatgtaatagccaatttatacaatagttgtttactatactattaatacctgtttctacttatcatacatacattacatcttaaagtccgtgctacagctggttacagatctgtagcccgctgctattctctctctttttttatctttttaaaatatgtttatagctggcttatagcctgctattttacatgctcttacacaggttgataggctgctgatatgtttggccatatgtctgatagtttaatccgttgcactgaagaggatttattcgtgagtcgacgtacacatccgtagattacatgcacaggtatttcgtcgaatgtgcaagttctattcaacacagatttttgtaacacaccagccaaccacgtacctagagtgccacaccaagcatacactcaaaccactaactcccaaaattattagaaattttggcagagtctccgctgtaaatacggacatccacgacaggaaattataagtttaactaataacaatatcattcccacaatacgatccatccttataatcatggggaagaaactattagaaatctaaaagattattacaaaaccgaaccatgatatagtttaagtattattatggatctaggcaatatagtttgatagtgtgcagataaatgtgtatataagggtgctacgtcccgcccatgcatgtcggtctcaatatgtacctaaaaccaaataaaacacaagagtataaaaatactcggcaagtacaatatgggactagaaacacatatacacatcattggcaataaagcatgaacagaaggttttctttctttgataggaaacacattttcaaataccaagtcaaagaagatagtagttcccattccgggctggcatgaattgaaatagtagtttctatcccggacaatagtgaatacatcctaacatttgccggcaaagccgagtaagcgtgatcagctcttgcccacaggaatttgaataaagaatcaaattgcactcccatgactacgcatggtagttgaataattgaaaccggaatcaaagaaccaaattaaaaccatattgcacattcatggcaaacagggaacttgaattatttacccagaaccagaatccggaatattgaaacaagaataacatcgtaaacatatgataaacaagaaaagcaaaatagtgtgaacaaaaatatgaatataagcggtcacatgtcacatagaaatatatcggaaataaatagatagagcaaacaatccatcaatcacacacttagttcgtcatgcacttgcctccaatgaagggttggtatcatgcacgatctgaaaaaccaccacctaatcacaaacaaaacctcagcaaacacattcaacatgcatataaaacaatgaaaaaggtgaacctactgccctatcccatcaaaacgcaataacaaggaacgccgcttgcactataaacaatattgttgcttcaaacatttatatcttgaaatatgaaaaggctattaccgcaaacaaatacattttggaaatctacagaacaaggcctacaactcttatgtggaaatcatatttttattatgccattaaaatggtctaatttgcgcttgaaagcaggcttcacaatctgtctagaaattcagactatccgcactaaaacaatcataactggagttctacttgcccaatcagggtgtactttaccaatatggaaagctaagaaaaacctctacaactttgtctataggcgtcttggctgattccactgtttatcccatccaaaaatggttcaatctactactatccagattatgacataaaaacaacagttatactcaaaaattcgtatcatctaaaccacttgagataaaatcgcgccctttggtcagaagatagatataaatattatctacagcttcctagttatacactttcgcagaaaatatcattttgatctccgaaactttgaaaaaccgaaacactgtaaatctgccaacgtgcagaacagccaattcgaaccacaacaaacaaaactccttctctaaccttccttatccacgaaataaaccactaaaaccaccctagaacaattgatatgacaagggaaaaagcctcacctatggtttctttagagaacttgtgaggagacaataggggagactatgatctaacccctccttttactcctctcctcctcctcgttgcgtttttctattttgctttttatccaagttatgaaggcggagatctagggagagcaatttgttgtagaggggagagatgcgaacataggaggtgggagtcggttcccctctctctaagttttagggaaaaactaatgggttgggtttatgggccttctcatgttggcacacttctaaagatatttttcttttatttatttctgttaacttctttattttaacaagtcaacccaaactaaaaaaactaaatatattttaatacggggtattacaatttcttttttagtttgattgaaataatgaatatgttgctgatttttttggtgttgaattatatcttttatcataagtgcatggttaaggtaatcatgtcaataaattagaaaaatcccagacacaactataaaaaaaggtatttaatcttagttttgaaacaaagatatatattggtatattttctgtatacacagttgaaaactaccctctccatcccaaaatacaacttctagcatttaaaaattcaaccaaaaataaataacaactttacttttaaaaaaatatgacaacttctctactaatttttttctcaatcaattataacctttccccaatttaattctacctacttccttcatatttgtgtcataccctaaaatttattatattttgtgaccgatagtaataattaattttccctatgtcttttttttgtgtgtgtgtgtgtatatatatatatccatatgactactgtgtgcagtctgcaatttattgttatttgtacatgccgttacagttttatcatcataccaatttttctgacaaacaacacctagcaaaatattgtgccacagtagcaaaaaacacaacgccctaaaaactacaaaatttggatgatcgagactctaggataaaattgtggcacagtagcaaaaaactcaactccttaaaaactacaaaattcagatgatcgagnnnnnnnnnnnnnnnnnnnnnnnnnnnnnnnnnnnnnnnnnnnnnnnnnn

SEQ ID NO: 17667 - DNA, 1320 bp, Oryza sativa
  unsure (1)..(1320): unsure at all n locations
gggcgaattcgagctcggtacccatctaatcttcgtaattaccaataatactcaatcatattaatcactaatggtttgtgtaagcagaataatcacgcgtacacgtatggcagagcctctacagacgtcaaaagagctagctttctttgggatcaaactagcttgctacacacataggctgttgatatcgcttccattgcactaaagatgattagagcaagttcaatagtaatctatagccaatgtaatagccaatttatacaatagttgtttactatactattaatacctgtttctacttatcatacatacattacatcttaaagtccgtgctacaagncctttgggggggtttttttaaaccccccaaaaggggggaaaattttttccctgtagcccgctgctattctctctctttttttatctttttaaaatatgtttatagctggcttatagcctgctattttacatgctcttacacaggttgataggctgctgatatgtttggccatatgtctgatagtttaatccgttgcactgaagaggatttattcgtgagtcgacgtacacatccgtagattacatgcacaggtatttcgtcgaatgtgcaagttctattcaacacagatttttgtaacacaccagccaaccacgtacctagagtgccacaccaagcatacactcaaaccactaactcccaaaattattagaaattttggcagagtctccgctgtaaatacggacatccacgacaggaaattataagtttaactaataacaatatcattcccacaatacgatccatccttataatcatggggaagaaactattagaaatctaaaagattattacaaaaccgaaccatgatatagtttaagtattattatggatctaggcaatatagtttgatagtgtgcagataaatgtgtatataagggtgctacgtcccgcccatgcatgtcggtctcaatatgtacctaaaaccaaataaaacacaagagtataaaaatactcggcaagtacaatatggaactagaaacacatatacacatcattggcaataaagcatgaacagaaggttttctttctttgataggaaacacattttcaaataccaagtcaaagaagatagtagttcccattccgggctggcatgaattgaaatagtagtttctatcccggacaatagtgaatacatcctaacatttgccggcaaagccgagtaagcgtgatcagctcttgcccacaggaatnnnnnnnnnnnnnnnnnnnnnnnnnnnnnnnnnnnnnnnnnnnnnnnnnnnnnnnnnnnnnnnnnn

SEQ ID NO: 17668 - DNA, 634 bp, Oryza sativa
  unsure (1)..(634): unsure at all n locations
nnnnnnnnnnnnnnnnnnnnnnnnnnnnnnnnnnnnnncgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaatggatccgaactttccataccagtcgccgtcgttcaccttgggtgatttcgaccccaactacatgtcggggtttgacggtacctccggatcggctccaactccaccatctgtggaggaggtaccggttcatacggctgtcgttgaggaggtaccggttcaggcggagacagcttcggaaggattttccggaaccgcgagcggaagtgtttcgacacacaccggctcgaagagatcgagaacctctggtgtgtggcaaagcttcgacgagataaaggaaacctgccccgacggaagggaggtatcgaaagcccgttgtagaatatgtaggcaaattttatctgctcgttcttctggtggtacaggtcacctcaagcgccatgcggagtcgtgtgccaagaagcaaggaatacaacttcggcagcagcaacttatgggaaacccagacggt

SEQ ID NO: 17669 - DNA, 1793 bp, Oryza sativa
  unsure (1)..(1793): unsure at all n locations
nnnnnnnnnnnnnnnnnnnnnnnnnnnnnnnnnnnnnnnnnnnnnnnnnnnnnnnnnnnnnnnnnnnnnnnnnnnnnnatgctctattgccaattatgtgtatatgtactttctagttccatattgtacttgctgagtattttgatacttttatgttttatttggttttaggtgcgcattgagaccgacatgcttgggctggaagtagcacccatatatacacctttatctgcacactatcaatctatattgcctaggtccataatgacacttaaactatatcatggttcggtcttgtaataatcttttagatgtattttagtttcttttcatggattataaggatggatcgcactgtgggaatgatattattattagtttaacccataattgcctgttgtggaagtccgtatttacaagggaaactatcgaaattcttaatgaatttaggacttagtggtttctataccatagtgtgtagcattctaggtatgagaatacctggcatgttacagagaccgacaacaatagcctgtgttctgcggtgccctgctcgaaatgaatcaggaggtagtccgtgttgcgctcaccccaagcgcggtgtgtggcggagcatcggcggctcggcgccagcatggcccttgcgctgctgtggcgaagagtgcgggaacgacatggagccacagggcctaagcgcatgggccctccttgaacccccccttcccccctagagggctacctcatcggcggcagctgcggttgcagcgtcaaaggtgtatgcgagccggacttgggctgtgttcttccacccattttcccaacccagctctctcgttttctgcgcacacgcttttcaaactgctaaactgtgtgatttatgaaaaaactttctacatgaaagttgttttaaaaaatcttattaatccatttttcaaaaaaaaaatagttgatacttagttaattatgtaataaaacgagctttgttttgcatgccggggagccatggtaggcaggggaaagtcatacttttgttattgtttgtctctgcatttcctttggatattataaaataatctcgcaggcctccagtagctaattaccagttttttcggtgtcctacaacaaatacacgttcttgctgtgtccccggccaattacacgttttttagatgtcgcttagcaaattttaacctaaataaaagaaaatactaaaatttctcaccaaaaatcaaaatatcccagcttatcttttataaaactggtagacccattacttataccccgttagacatctaacgactttctatcaactttttctcagcttgtatataggagctatttaaccatacattttgatattgaagcttttatcaataaatgatcattttaggagataaacaataatctcaagatgatcatagcatctaaattatatatataatatatgaagtcacgtggctagttgaacagcatactgattgattgtactgagcgtgttggttgcaccaaggaatcttaagtatgaaacaagcatgatgtggcctcagcaatatataagccaattacagatatgaattaaaagactataggggatccattttttttttgtaaaacttgctacagtacatcgtgaatttgtgacacataacatagaacaatctagaaacatataattattacatgatgctctagtttagtggtaatttgcaaagcaaatactaccacatctattttaatttttcttacttaattggagcgagataatttataattgatgcctttaccccatgcca

SEQ ID NO: 17670 - DNA, 734 bp, Oryza sativa
  unsure (1)..(734): unsure at all n locations
cccgcttggtcgaattttacagtcggagccataagaggttcgcttacgaaaaaagatgaacgaattatcataggtgagatgtaaagatgttagcatgcgaaaaggtacgagcgctcaaaaaatccacgcagctaagtctccatctattattttatcttcatcccttaggctgtgtttgatacttggggttgggaacccaactccaccgcacggaaaacggagcggtccattagcgtgtgattaattaagtattagttaattttttttcaaaaatggattaatttgtttttttaaagcaactttcgtatagaaactttttgcaaaaaaacacaccatttagcagtttgaaaagcgtgcacgcggaaaacgagggaaaggggttgggaaacttgtggaaagaacgcagccttagtctgctcactccctccctcaccctccactcccctcgcctaccctccccctgatctacctcaggggtggaagccagtagtgaaagcggtagagggggcatcgacggcccttccctttcccagatctggccaaagaggagtaggacagcggaggcaacagctgcagcagaagtagaaggctgtggtagtagcagcagaagaagaatcaaaaagcagtggtggtggaggcggcaggagcaacacaaagcagnnnnnnnnnnnnnnnnnnnnnnnnnnnnnnnnnnnnnnnnnnnnnnnnnnnnnnnnnnnnnnnnnnnnnnnnnn

SEQ ID NO: 17671 - DNA, 1389 bp, Oryza sativa
  unsure (1)..(1389): unsure at all n locations
agccagaaatgaccttggaattcccgtgctactgtcctgttttttcttttctggtcacgagttgatacagacatgggattagctccttgggtgacctaccatctatcatcggtccttcacaagctacctatccgtttcatcacaaggtaggatggaaccttaccatggtttgtcatatgcgtccaatcgaaccagagctaccttagttgcaatgatccgtcgaaacaatccaaatcagttatacctatgcccgctaaatttttttggcagcataccctttaccagttcactaagcaatgtccgtcgtgtgtctgttccgaacctgtctagaggaaacctcgatgaaatttgtccatattgttttcagtccacttctttaggtgggatactgtgaggtgggtatgtcggcagggctgaaagggtggacttaatcaacactaactgacttgttttgttaagcaaccttcctttccacgttggtagtctagctgcaaaccagtctataagcggttggacatccaacttacgaattttcctgatgtgtagaggaagtcggaggtaggagcttggaaaagtttttttgttgggctgggaacggggagagaatatcctgcagattggggtcgttgcacctgattgcatatactttgctcttttccagattcgtggtcatcgttgtagcacgtccgaaattttgtagaatggcatgtaccgcttggagttcctatttgtccggtcttgtgaacaccaccccatcatctgcgcataaggctatgttgaaccatgtgttcttccgtgcaagggctgtagaatacatgtttgttgggcggcggattaaagcttttgcagcgggtctatcgcaaggatgagtaacatgggagagagagggtcgcgttgacgtaaaccccggtcatgttgaaagccggtccctgccctgccatttaggatcaccttggatgacgtgcttgctataatggaggtgacccaatttatccacctggccaaaaaaaaaaaaaaccccccccccaaaaaaaagggaaatttccctttncctcaaagcggtcgagaagatatggccagttgacagaatcaaaagattttgctttatcaagcttgaggaggatcgctagaattttggatgaatgaagttcttttaccatgttattgacaacaggaaagttgtcctttatgtttctcctcttaatgaaggcactctgatttttggataccaattgttgtagtttcggtgtcaatcaatttgctaggagtttagagaacattttgccgaaagcatgaatgaagcttattggcctgaaatcccccactctgcaagcattatgctttttttggcaatagggcaatatagggggtaccgagctcgaattcgcc

SEQ ID NO: 17672 - DNA, 1609 bp, Oryza sativa
  unsure (1)..(1609): unsure at all n locations
nnnnnnnnnnnnnnnnnnnnnnnnnnnnnnnnnnnnnnctctccttgtgaaggtgcacctgctgaatgagctgccgcaggagaatgaattctctaacttgagtagtcgagttcatccttctcatctgccttagccagaaatgaccttggaattcccgtgctactgtcctgttttttcttttctggtcacgagttgatacagacatgggattagctccttgggtgacctaccatctatcatcggtccttcacaagctacctatccgtttcatcacaaggtaggatggaaccttaccatggtttgtcatatgcgtccaatcgaaccagagctaccttagttgcaatgatcccgttccgggaaaaaaaaaacccaaaaaaattttttccgcccccaaaaaaaaaaatcagttatacctatgcccgctaaatttttttggcagcataccctttaccagttcactaagcaatgtccgtcgtgtgtctgttccgaacctgtctagaggaaacctcgatgaaatttgtccatattgttttcagtccacttctttaggtgggatactgtgaggtgggtatgtcggcagggctgaaagggtggacttaatcaacactaactgacttgttttgttaagcaaccttcctttccacgttggtagtctagctgcaaaccagtctataagcggttggacatccaacttacgaattttcctgatgtgtagaggaagtcggaggtaggagcttggaaaagtttttttgttgggctgggaacggggagagaatatcctgcagattggggtcgttgcacctgattgcatatactttgctcttttccagattcgtggtcatcgttgtagcacgtccgaaattttgtagaatggcatgtaccgcttggagttcctatttgtccggtcttgtgaacaccaccccatcatctgcgcataaggctatgttgaaccatgttgttcttccgtgcaagggctgtagaatacatgtttgttgggcggcggattaaagcttttgcagcgggtctatcgcaaggatgagtaacatgggagagagagggtcgcgttgacgtaaaccccggtcatgttgaaagccggtccctgccctgccatttaggatcaccttggatgacgtgcttgctataatggaggtgacccaatttatccacctggccaaaaccaagatctctcaagcggtcgagaagatatggccagttgacagaatcaaaagattttgctttatcaagcttgaggaggatcgctagaattttggatgaatgaagttcttttaccatgttattgacaacaggaaagttgtcctttatgtttctcctcttaatgaaggcactctgatttttggataccaattgttgtagtttcggtgtcaatcaatttgctaggagtttagagaacattttgccgaaagcaatgaatgaagcttattggcctgaaatcccccactctgcaagcattatgctttttttggcaatagggcaatataggcccaagtcatgagccagagatggtgaaaggaggtgtaatatgcttggttgatcacctgtaccaaatcttgtatgatctctcagcatttttcaataaaaaagctcctgt

SEQ ID NO: 17673 - DNA, 838 bp, Oryza sativa
  unsure (1)..(838): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagatcccatatgtcaatgtctcctcccctgttcttctctccgtcatgtgtctacctctatttctctcttgtgtgatccatgacatcatgggctatgacggaggtaggcggacactactacagaaaagcccaaaggcgccagttctaaaggtcctatcttataaaccgatttcagggttacaaccctgactcctcattgggccacgtagcaccacgcccagagctccagccggattctcggccggagaacgtgccacgtattcccaaccatcctgcagccgtccgataatatatcaatggtgaaaaaaccttcaacggatccttcacaaaatgtgcaatctcatctagaacagtcgggattagaggggaaaaaaattaaaaaaaaagaatccaagcaaaagaaataaaaacatcaagaacaatagattccccttgcttgatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17674 - DNA, 945 bp, Oryza sativa
ccatcccttgtcgacaaacatttccacccaaactaccatccaacctagcaccgaatttgcggtgccctcgcctgttctccagaaagccattgtgccgagtggcaactccatgaaactagttttcttttccggccaagtagacgtccttcttcgtaaccacttcgtgatcctgcatttcgctgacttccagaacaacaagtcccgggaatttacagtttccatcgacaacggcgtgcatagcagcccatacagtacaccgtacctaaatggtttgtcagtcaccggcagctggtccagcgattctgaaggcaagtataacttcaccattgctgcaactgccatatcagctctgccccccatcctcaacgcttacgaggtctacggtcgtattgtccatgacaatccaacaacgttctcccaagattgtaagctcgctatatctgtcggtctcggttgaggtacactaaacaaacattatcaactctccctcttgaactcctattttttttcctcgtatgctagttgatgcgatcatggctattaaatatgagtatggaataaagaagaactggatgggtgatccttgttttccacatgaatatgtttgggatggtgtgaaatgcagcgatgcaggtgataaaatcatggggataatatctctgtgagtatatttgaaaggtatgcatgtactagcattattaattgtatacatcaggctaaattttgttggattacttgaaattattatgcagtgatctttccaacagcgaattgcatgggtcgatatccaattctttcacaattgttactgccctcaagtacttgtaagtatatctgagatcccctctgccttcagttgttctgcatttaaaactcccaattgacatgactatgcatcatcttccattaaaaatgaaaaacaccgactaaatattatctagaggg

SEQ ID NO: 17675 - DNA, 6488 bp, Oryza sativa
  unsure (1)..(6488): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctagttgatgcgatcatggctattaaatatgagtatggaataaagaagaactggatgggtgatccttgttttccacatgaatatgtttgggatggtgtgaaatgcagcgatgcaggtgataaaatcatgaggataatatctctgtgagtatatttgaaaggtatgcatgtactagcattattaattgtatacatcaggctaaattttgttggattacttgaaattattatgcagtgatctttccaacagcgaattgcatgggtcgatatccaattctttcacattgtttactgccctcaagtacttgtaagtatatctgagatcccctctgccttcagttgttctgcatttaaaactcccaattgacatgactatgcatcatcttccattaaaaatgaaaaacaccgactaaatattatctagaggggtgaaaatggtacggaaactttccggattctggacctattttaaaaaacggaatctgtcggtcggagtttttttggaatttttcggaaacggaaacgaattcgaaaatattttctcggaaacggaatcggaaatgataaggccagtttccgtcggaactcggaataagtcggaaactttccagaaattttctaactaaaataccctggattcatttttaagcactgaatagtgaataccatggtgtttggctgttattctttaaaatatatttgttatgcaaatctgaagttatataagaatattttttttctgcattgggattaatcaacatcattactctcttaaacatagataatttattccatagattgtgttttgtgatgtactgttgagacttaaaaattggacttatatgattgtgttttatgatgaatcgttgaccgttgagacttgagaattggatttattggtttgaggggttttgtattctcataatttttcgttaccgtattcgcgttggttcgtttttgctccgttttcggtttcgataatattcgattccgttttcatatccggagtttccggttccgattccgattgcgaaaaaaaatgaaaacgaaaacgataatgatggttttcgtccgtttcagtattgttttcacccctaatcaagagtgatgcagctttactttcataaagtggtaaaaatgaactaaaggtatgataactaggggtgagtgcgagtggatattggctgctcttgggctacaagctaccccctgtagtgaaggaatactattcttgagactccagagagggtaccacttagtatctattatttttcattcagaatcactaaatcaattgaaatatataattgagactttaaaccagggacatgaagatcccagttatcatagtacccacctgtaagactgttatcatggttctgaacctataaaagaaatcatatcatatgaaaaacaacctcattaacagtttggccaagtgttactatacgtgtccgaattcgtattaggtttgtgtcacatctcgtactaggtttgtttttttatgggacagagctggtaattctctatgtaccacagtatccaaagctgaacataaaaactcttggtaattttaaagatatctgagtacctgacggtatttaaagtggtttgatacttatacttggaactttacagtgttgttataaaagtctgcagtttgttaacaagccatagacatattgcttaatgccaaaattatatatctctttgtacagaaacttatcatgcaaccaacttaatgggacaattccatactccctcctcaaaaataatggatcaattgatttcaggtttggatatttttattaacgttggtttctttcagtaatctttaggcaaattagcactgaacaacgattcttttgaacccttcaggactgatagttttatgtaatttcagttatgagactgatggaaatatgtgcaaaacacctgttactccatccctgtcaagaaatagagccgttaccttggctgtttccgtagtggccccagtgctggtactggccatacttgttctcacatatttgatatggagagccaaaagaaagctcaatagtacgtatgctctgttataatagtctgtactgaaaataattgactcttatggtttaataactcaatgtaatattgctaatactttttttttttgcactagcttcttcaactgatcttgccatggtaccagaactcaggggtgctcctggacatatcacaaatcattgggaccatttacaagaacctgaaaatcgccgattcacgtatcaggagctagagaagtttactgataacttcaaacatttaattgggcatggaggcttcgggcatgtgtactacggttgtttagaagacagtactgaggttgctatcaagatgcggtctgaattgtcttcgcatgggcttgatcaatttttagctgaggtgacaaattcagttaccactaagttcaccacagacaaagtcaatattgtcactgtcatataacttaatcacagccacagtgagatttcatacacattagtccctcgtgttctttggtgcaagttcccaactttagtccctcgttttccacactcaagtttcccaaactgctaaacgatgtatttttggcataaaacattatagaaaagttgccttaaaatatattaattaatctattttttaaattttttagataatacctaattaatcacacgctaaacctctgctccgttttgtgtgttgtggggaggggttcccaagccccacaatcgaacacagcctaacagacttaaccttcctcttgcttatagtacaggttcagagcttgaccaaggtgcatcacagaaatcttgtttgtttggttgggtactgctgggagaaggaacatttagcacttgtctacgagtatatgtctagaggcaatctttgtgattatctaagaggtttgtccattgcaaacttcaaagtattgaatgttgcgaaatcatagggaggatagttggacacaagtgagcacctacacatagcgtaaactaacttaatgttctacatgctccctatagatgtacgaagcaatttgcagcacaataactactataagtacttaatacacggaatgaccacagttacaagtgagaacttaattatcactttatttagtaatgtgcctatatgtgtttcttaaaaaataaagataccgatttttgtttagtggcggcatattggcaatctctacataagggaactccatggccttcgttaattaaactcactatagatacgacaacaaatttagttgtcatctttaaggaagtatcttgatcttgtatttccaatcatttgtagaagttttgtcgtcattgttttttttagaactgtcatatttgttcattgtttcattctcaacataattgattcacacatcatgtaaatattttaaacataattgcatatggaataattgttttcaattagttggacatgaaaatccatcttgactgatttttaagacatgaatgcatatgtgatgtacaagcttttttataggtgtaatctacatctgtgctttgctagtccctatgatacaaagtgatatctagtatgattcttagagatcaccgcattaactactttttgttgttaaagggacaatactattttgattatttatgttattgctccccctgccgatgtgtgcacacacacaagagacgagtgttttacaactcccttaattgctatttgaagttgctcgtagaattcctttctaactgtttgtctgtgaatatattaaaagggaaaattggtatgggagaaaatttgaattggaagacacgcgtaagagttgcacttgaagctgcacaaggtattctataatagcaaggcaaaaaaaacaaagcaaaagtgttatggctcatcttttcttctaactatagtttccttatttgtaggcctggattatctccataagggttgcaacttgccaataattcatggggatatgaagacgaacaacattctgttgggtcaaaattttaaagcaaaaatagcagattttggaactcatattgggagccagagttgctgctggatctatgggttatattgactctgagtatgaatctcttctacacactataatcacttatgcaatctctacatatattaacacgggtcaattttaggtactacaccactggtaggctcaccgagagcagcgacgtttacagcttcggcattgttttactagagataacaactggcgagcctcctataatacctgaaaaaggtcacattgttcaacgtgtgaagaaaaagattgtcagtggtaacattagctcagttgcagacgcacatcttggaggtgcctacaatgttagctccatgtggaaagttgttaacatcgccatgatgtgcacaacagatatagctactcaaaggccaaagatggctgacgtggttgttcagctgaaggaaagcctagacttggtggaagttcaaggggacagaggagacaaggaaaacctagcaagtgataccatgtcttcgatgtcgacatttggtccatcggcaagatgattaaataatacatacctagccttggctttcactacattgatggatccctgtgacaagtctataacgatatatacaatgtgcatgcacagcctgtttgttttgttaatgtcaataattgagacagccagtataaaacatagatgtcatggaaggatcatgataggtgtgtatatggcccataatgtatagtttgcatctatctatgtgtgtcaactattactcacattagctccaatattcttctgatactacaactccaattaatccttagcaaagattgtttgcacatttccttattgcttcttatgtcctatttcacataatctatcattagtacttgtatgctccagcactagtacagatctagacatttgtgatgagcgttcgtgctgagctaaggtgactcgtttgtgctgcatattcatatattttagtgattctatacaatattatccttaatcacttggcgctatcattatgtttatcaatatgggctattttttggcactacatcaccgataggcttactgacagcagtgacgttgacagcttcggtgttgttttactagaggtaactatcggtgaacttcccataatacctggaaatggccacatcattcagcacatgatgcagattgtcactggtaacatcacctcagttgccgatgaacgtctaggaggttcctatattttcaactccatgtggaaggttctagatgccatgatgatgtgcataacagatattgcttctcaaaggctaatgatgtccgccgtggtcttgcaattgaaggaaaaccatgaattggaggaagctcatggggatgggttacttggaaaatgtagtaagagataacacatcttcgatgtccatgtttagtccattggtaagatgaaaaaaaccattgatagctcgctttggaacatactgatggctctcttcttcaagtctaaaataaaacaactgatttctctctagacgatttcttctgtgttaagacacaatgatttatatacagtttgtcttcataaacaatgccggtaggatccttaataggtgtgggtattgcaaagcaatagtttgcttcagtgtaacagtaagctgtttgtgagctttctaactatagggtatcattgctcaaataatatgtaacaaagatatcgaaaatgtttacatgtttcgttatcatatccttttctgtgttgatttttacatactcattatgtattttttaaataatagtactgattatggtaattaatgctgattacgggggtggggattgcgcagcgcgagttgagcagctggcgcttgcgcgcccactaggaagccccaggtgaagagtgatcgctgccgcggcttttggcactaggctttggctgatgcaggccatggacaccatagtcaagcacaaacttttgtccacatgtccgaccgaagcttagatggaaaagcatttcagggagatgcaggggaagcattgcttggactgcatcaacaacggcaagctcctgctgatgttggacgagcccaccggagtcttgcttcttctggcctacgcctcatcgccgtctcacggcagtccaagattctgctcccaccgctgcgactgccgaccaaatatgtgggagcgtttggggtgccacgaaaaaaaatatgtggagta

SEQ ID NO: 17676 - DNA, 4895 bp, Oryza sativa
  unsure (1)..(4895): unsure at all n locations
nnnnnnnnnnnnnnnnnnnnnnnnnnnnnnnnnnnnncaaaatcaacttccatacaagttcaccttccgaaaatgccttgggcaccactctcttgttgtaatgccgagcaactcgttccttatccttggtaacctttgcaagggccctcaatctggactgaaccaactcttccctttcatctgccatgaggttataatactcatcggctgttaaatcattttgcaactacgttctccttgagccgattctaatctcccatggtaaaacagcctcatgtccataaacaagcttataaggagggacttggatcgatccatgacaagccatccgataagaccacaatgcttcggccaaacgagtatgccactgccgaggataatcagaaatctttcttttaattaatttgatcaagctcttgttagatgcctcggcctgcccattagcttgtgcataatatggtgaagaattcaacaatttgatacccatgctataggcaaactaaacaaattcatcggacacaaaaattgaaccttgatcagttgtaatggtttgaggaataccaaatcgatagattatatgttcttgaacaaattgtatagcatccccagaatcaaccttcttcgaaggaatcgcttctacccacttgctaaaataatcagtcgccaccaatataaacttatgccctttactcaatggtggattaatcatgccgattatatcaattccccaacctctaaatggccatggcttaatgatgggattcatagccgacgccgatgccctctggatcgccccaaatttcttacaatcttgacatcccttgtaatttttgaaacaatccttcagcatcgtcggccaaaaatactctgcacgtcaaagcaaccacttcatcttatgagccgattgatgagtaccacaaattccttcatgaacttctccgatggcaaccttagcctgatcagcactcacacacttaagtaacaccccatcaatcgtccgataatagagctcatcatccaataaagtatacttcaacgctttatatcttaatctccgagaagccgactgagatggattctgtaaatattgatgcacatcatatctccaatcatcggctgttattgcagcaacttcaaccttaacatctttgatcatcggcttataccctgatgccccttgggccaaatcattagcttcaatattctgctctcgagatacatgcctcaaggtaaccagccaaaattccatcattagttcttggcacttctcattataaaccattaatgtatcatttttgcactcatattctcctgccaattgactgattactagcaaagaatcccccataatttcgatagcatcggcttcaacttccttgagtaactgcaaccctttaagaactgcctcatattcagcttgattattggtcgcataaggtttaatagtgtaagcaaactcaaaacatgccccacgaggggaaattataactaagccgataccacaaccatgagtatatactgatccatcaaagaaaaaagtccatggcacgatctcaattgagccgattaaatcatcacgatgatcaacaatgaaatcggctatagcttgccctttgatcgccttcggtgactcataccgaagatcgaactcagttaaggaaaatatccactttccaacccttcctttcaaaattggagccgataacatgtatttaacaacatcggctttgcatatgacagtgcattcgttggacaatagataatgccttaaccttgtacatgaaaaatataagcacaagcacaacttctccacaggggaatatctagtctctgcatccaagagccgacgactcaagtagaatacaactctatctttcccttcgagctcctgaatcatgaccgagccgattgacttctcaccggccgacagatataacctaaaaggtatccccttctgtgggggaatcaaaactagaggagagctaagatattccttaatactgtccaacgctttctgttgctctgccccccaagtaaactgttgatcggctttcaacctcaataatggtgtaaaaggctctaacattccagacaaattaaaaataaaccttctcacaaaatttatcttgccgatcatctcctgcaactctgtcttgttctttggagactgaatcttcttgattgcattaacactcctttgagttatctcaattcccctctcatgaacaagaaatcccaaaaactggccagccgatacgccgaaagcacactttgttgggttcattttcaagccatatttcctggttctctcaaaaaccttcctcagatcagctatatggtcctctatctttttagacttaacaaccacatcatcaatgtagaccccaaccaaccagcagatcagatcatgatatatataattcatggctctttgatatgtagccccagcatttttcaaaccaaaagacattacaacccagtcaaataagccaattgtaccaggacacataaaagctatcttatgaatatcttcttcggccataaagatctgattgtaccctgcattaccatccataaaactcaaaatcttgtgtcctgaggcagcatcaaccagttgatcggctactggctttggatattcatcctttggggtagctttgttcaaatctctgaaatcaatgcataccctcaccttgctgtttttcttgataacaggaactatactagaaacccactcggtatatcggcaaggacgaataaaaccagcatcatataaacgtttaatctcagctttgacaggttcgagcatatcggctttgcatcttctcggaggttgttggtgtggcctgacccctggtttgataggtagccgatgttcaacaatcgatcggctgagtccgggcatctcataatactcccaagcgaagcaatctctgaattcctttaatagctctatcaacttggttctgaattccgaagataaattcttactaataaatgtcggccttggtcgatcaactggacctatatcaatctcttccaaatcatcggccgacatgaaaccctgtccttgtttgtcatcgagattttctactgtgtccttggtgtagacatttgaaccctccacgacgccctcaaaataataggttgggttctccatctacaattggttgtatatcaaaatcggacacttttagaaaatctccatcccaaacttttccagataaacaatcaagaccatccatctcccaaagagctaaatctgcactggcaacattgactgacctgtcggctggcacaatttcaatcttgtcgccttgccactgaatcaagcattgatgcatggttgaaggaatacaacaattggcatgaatccaatccattccaagcaacaagctgtaggaacccttcccatcgatgacaaagaacgttgtaggtatagttttactgccgacggttagttccacattcaaaactcctttggtttctgatggattgccaccaaaatccttgagcaccatgtttgtcttgatgagatcttcagtgtttctgcccaacttcctgaatgtagcataaggcatagaattcactgcagccccaccatcgaccatcatcttggacatcggcttcccattgacctagccatttatatacaatggtttaagatgccgattctctgttccttccggcttttcgaagactgcttgctctggtgacaaaatcaatttagccggttcttcttcaacttcgtcaacatgggcttgcttgaccccaaattcagtaggcaacgtgaaaaccatgttaaccgatgtagttacaaaacttttccctttagccaatctctttgcttcatcggctacaggagcttgattcttaacgcgccactcctgcttcggctttgttttttcagtcgatgattgatttcttgctcaacctcctaaaatcattctctgttcctcaacctctgaacacttctcttttgattctttgtaaagataccagaaggacaccattgattctgcatgtcttcattgtcctcttggttataatcttggttcaccgggcccaacctttgatgaacaggaactcttgtttgctttagccgattgcttctattacacgatcggcttgaactttctacaacattaccgcacccaggacagtcctcgatagatggcagcctcttgcccaattcttcagccgatgggattgtatgaccagcaggaagttgaatctgtttctctcggagtaacaaatcaaaaatcttatcagccttggtaatatcaaagtcatacctctccacttttccagaattctttacccattggcatggtataacctttttgcttctcacccattctatctcagagtcatcatcatcatcatcatccgatccatatatgtaaggacagacatgattaacctttttaaagttcttcctgacttctgcaaacctctgttcatgcaaggttaccttctgtccaagatgtgacaggctatcaaagtcttgagacgagaatttctccttgatcggagcaatcataccctgaaaagccaaatcggctaactgggcatcaattaaactcaagctgtagcacttgctcctcatctctctaaatctctgaatatactcatgcacaggctcatcatatctctgcttgatcgctgttaaatcggacaatttcaactcatgaatctcactgtagaaatagctatgaaaatgcttctccaaatcggcccaactgttgattgatccacatggcaaagaagaaagccaagtgaaagccgatccagacaatgacaaccggaacaacctaaccctcaaagatccatgataaaaatcggctaacgcgttcataagttgacatactatcctggcctgagaatattgaaaa

SEQ ID NO: 17677 - DNA, 1045 bp, Oryza sativa
ctgggtactgatggtgcagctgcagacggaagtggtacagacattcatgaagaaggagatgaagaagagcatgacatgtttgtcccatctccattgggcggtgaaatggttgatgtggaccctgatatgctgcaagatatgttacgtgacgttgatgacccagctatgaacgagagagattccatgaagttcagcaggttggttagtgactcggagactcctcctatacgtaggatgcaagccaaaacacaccaaattatcagcaacattagacctaatgaagttgaaggctagtaatggatgatcaaacaagagttttacagaacttttgggaatactgaaggacatgcttctcagaagaacacattgcccgagacgacatatgaagcaaaacagtttctgtgtcccctagggttagaggtccggagaattcacgcatgtccaaacgattgcatattgtaccacaagcaatacgcggacttagatgcttgtcgtgtctgcaaggattctcgatacaagcgaaagaagagcgcgggcgagggaaagaagtcaaagtggggtggtccagcgaaggttgtgtggtatctaccaatcattgatcgtttcaagagaatatttgccaaccccaatgaagcaaagttagtacgttggcatgccacagagagaaggaatgacggtttgctaagagaccctgcggattcgattcaatggaggaatatcgatcgaaagcacaaagactttgctgccgaccccagaaacatgatgatatgtttgtgtacggatggcatgaatcctttcggagacatgagcagttctcacagcacttggccagttctcattgcgaactttaacctccagccatggttgtgcttcaaaagaaaatatattatgttgtgcttgttaatccaaggtccgagacaacccggcaatgacatcaatttgttcttggagcctgttatcgatgaccttgagattctgtggaaagtgggtgtggaaacttgggatgcatatggtcaggagaacttcacactacgagttctattgt

SEQ ID NO: 17678 - DNA, 381 bp, Oryza sativa
  unsure (1)..(381): unsure at all n locations
agggcgaattcgagctcggtacccggaggagatctatatggatcaaccagacgggtatgtattagaaggtcagaagggaatggtatgtaaactgttgaaatccttgtatggcctcaagcaagcacctaagcaatggcatgagaagtttgacatacaagaaatccagcctgaccaagtacttcgacccgatatgggtgggcagcgagtagcagttgcgctgacccttggcagatgggaagctcctgaccgtgtggagagtacgtgtgtcagggccccaccagcgattgcggtatacggtggtcaccttctgattctcgccgccgtcgatgtacgggccgtctgggnnnnnnnnnnnnnnnnnnnnnnnnnnnnnnnnnnnnn

SEQ ID NO: 17679 - DNA, 682 bp, Oryza sativa
  unsure (1)..(682): unsure at all n locations
nnnnnnnnnnnnnnnnnnnnnnnnnnnnnnnnnnnnnnnnnncttcctaggtgtatataggaagtcaaaagatacacatgaagcacgtaatgatctcaagcatatggaacaacgcggtggccatcatccggaacaaaagaagaaaggaagccattacttgagtaaggaagagaacgaaagtatgtttgaatgcctagagagcgtcaaggtaccgtctagatactcctcgactacaatgagaataataagtatgaaggagaagaagttcacaaaactgagcagctcacgcaaaaaattgctagtagcctagtatagccctgaccatgtacaaccttgctacgtagctttgtcagaagtgaaagtaaattttattgcccatccataaagaaggcccatcaacccgcggggggaggggggatggatctgctgccctcgaactccgcccaatgccgtcgtcaccctctcggggccaggggtggctgatccgccctcccgagggtggcgccgtcggatccgctgtcgccacccaatgtcgtggtcacctcttatgtggccaagggtggcagatccgcccctcccgaggatggcacggccagatccgtcggcctcgagctcatcactccggccagatcccatagcctaggacaccgccgttgtcgcccgataccatcaccgccgctcc

SEQ ID NO: 17680 - DNA, 262 bp, Oryza sativa
atacacatcaagcacgtaatgatctcaagcatatggatcaaggcggtgcccatcatcaggaacaaaaaaagaaaggaagccattacttgagtaagtaagagaacaaaagtatgtttgaatgcctagagagcgtcaaggttccgtcaagatactcttagactacattgagaataataagtatgaaggagaagaagttcacaaaactgaccagctcacgcaaaaatttgctagtagccaaaaatagccctgtccatgacaacct

SEQ ID NO: 17681 - DNA, 994 bp, Oryza sativa
ggcatgaggcagattgagacaatcaagaagaacggaggatggaggcaagcaaatccgagggacaaaccttgcaaatggcgactgttgttgcctccagaacccgacatcgagtcgctgggtccgggagcagctgagccatagccaccagcaggagaagcgtcgccgcctagagagtccgagccaccgcgaaggttggtggcgccgttgacgctgactccgggaacagctaagtcttcgacgcaggcaacaaagtagagccaccgacgacggcgttgaagggttttggacgacacggttaggcggacatgggagcaatggaaccctagtgttgacgtacaaaggaagctggcatatatcagatatatagcttgcatcataacttattttgttttataatcgcttctgttactgaattgttattcaattctttttgcgtgctacaaggcaagatgacacttgggggcaaacctccctcatagcctcctaggttgatggggtgaccacctacggtgcatgtctcgtggcattactccacatattttttttcgtggcaccccaaacgctcccacatatttggtcggcagtcgcagcggtgggagcagaatcttggactgccgtgagacggcgatgaggcgtaggccagaagaagcaagactccggtgggctcgtcaacatcagcaggagcttgccgttgttgatgcagtccaagcaatgcttcccctgcatctccctgaaatgcttttccatctaagcttcggtcggacatgtggacaaaagtttgggcttgactatggtgtccatggcctgcataagccaaagctatgccaaaagccgccgcagcgatcactcttcaccttggggcttctagtgggcgcgcaagcgccagctgctcaactcgcgctgcgcaaatcccacccccgtaatcagcatttatttacaataatcagtactattatttaaaaaaatacataatgaggtttgtaaaatcaacaca

SEQ ID NO: 17682 - DNA, 451 bp, Oryza sativa
  unsure (1)..(451): unsure at all n locations
agcatgaagaagaaggccatgttcaaaaagtccaacgaccaatctacttcgttagcgaggttttggcccgactccaagacaagatatcctcaggttcaaaagttattatatggtatcttaattaccgttaggaaattatctcactacttccaaggtcactcggtcacggtggtcacatcgttcccactcggggatatacttcgtaatcgcgaagcaaatggacgaatcgcaaagtgggccttagaattgatgtccctggatatatccttcaagccacgaacttcgattaagtccaagctttagccgactttgtcgccaagtggaccgagtgccaagaagacatgcccgaggagaagatggagtattggaccatgcattttgatgggtcgnnnnnnnnnnnnnnnnnnnnnnnnnnnnnnnnnnnnnnnnnnnnnnnnnnnnnnnnnnnnnn

SEQ ID NO: 17683 - DNA, 405 bp, Oryza sativa
ggcaaaacggaaggttttcaggacaaacctacaaagaggtgtcgcactctcgcagcgacggcagacggtttacggcgcaaaccgacaaagatggactaaaactggggtaaaatagaaaacatagtaaaagaacgattcaagtagattgtatttggggttttacaatgaaccggccttgtcccttaaataggggttggtcttgccctatacaggcccttctccacgtccaactcgggatagaaactaaagaaaacacgaaacatgccttcccgagcaaggaaacccgagacccgacgaaaatagactcggactcggaccctgccggtctgaccgcccacatacctacggtcagaccagccctactagccggtcagaccgcccactacggggatcctctagagtcga

SEQ ID NO: 17684 - DNA, 556 bp, Oryza sativa
  unsure (1)..(556): unsure at all n locations
nnnnnnnnnnnnnnnnnnnnnnnnnnnnnnnnnnnnnnnnnnnnnnnncgggcggcaaccaggcgagaaccaccactagcctcttcccttcctcctctccacctcgccgccacctaagtaatcaccggcgaagtcgagcgggtgcaaggatggcagcggcggggctcccgaactcctctcacgggtgtggcgcactggggtgctaccaagaccgaagggattaccccaagtggcggtcgtcggtggccagattaggtgttgttttggctggattcggtccccacacgaccggatctgatgccccagctagtggatccaaacggtggcaatgaggaggatgcacggtggtccaacaaggaggtgtggagaagctggggtcgcgcgatggccgaggtgatggagcagcatggaagcgtcgacggagtgcgtgcaagggtgcagcctaggcaacgacgcttgttgtgggagttaccgaccttccaatcgtcattacaaggctataaatagagaagagaagatcttcccacacacacttaagaagcatatcttaggctac

SEQ ID NO: 17685 - DNA, 649 bp, Oryza sativa
gagattgcataagtgattatagtgtgtagaagagattcatactcagagtcaatataacccataatccagctgcaacggctgaaatatgagttccaaaatctgctatttttgctttaaaattttgacccaacaaaatgtggttcgccttcatatccccatgaattattggcaagttgcaacccttatggagataatccaagcctacaaataaggaaactattgttagaagaaaagatgagccctaacacttttgctttgttttttttggcctgctattatagaataccttgtgcagctttaagtgcaactcttacgcgtgtctttcaattcaaattttctcccataccaattttcccttttaatatattcacagacaaacagtttgaaaggaattctacgagcaactttaaatagcaattaagggagttgtaaaacactcgtctcttgtgtgtgtgcacacatcggcagggggagcaataacataaataatcaaaatagtttgggcctttaacaacaaaaagtagttaatgcggtgatcctcaaagatcatactagatatcactttgtttcataggggactagcaaagcacagatgttaattacacctattaaaaaagctgtgcatcacatatgcattcatgttttaaaa

SEQ ID NO: 17686 - DNA, 1016 bp, Oryza sativa
  unsure (1)..(1016): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggggtgggggcgccacggacgatcgatcgcccgttagccaacaccgccacctcttcctctacccggccccttccacgtctctgcgcctgctacccctcacgctcccagttggctatggaggagcttcacgttcggatccagctttgcccccaactaaaccagcacttggacgaccacattgagcagaacatcccacaagatcacaaccataagaggctatcttcattctaagcatttttcgaacgattcttccttctaaacattaatcaactgcatctctgcaagcaaatatcaaccctcaaggacaatcgaactcctgaccgccttgactggcctttccctaaataagtaatatgggactattcccaacagccgagcagagcgaccgtcccggcgcacggcgccgatgacggcggctggcatccctactcaccagaggtttgctgccaccccgaacgcggagccgcttggcagcctgcagggagcatgatgcatgggtggcagcggagaggtggaattgtcggaaattgactgccgccgcgagtcgatcgctcgatcgatatggataggggctcagttttttctaagtacaaaactgcccccttgctaatggggggattactctgttaatccacttttaatatccacccattgatgtgctttaatttccgtgcaggtttttatttgagaagcatagtatcacttcccttccctattttcttttagggtgcacaaaaaaaacaggaagaacaaccccacaatctggaaannnnnnnnnnnnnnnnnnnnnnnnnnnnnnnnnnnnnn

SEQ ID NO: 17687 - DNA, 711 bp, Oryza sativa
  unsure (1)..(711): unsure at all n locations
nnnnnnnnnnnnnnnnnnnnnnnnnnnnnnnnnnnnnnnnnnnntaagctgattaggagttggcccattccttgttgtctagctaagctcattggatgatagaactcataagagacttggatgtttttcccctgatggatgcgacagaaagcatgcatgggctgattgcagctgagaaaacttccctggacttttggtatctttcatgattgatatcttcaaatctaaagtccgatgggagctcaaggtttgctgaatcttcataaggaaaccaaactcgaacatctttttgaaagccatcatagaaactgcagaaccagtccttgagcagttcagccgataattttgctccggcatcggttggtgtggatgcatattctccatatgacatgcatctgcgatagtgcgctcttctccatcatcttctacaatcggctccagtcttgggaattcggcttctgtcaaagatggccgattgacaactttcatgaccatcagatttaacgaagtctgcaatagccaccatggtccacctgctccaactactgatctgatagctatcttagctgatgcattattcaacatttggtatagatagccgagaaggattttgcctagaggaaattgctttttcgattctagggcttcggctacaaattaccaattggttgtaggaaaaaaactggatcacagaagaggaacttctctagc

SEQ ID NO: 17688 - DNA, 1320 bp, Oryza sativa
  unsure (1)..(1320): unsure at all n locations
aatacaaagttattgtatcatgtgcatcttgagatgtatttgatttttcttcatttcgtacatttgggctgaggcatttcttttttttttgggtgatttttgacatctgtgacgggtgagaactaaaaccagtcacagctgtttcgtcacctttgacgggttgcaaagagtcatccgtcacatgtgtgagtcacctgtgacggctatattttttagcccgtcaaaggttttaattaccagtgacgggctttcacccgtcaaaagtgaggtgtagtcatcagtgaccacttgtctctgaccagaaccaaatccgtcaaaggtgagggttagagcccgtcacagataactggatccggcctagtgatcgcacgagctccatagttttgttttcttaaaaaaatcaataccatctaggtatttactaattcagactgcaattgttaaatcatccaaacatgacaattgagcttccgaggacaacacaatatgtattaatttaaacttcaaattattaaatcataaaaaactaattattactccacaccaacaagaaatctatagttgatattatattattactttttcatattttttaaatttggatttattaaatcaaaatggcatatataatgattcaaacgaagtgcaactacagtttcacaccaaaaaccgggactactttcaaattgaatctatttttgaatcagtgtgcatttaggatccttttttgtctgtatgaattaaaatcattttattttcttttgtaaaaatcagtatcgctgctggtcgtctcccaaacatagctggtaatgtggaaccgcgagtaatgcccagtttgtagtgcgttgtttagctaaattaataaaatcagaaaatagcttcaagtgatatattggttaacgtacaactgactaactgagctgcaaaatgtacaagatccaaggaaattaagaacatatataccttactaaattgtcatcgtcagggctagatcccacgttgctccgaacatagagggagagtgacacattgcccatgacagccgggtagggcaagataccgagaggcctcaactccaccgtggacacgaacggcgtgccctggccgatgttgatgaggcaaaccggcgcctagctcgcccatgccacgaacaccgcttcgtgaacattataaccatcatttccgtcggtggtgtctatactcacggtgtcccagtgtttcacaccaagggtaaggttgaaaattagcgatgggttgtccatgccgtcgtagttgccannnnnnnnnnnnnnnnnnnnnnnnnnnnnnnnnnnnnnnnnn

SEQ ID NO: 17689 - DNA, 539 bp, Oryza sativa
  unsure (1)..(539): unsure at all n locations
nnnnnnnnnnnnnnnnnnnnnnnnnnnnnnnnnnnnnnnnnnncatgagtatattcagagatttagagagatgaggagcaagtgctacagcttgagtttaattgatgcccagttagccgatttggcttttcagggtatgattgctccgatcaaggagaaattctcgtctcaagactttgatagcctgtcacatcttggacagaaggtaaccttgcatgaacagaggtttgcagaagtcaggaagaactttaaaaaggttaatcatgtctgtccttacatatatggatcggatgatgatgatgatgatgactctgagatagaatgggtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17690 - DNA, 1044 bp, Oryza sativa
tcaattttcatttctttttatcttcattttttggataacccactttaagaagcatcttttaaatgctttgatgtctgtaagccaggatgaaaatataagtgggttggtcctacaacctggcatggggtaaaggcatcaattataaattatctcgctccaattaagtaagaaaaattaaaatagatgtggtagtatttgctttgcaaattaccactaaactagagcatcatgtaataattatatgtttctagattgttctatgttatgtgtcacaaattcacgatgtactgtagcaagttttacaaaaaaaaaatggatatagtcttttaattcatatctgtaattggcttatatattgctgaggccacatcatgcttgtttcatacttaagattccttggtgcaaccaacacgctcagtacaatcaatcagtatgctgttcaactagccacgtgacttcatatattatatatataatttagatgctatgatcacttgagattattgtttatctcctaaaatgatcatttattgataaaagcttcaatatcaaaatgtatggttaaatagctcctatatacaagctgagaaaaagttgatagaaagtcgttagatgtctaacggggtataagtaatgggtctacccgttttataaaagataagctgggatattttgatttttggtgagaaaatttagtattttcttttatttagggttaaatttgctaagcgacatctaaaaaacgtgttattgggcggggacacagcaagaacgtgtttttggtgtaggacacccaaaaaactggttattagctacccccccgttaaaaccctttttttttttttaaaaaaaaaatttttttggggggccccccggcggataaataatggatgaagggaaaactagcatgggtggaaccatgaattgggcaacacgcgttagagttatgcttggagctgccccaggtatgcttccaatagaagacaatggcaaatacgcaaagaaagaatctatgctatgccactgaattatcccactttaaca

SEQ ID NO: 17691 - DNA, 2738 bp, Oryza sativa
  unsure (1)..(2738): unsure at all n locations
nnnnnnnnnnnnnnnnnnnnnnnnnnnnnnnnnnnnnnnnnnnnctgttctcgcttcctcgcttctgatctcttgcgagcacgagagattggaaggagcagtgcctccgaaaccacaccttcacctgagatctgcaccgggtaggcggatgatcaggttttttgggagtgcctcccgcacgactgctcgccatgtctggagttgccgccgccgctgctggaggaaatggcggaggtggtgcgccgccgccaggagctggagccggtggcgcgaacaacaacatcaacggaggcaattctgcctcataatccagcggagggccattctcggggtatatcattctcctgttcctgttcccactgttagcgctttactgctatgtgcgctatgttcctgttcctgatattcatgatgcctctagcatgttattgcgttgctgtaatgttcctgttcttcacattcatgatgcgcatagtatgctactggttatgttaagatcaacctacactgcttatgccatgattattgctttaacattttggattaaaatatgccgattcttgaccatatttccaacaatccaaaaacctgataggtcattttcggtagttggctttgctgctgcactgaaaccacatgcttttgatggttctaactataagagatggaaagcccgtgcactattgtggttgacagcgatgcagtgcttctatgtttcacgtggcaaatgaagtgaaccacctctttctcctgaggaagaggctaagttcgaggcatcggattgtctgttccgtggagcattgatcagtgtactcgctgacaatatagtggacgtgtacatgcacatgccttctgggaaggacatgtgggatgcacttgaggccaagttcggagtttctaacgccggcagtgagctgtatgtcatggagcagttctatgactacaagatggtcgatgaccgttctgtagtagaacaagctcatgagattcagatgctagctaaggaacttgagaacaacaactgttagttgccggacaagtttgtggcgggtggcattattgccaaattgccaccttcttggtcggactttgccacttctctaaagcacaagagacaagagttcagtgtttctgatctcattggctctttgggtgttgaggagaaggcgagggcaacggacatccgggaaaaaaaggttgagggaggttctagtgccaatatggtacagaaaaagaaccctcatgcatcctacaacaacaagaaagtcaagcctgatgtcaaacccaaggctgcaaccaactttaagaagaaaggcaagggaaaagcaaagggagactgctttgtgtgtggcaagtctgggcattgggccaaggactgtcctgagcgcaaagacaggaagtctgccaacatggtcattggcgagggcggaggaacatcggggtacggtaaaatattacctacagttctctctgtttttcactcacctgattggtgggtggacactggtgctaatattcatgtatgtgctgacatttctctgttttcttcttatcaggtcgggagaggttcctccatgttgatgggaaacgggtcgcttgcggctgttcatggtattggtacgggcgatcagaagtttacttcgggaaagaccgtgcagctgaagaacgtgcagcatgtcccttcaataaagaagaatcttgttagcggctctctactttgtagagaaggttttagacttgtgtttgagtccaataaatgtgtcgtatctaaatatgggacttttgttagaaaaggttatgacagcggaggcttgttccgcttttctttgaatgacatgtgtaataatcataatgttgtgaaccatattagcgagaatgatgagtctaatgtgtggcattcgcgactctgtcatgtgaatttcagttgtatgacgcgcttagctaacatgagtttaattccaaaattcactttgatcaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattacactagattttgttatgtgtatatattgaaaagaaaggatgaagcattgcattactttaaaatctataaagctgaggtagaaaaccaacttgaaaggaaaatcaaacggttgaggtctgatagaggtgaggagtatttttctaatgagtttgcatccttttgcgaagagtttggaattatttatgagaggatgcctccctattcaccccaatcaaatggggtggccgaaagaaagaaccgtactctaactgagatggtgaatgccatgttagagactgcggggctttccaaggaatggtggggtgaggcagttttgactgcgtgtcatgtcctgaataaaatttcaatgaagcataaggaagtaacaccattcgaggaatgggaaaggaagaaattaaatctctcatacctacgaacatggggctgtttggccaaggtaaatgtacctatagccaaaaagcggaaacttggaccaaatactgttgattgtgtgttccttggttatgctattcacagtgtgggttatagattcttaatagtaaactctggagnnnnnnnnnnnnnnnnnnnnnnnnnnnnnnnnnnnnnn

SEQ ID NO: 17692 - DNA, 2132 bp, Oryza sativa
  unsure (1)..(2132): unsure at all n locations
nnnnnnnnnnnnnnnnnnnnnnnnnnnnnnnnnnnnnnnnnnnnnnnnnnnnnnnnnnntaaaaaaccaggactacagagggttatcaaccgggactataaaccctttctccaccagttatttatataaataaatttttccaactttgtttttttattttttaaaaaatttatggtgtagtaggaagagaagaagggaggaggatggaggggggggagaggagtgtacaggggatggggatcgatcgcccattagccacagccgttgttgatcacaccggctatactccatctatctattaaggctcgatttatcatgcatggtcattaaaattctacttttgactttattagttcctcacatgatatgtttttctaagtactttaacgcactactatagatagggtttttccatacggctgagaaccatctttccatctttccatgacatcatttttgcatgcggacctcttaagagacccgtatgggaaaatcgatttttccatacgggcttcttaaggagctgtttgcgaaaatgccgcgcgatttttgcaggcgccactagttatggtccgtttgcaaaaatcatggggtctcgcacagaaaaatcacttttgtagtagtgcgttgatatgttttaattttgaacagcctttcactactgcaaagagcattttttttcaaatagtcaaaaatgtattttcgcatgcagatccgtggcctgcctgtaactgaacgatcataaaaattcgacattttttttaggctgttaagcacatgcatgcatgtgaaaatcgtttttgacgcgcatgccaaaataaaacactagatcctacaatatataggctccaattcagaaatttacaatacaattctacaatcaatcatcggtgccgaatcagtcgatttagcactgctttccgattcatcaagaagcaggaaactaaccaaaaacttacagccgaggattctcaagggcctcaaggcctgagaaggtgagcgcgcgccatcgttaattgaagctgcacccgcacaaaacaaaacttcagcaatcctcgcagcgcaataattaatagcactggagatctacggtgaatcggcgaggtcgtcgtcaaatttaagtaattattaattattttcctatcatttgatttattgttaaatatgctttcatgtatatatataattttacatatttcataaatttttttaataaaacgaatgatcaaacatgtgcttaaaaagtgtcaaacatttagaaacggagggaatatttacatgtaaacttatagatttgtatttaatgagttttatagttacataaaaggttagatttccacgcatgagcagccacgatttctgcagcctctctctgccataatctcgcttttgtaccggtcccacgcctctcgccgtacgtcccaatttgtacttatcaaatcccagattacattactttgtatacttctctggatcacaaataatcagtactgcacatatttacgcaatatatagtttgaaatatgctaacatatattgtcaacttcttctcaaaaagttattgtttgatataggagctagactagtcgtcgactagctactagctagctagcgatcgacaagcggaaaattgattttacccgagcaacaaaaagaaggaagagaaaagccagccatatatttatatctttcgtattttcttagcagcaaaagcacacgactgtgtgcacgtgcacgtcgtcgtcgttacgcggaggaggctcatctaacttatactatagcttcctctaacttcagttggtgagagatatgtgtcgcttatatgtgaacccataaaaataggttctacctgttagggatctatgtctctgtaatttaaaagtcagatgagttcctttcgcattacgcccaacggtcctttccgaaggagcacaatttgtcaatttgctagagtcagttaaaacccgtacggaaggtcattaataacctacgtttacatatgatgtacgcagctgagaaaaaaaaacaaataattcattcattcggtgctccacagggttattactcttgtaatacgtaatttaatactactcttacatttagaaatggagagtttatgtgtgtgtatatat

SEQ ID NO: 17693 - DNA, 2009 bp, Oryza sativa
ccaccgaagcgcagtatctcaaccgcccgagccaggcgcaagtcgtagcgggcgccagatccatcactactggccgctccacagtcgtcaccagccctggatctgttgcctcctccgcccaccgtagtcgccggcgccggattgacagccggcagtccatgcaggcgcgagatcgactgctccaccacctgttgtcggcgccaacgctggatccgccagccccgccgtttgcgcaagggaggggcgcccttggcccaaaaccccccgggggggaaaaaaaaaatttaaccctccgggaccaattggagcacggttccgcccctacccccgtggcggttagggggggagggttgcctcgtcgtcgttgtcggcgttggcagtcagaaggggatgtcggtggcgccgctgcccgcgttgccgcccactcgctggatccactgtcccaattgcgcgcccgccgtcgccgtagctgcagccgctccctagggtgacgaatctgaccttcccgagggaggcgccgcctgatccgccgcccttgctcccggctgccggcacccactctcatagagggagagggagaggacaaaataaaaagagagggagaggagaggtgagagagaggggggagagtgatataatagaaggggtgagagtggagatgggttggaaaaaatttgatgtattgggagcgaaaagagggtgtagggagatgaaaaaaattagggttgtatttttgtatgcggacctcttaaggggctgcatgtaaaaatatgagaaatttgaatcgaattttatggtactaaatcaacttatgtgaaaaagttatcaaaaacaaagttgtagaactcattgagatctacctttttcttctggtcatctctccatccaagtttgattgaactatataaaatttaaatattaaaatataagatattcaaataatttttcgggtagtaaatgattttaaatgaacaaattgttaacaacaaagttgtataacttatcaagatctacaacttttgttttgatcattttgctatttgactttgtttcaaatataatttgtttttggggaaaaaaatttttttttcccccgggggaaaaaattttaaattatgataacctcagacaacattttgaagtactaaacgatttcaactaaaaaagtcgtgaagaacaaagttgtatataactcatcgagatatataacttttattttggtcatttcttcatctgacaaagtgatagtaacattattcataaaatttacacatctcttatatagttttataaaataaaagaaagatatgtaatttttgggaaaatattactatcactttgttggatgaagaaatgaccaaaacaaaagttatagatcatgatgagttatacaactttgctgttgatgaccttttcagctgaagttatttactacttcaaaatattatttaaaattttgaaattcaaatttttaattgacaaaacaaagttacaagaaaaaatggccaaaataatagcagaaagaacacaatgacatgatagagcatgattttggaaacatttagaaaaaatgatcatccaatttggagttcatgagtgagataaactggtttcaattttttaaattttatatgcaggctcttaagtggcccgtatggaaaaatttattttttcatacgggcgtgttaagtagccgtatgcgaaaatgccgctcgatttttttcagacgcggcaagttatgttccgtttgtaaaaattatagggtcttgtatagaaaaatcgtctgtgtagtagtggctgtagtcgtgttagaagcagcggttcgagcggacagccagacacaggtcaccttgatttttctgttctgttgtccctttcactgcaaaactcttactatctaattttacaaggcatgatcttaaaaaaaaatggtctacacatatacacataataaatgagtaaatttcataaaactatagatattttttttgaaagaaagataaaatata

SEQ ID NO: 17694 - DNA, 1073 bp, Oryza sativa
ttcgagctcggtaccccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacggggacctatagtatcgacctccaggcataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttg

SEQ ID NO: 17695 - DNA, 1799 bp, Oryza sativa
  unsure (1)..(1799): unsure at all n locations
nnnnnnnnnnnnnnnnnnnnnnnnnnnnnnnnnnnnnnnnnnnnnnnnnnnnnnnnnnnnnnnnnnnnnnnnnnnnnnnntaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcaggtttcctttatctcgtcgaagctttgccacacaccagaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccg

SEQ ID NO: 17696 - DNA, 1527 bp, Oryza sativa
  unsure (1)..(1527): unsure at all n locations
cgcatcacaaatcacagatctaacaaatcacagccattcacatcacattaagaaggaaaaaaagaaaaaaaaggtaaaatatcccatgccggccaccgccggggcgggggccgcctgccaccgcctccgcgcctccgccgcctgccctccgcgcgggcagccgccgccgccgggccctccgcgcggggcagccgctgccggcagccctccgtacctccgccgcctgccgccgccaggacggccctccgcgccggccgccgccaagaagacaggggagaggggaaggggaggaggagaaggaggaagaggagaaggactgaggaggagaactagtggaggggcagaaaagctaaggataagactgaggagggacagacagatcgacgcgccaagagataaacatcgcgccggcttggggtgatttttagtcccggttggtataatcaatcgggactaaaaatctatctgtagtcctggttgtttataccaactgcgactaaaaataatagggacctgacacgacctgacaacttcttcaaccgggactaaaaatgatctttgtcctggttggtaacaccaaccgagactaaagatcaaaaaatacccctcagcttttaaaccgggactaaagatgttttttagtcccggtttttattggaactgggactattgtggaatttggccgaccgaccaataatggtttctccaccgccggggcggccctccgcgccggggcagccctccgcgccggccgccgccaagaagacaggggagaggggaaggggaggaggagaaggaggaagaggagaaggactgaggaggagaactagtggaggggaagaaaagctaaggataagactgagtagggacagacagatcgacgcgccaagagataaacatcgcgccggcttggggtgatttttagtcccggttggtataatcaatcgggactaaaaatctatctgtagtcccggttgtttataccaactgcgactaaaaataatagggagctgacacgacctgacaacttcttcaaccgggactaaaaatgatctttgtcccggttggtaacaccaaccgagactaaagatcaaaaaatacccctcagcttttaaaccgggactaaagatgctttttattcccggtttttattggaactgggactattgtggaatttggccgaccgaccaatgatggtttctccaccagtgaatactatatataaaaaatatttaaatttaaatttaaatttgaaacgggtatgtaaacttttgacttataaacttttggtctataaactaatatttgaattcaaaatcaaatttgaatcgggtatgtaaactttttgacttataaactttgggtctataaactttatgtgtataaactttatgtgtataaactttagatgtataggaatactatatataaaaatatttgaattcaaattcaaatttgaatnnnnnnnnnnnnnnnnnnnnnnnnnnnnnnnnnnnnnnnnnnnnnnnnnnnnnnnnnnnnnnnnnn

SEQ ID NO: 17697 - DNA, 2377 bp, Oryza sativa
  unsure (1)..(2377): unsure at all n locations
cggccatttctgccgccaccgcccgatcggctcggggccgatctggaccgtcagtcccgtggaccggtggtggaccacccgcgtggtcccgccccatggtggaccggcccccttgagccgctgccgagtggggccgtgtgccggcgcccttcccctctcttccgagccactgaccagtgggacccgcctgtcggcgccgccccccctgatgacgtcagccctgggaattatggcgcaataaattatataagggctttctgttatagtaataaacacagtgaatcttctaaaattcatatgtaattcatccgagctccgtttaagcccattcaagtcgcagtaaatcaagaaaaatgtgtagaatccattaaaaatggttttgttctctgtttcagtagtcttatagcctgtttgcattgtttgccttgtatgtcgttagattccggctcttccgacgctccggtgtacttcgaaatagtcgctgaggttccttcagcagcagagcaaggcaagtcatacttgtcacttgatcatgttgatcctacattgcaaatgttctattgttttccttcaaatactgcatttgttttgcaataacactatgggatgtttacctattgttacagccatactattttggtaccttgctcctttgttagctcgggttataacatgaatagattttggactaggagttgcttagccatgcttagttcaactagcacacaatggggaaatctcatttaaaatatagactgtaggtttatatgataatgttggattagtaccaccgctttggtgttagttaattaaaatgaatcacatggtgggctgtgggtgcatagttctgctagtcgcacccatggcaagtaaggaccggttcgcgggaaaccctggaagaactcctcgtacttaccacaagccagcgtgggcaacggctgggcttgtagtgtagcttttctctagctgacgcatcctggcaagggtgggcgtgatggagcggggtgggccctgcgacggcctctgtcgcttccgaattcacttaggtatgagaggggcctgcccgtcgcccgctggggacgggggtgaaacctgaggtgtggtgtacttggctagagggggttatgcgaagggtcctgtcacagtctctttccgatatgtcgtggtggcatgtcggcgcacggaaacgtgtcgtgggctgtgtcttggggtacagttgtacacctctgatcagagtaaaactattcgaatagccatgcccgcggttatgggcggtcaaccagattcaccgtgattagactcatcttagtttagtctaatgaaattggatggtataggtggatggttgggcctgttgcaacgtggtatagcgttggacagtggatgattaatattgattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctattttttttcccaaccccagagttcgagtatgtgtcagatggaggtttctccgagaagtaggcttcgtccgtgccatcgagggtgcctgtggaggttttaagggggggctctcttttttttccccggggtctttccccccgggatgcctgtggagtgtgttcccgctgagttcaagtcaaggctaaactcccggtgnctttcgtttttccgctgcatttatgtaacacttttagtgtgtttgtaagacgtggatctgaatgnnaacatngnnnntccngccccccggccgntcctggacgggggttttaatgcacattctgcttggaattctattcgggaatttctgggcgtgacagcctaccattaactgcgtatcgaagtgaaaatgataaagaaattaataatatttttatatgaagtcgatgatcaaagataaactttctgccaaagttatatttcttgacaagatctacaacgtggttgctgaacaattttttatttgacatagtttatgtgtgatagaagttatcagatctaattgataaatgctttaaaattttcatatgaattgaaatcgacgcaaactctatatcaaaattatacagtaagtaagatatataattttataattttatagttgataaccttaacatttacatttgaagtcatcaccttaacagcacagccaggatgctgcaacaagtcccaccgaacagctccacttcaggtttgtcttanattaacgatcgatctatagttttaccatatatannnnnnnnnnnnnnnnnnnnnnnnnnnnnnnnnnnnnnnnnnnnnnnnnnnn

SEQ ID NO: 17698 - DNA, 1181 bp, Oryza sativa
  unsure (1)..(1181): unsure at all n locations
taatgttttctaagcatggctaagcatttatatatataaagcatttagttgaaccaaaccaatatatagggttctagctaatcgaattataacccataggaaaatagagtcatcttcgaccattaattaattggaaaaggctcaccacccgatgagattcaaaaataatgcataagttgaaataaaacaatagctttaaacgggttcaacatgctcaaagggttgtttggaaactgtgtgacttgcttttgaaacaagcgtcttcaattcgtctttaggaacttctccaacgaacgaacgatcctccgaaacaacggaaaacaaaaaaaaacccccttcctttaaaaagggaaaaaaaaccccggcccaaaaaaaacgagaaaaaaactctaataaaaaccaaataaacagtacaattaaagttcataaataggtagagcttgaatttagatgaattatgagacttgaacgacctcattccgagttcgtatgaattaaatatgaattttacaaaatttaatttcaattaaacctattaaagaaaagactattccaaattgattaaacaatttacaaatgacttatagctgtgacaaaagattaaaacatcctccggaaatagattaggtcatatttggtagatgacatatattaaaaaggaataatatgccattgaaaagaaagaacagatttatatcgattttggacggctgagattaatctcgaccgagtcgaccaagatcggatggcttggattgacacacggcagcggcacaacagcggttgcggtggcacacatacagcagcagcacgacggcgacgtacaacgtctaaacagcgacgcggcggcaacaaggcagctagcgcagcggcgacgctagggcagcagctagcgacacagcaacggctgcgctagggttagagcaacagcggcggtgacacgaccaagggattgaaacctaacccgaggggacacggatagaagtctcaccgaaccaaagcgaccggagagggggggtcgacgatgacgatccggcgacacacacggaaacgatgacgacgctaggggcaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17699 - DNA, 562 bp, Oryza sativa
  unsure (1)..(562): unsure at all n locations
nnnnnnnnnnnnnnnnnnnnnnnnnnnnnnnnnnnnnnnnnnnnnnnnnnntactatatgttacatttggaaacaatccctatcatgccattctttgttatcctgtgcatctgcatatttgttatgtggcttgcggagtatttcatatgctcacctttaatcatcaaaccacagttggagaagtactctgaaggagaagacctttggtttataatctagttgagctacctgtggaagtgaagttgaagacatcgctagatcgtctttcccatattgtttccttgtgagtattatattggacctgaacgagaatagaatgcatagattagtttaaaattactagtaaatttccaagcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17700 - DNA, 469 bp, Oryza sativa
  unsure (1)..(469): unsure at all n locations
nnnnnnnnnnnnnnnnnnnnnnnnnnnnnnnnnnnntataagagtcatcggtgacgggcattaaggccttcttaatcgggccttctttggagcccgtcaccgatgacactcatctgtgacgggctcagtatttgggcccgattgagatagtggaggtcatctcaattgggcctaacttcgagctcgtcacagatgggtcatcggtgacgggctataggaatatgcaccccgacgagtacatctacaacggcaaaaatttaggcccgattgagatgacttcgttctaacggcccacgttgtctaggcatgtgatgagccatcacagatgagaggatctgtactagtggacgggagatgctccaggtttcatttgtcccgatcttcatctaatttcatcttttagatcgtgaccagatatttggtatttgagaacacgtacggggtaccgagctcgaattcgccctatagt

SEQ ID NO: 17701 - DNA, 270 bp, Oryza sativa
  unsure (1)..(270): unsure at all n locations
nnnnnnnnnnnnnnnnnnnnnnnnnnnnnnnnnnnnnnctggggttcatgccctatttatagggcgaaatttgagattttttggaattttttcgaaatttttatgaattttttagcctcccaacggttattttcaaatttgaacggtcaaatagcccgttagtgccacgtggcgccttcccattcgaccgccgcccgccctgtccgcgcctgacgggccgccggcgtgccgtgccgtgccgtgccgcgggccgtgccgtgccggcccgct

SEQ ID NO: 17702 - DNA, 4081 bp, Oryza sativa
  unsure (1)..(4081): unsure at all n locations
nnnnnnnnnnnnnnnnnnnnnnnnnnnnnnnnnnnnncgagtttcagttgtgaaacattaaccgtgccaatcacaagccagcatgggcaacgactttaccttttatatagcatgatttattgcggggcaccagactgagaagtggcggagataagcccacgggggtcgctggggagtccatgccttgtctataaggaggtgattatgatccaggtacggtgcactgctttgagttgtgttgtgcgaagggtactgtcacgatttccccctttgtagtgccgtggtggtacttcaaggcatggtaacatgtgtggaatcatgtcttgtgggtatagtggtacacttctagccagagtaaaactattcgaatagccgtgcctgcggttatgagcgggtataacaatgtctttcgtgttagtctcacacttttcaccataataaatgatgcgataactggtaataatttgatttgctcctggtttggaatggtacattcctggttcggagatagatctgtacagccgggtatggttgttcaggatggttgggcctgtgcagcatgggtgtgttgttcagtgttgattaatattgatgattaattactctgctgttttacaattctcatatgtttgctaaatgctgcattcgcaaatgagccctatattacgccattctttggtatccttgtgcacttgcatatttgctgtgtggcttgctgactatgtcatatgctcaccttgcaataatcaatcaaacctcattgaagaaaagttgcgaaggagaagacgtttggcttataccccagttgagctgcccgtgggagtggagccggagcttcgctagaccgtaattccgctgctgttttctcctttcttttgtaagtatgtaatgttgtatttttgatgaatctgtatattaaattgtcagtttgtgtacctcggttgatcctaaacgagttttttaacacacaaattagtcggttgattcctaaacgaggattttaatacacaaattagttcggaaattactagtgaatttctgtgcgtgaccgtgcatcgccacccttttactttcgttttgtttcgacaagttcttgctttcgggttgagctgcatcggttttgatcttcaacaagaggtaaaacttgttatgggcgcttgcggtctcgggattagtgcttccatctttatgatactctaatcttgtttatgtaatttggcgagtattatatgtcttacataatctctggcgatatcgctatctaatctacaatcggcttacattatcggtagagggcagctgattaggttagatatcgatgttgacttagattatataaggtatccacaactctatgaaacttccaatggcttggntgtcttgatattgcccttctttccatacttatagctgcatcagttgagtttgatcttataagtcgtgattagaatttcaatctctagcctgcttcttggttaccgattagggtagtatcggggtttcagccgatctttcctgatttaactatatttactctatatgcttcgttgatatgttaaatctgccctttatgttaagatctcgttgcatttgagtatattaggcctttgtttgatatattctacttggtttaatatcttaatatagagtggtatcggagtattagccgatacatgctagatctatctgatcggctatgctatgaacatatatagtcccattattaatatatatttcgatctaagtgatttatactgtctcggcatggcgatcgatctatcccaatcacttgatttaagtatatatcgatataaggagtatatattgttaatatctacagtcgttcgagtagatttagttccttcttatttattcatgactgccgatcgatacatatatgacatcggctcaaagataaaagatatgtcatcagcgctcagccgatcggctatcgtttataggtttaaccgcggtttctttgtctttgtttcttgttgattgcaggatcaaatgaactggcacactagcatacccgaaggcgagttttggacctgcactggagttaaacagatctcctaggcctcgtgttttacgtcaacacgcttttggcacacccagtgggaccgatcagaagtcaaaatcacaacagcagtttttcccatggccgagaaaccgccagcatcgccatcctcggctggtgaacttggttctgttaaagctaaggtccacaagctgggtctatctgaggttgatgaagccaacattgtgctcgtcactatggacaaattgacacctgaacagcaaaaggatcttgaggtaatgatgcagcaagcacggaatcagttcttgagctcattcacgaagactcgcaagggaacacttgttcagaagtacaaagtaaaagtaattgccgatgttcctgggacaggttcttctaaggttggagaagtgaaacaagctccagatgacgcggctcaaccgagtattaaaggtgctgcagatgactttcaaggagatcaaggtgatggctctcaagaaattcaaggtgatggtgttcagggagttcaaggtggaggtcttaatcatgacggcaatgcagcacaattacagtttaacaacttccaggatcaggttgactatgccgtgcactatgctttgatcaatcaatctagaatattagtcaacactttgtcaaacatggtgaagacaatggttgatggttcaatggctgaatatcaggctacaggacaagtttatctactaggaggggtattcccgaattatcggccattagtcactgataatcagccagttgttcaatcaattcctcttaatgcaccatcggctcagccggcggcaccagtatcggctcctgcacctgctgcaccatcatcagcgccaggtcaattagtgaatccttgattgttggtgagagagcaatcacagcatagtggacagaatgtgaatcggctaaagcaagatcaggttgcagctatgttcttacctcctcaacctaccgttgatccaacccagcagaagtcgattcagcaaataccaccaaggcagcaagttctgcagtcgattcaacaaacgccacgaatccaacaggttgtgtagccaattcagtagacgccacgtaggcagcaggttttgcaaccgattcagcaaacgctgttaaggcagtaggttgttcagccgattctgtagcaaggtttgatgaatgcatcgactgggtttgtaacacctgacaatcagccaaggcagcatgctgctaatcaagttgtgccagagcacttggttcatcatgtacagccagatcaaacgatgatacctcaagttgatcccgagcatttggtgcgcaatattcagccgaagtttcaaaattaccaggggggcaatttgaattatcagtatcagcctccttcaccgcaaatttaatatcagcagggaggatcggctcaaccccagtttgctcctcaatacaatcaattcgaactcattccacaacaacctcaaggagtacctcagcaacgaccatgggccgatatgattgcggatgtgatgaaggagcagtttgggcttaagccgaaagacgctggaaacttatatcggcaaccttcccctaaatggtttgagaaagtccctctacctaaccggttcaaggttccagacttttcaaaattctcagggcaggatagtatgtcaacttatgaacacgttagccgatttttatcatggatgctttgagggttaggttgttccggttgtcattgtctggatcggctttcacttggctttcttctttgccatgtggatcaatcaacagttgggccgatttggagaagcattttcatagctatttctacagtgagattcatgagttgaaattgtccgatttaacagcgatcaagcagagatatgatgagcctgtgcatgagtatattcagagatttagagagatgaggagcaagtgctacagcttgagtttaattgatgcccagttagnnnnnnnnnnnnnnnnnnnnnnnnnnnnnnnnnnnnnnnnnnnnnnnnnnnnnnnnnnnnnnnnnnnnnnnnnnnn

SEQ ID NO: 17703 - DNA, 721 bp, Oryza sativa
ggcacacccagtgggacccgacaagaagtcaaaatcacaacagcagtttttcccatggccgagaaaccgccagcatcgccatcctcggctggtgaacttggttctgttaaagctaaggtccacaagctgggtctatctgaggttgataaagccaacattgtggctcgtcactatggacaaattacacctgaacagcaaaaggatcttgaggtaatgatgcagaaacaacggaatcagttcttgagctcattcacgaagactcgcaagggaacacttgttcagaagtacaaagtaaaagtaattgccgatgttcctgggacaggttcttctaaggggggttttttttgggggccaaaaaaaaaagaaaaaaaatgttttggaaaaaaccaagctccagatgacgcggctcaaccgagtattaaaggtgctgcagatgactttcaaggagatcaaggtgatggctctcaagaaattcaaggtgatggtgttcagggagttcaaggtggaggtcttaatcatgacggcaatgcagcacaattacagtttaacaacttccaggatcaggttgactatgccgtgcactatgctttgatcaatcaatctagaatattagtcaacactttgtcaaacatggtgaagacaatggttgatggttcaatggctgaatatcaggctacaggacaagtttatctactaggaggggtaccgagctcgaattcgc

SEQ ID NO: 17704 - DNA, 521 bp, Oryza sativa
  unsure (1)..(521): unsure at all n locations
nnnnnnnnnnnnnnnnnnnnnnnnnnnnnnaaagacatacataagcatatattgtacaaagtatgactaatctacaaaatcaacactcatgccataaccttttgtcgtaacatgagaaggtaagcgggcgccattgttaattgacggtgcacccacgcatgcaaccgccgccttctccacctgtacatgtcatcctatcgacgcatagagcctcggctgggagtagcacctggtggtggccatgacaacggcatcgaacatttcctccatctccaccttgcggtcgcgcttgcttctcaccgtccatcgcaggtccacagcgagccatcacgctggcgcggcagcgcccactgcttggggagcccgcgccgccggatctgccactcaaaaacactactagaaaaagcatttccatagtcggccaaaacagtttttgacatgcggctagtcgcgacaactgcaatttaagggcctaaagtgatctgcctatgaaaatgttttcagagtgcaaaaaaaaacct

SEQ ID NO: 17705 - DNA, 817 bp, Oryza sativa
ggggtggccgaaagaaagaaccgtactttaactgagatggtgaatgccatgttagagactgcggggctttccaaggaatggtggggtgaggcagttttgactgcgtgtcatggcctgaataaaatttcaatgaagcataaggaagtaacaccattcgaggaatgggaaaggaagaaattaaatctctcatacctacgaacatggggctgtttggccaaggtaaatgtacctatagccaaaaagcggaaacttggaccaaatactgttgattgtgtgttccttggttatgctattcacagtgtgggttatagattcttaatagtaaactctggagtacccgacatgcatgttggtacaattcttgagtccagagatgctacattctttgataatgaattttccatgaaacatacacctagcactttgcaccgatagaacacaatgatcaaacgcctgagaaaaatcctgaggaggacaacattgtagacactcacaagagtaagagacaaagggttgcaaaatcctttggagatgactacattgtataccttgtggatgacaccccaagaaccatagaagagacatattcatctcctgacgctgactactggaaggaaatagtacgcagtgaaatggattcgattatgtctaatggtacttgggaagtcgttgagcgtccatatgggtgcaagcccgtaggatgcaaataggttttcaagaaaaagcttaggcctgatggtacaattgaaaagtacaaggcaaggcttgtggccaagggttatacccaaaaggaaggcgaggacttttttgacacata

SEQ ID NO: 17706 - DNA, 822 bp, Oryza sativa
  unsure (1)..(822): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctacaggctttgttgtgaacgaagctgacaaatgtgtgtactatcgctgtggtggggagaaggagtgatcttgtgcttatatgtcgatgacatattgatctttgggaccagccttaatgtgattgaggaggtcaaggactatctgtacaagagttttgaaatgaaggatttgggagaggctaatgttattcttaacatcaaactacaaagaggagatgagggtgggattacacttgtgcaatctcactatgtggacaaggttttgagtcgctttggatatagtgactgtaagccagctcctactccttgtgatcctagcgtgctattaaggaaaaaccgaagaatagtaagggatcaactgagatactctcaaatcattggttcattgatgtacttggctagtgcaacgaggcctgacatctcatttgctgtaagcaagctgagccggtttgtctcaaatccgggagatgatcattggcaggctctggaaagagtaatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17707 - DNA, 522 bp, Oryza sativa
  unsure (1)..(522): unsure at all n locations
nnnnnnnnnnnnnnnnnnnnnnnnnnnnnnnnnnnnnnnnnnnnnnnnnnnnnnnctttagtcaacacgccgttcatttcgcacaaattgtaatgaacaagttctagaggtgccaaattcctcgcctcagatgccttgtgaggcttgcgaggttgtttcgattgaacacaagtatggcacttggaacctttgatcaaagtgaattttggaattaaactcatgttagctaagcgcgtcatacaactgaaattcacatgacagagtcgcgaatgccacacattagactcatcattctcgctaatatggttcacaacattatgattattacacatgtcattcaaagaaaagcggaacaagcctccgctgtcataaccttttctaacaaaagtcccatatttagatacgacacatttattggactcaaacacaagtctaaaaccttctctacaaagtagagagccgctaacaagattcttctttattgaagggacatgctgcacgttcttcagctgcacggtcttt

SEQ ID NO: 17708 - DNA, 1000 bp, Oryza sativa
gtgggtattgtcttggtttgcttcaaaatgaagacgagatttggctattttgattcttccgttcgatcacttgtgtgtaacgtcatttttcttttctgtgtgtattaggtttcctaagcatcgactgtggcctggatcaagattccagaacagacagcctggttggcggaatcacctacgtctccgacggtgcgtacgtcgacgccggcgaaaatagaagggtgaccaccgtgtacaaggacgactggaagggccctcgctaccagacactctacacgctcaggagcttcccaacatccgttaccggtgaacggagctgctactcgctacccaccaaaaaaggggacaagtacaatgttcggctggagtttctgtatggcaactacgatggcctggacagcgcatccctgacgttcaacctgacccttggggtgaaccactgggacaccgtgatcttggacaccaccatccactacggttataaagcatacgccgcggtgttcgtcgcatgggctatgtcggcgccggtgtgcctggtgaataccggcggtggtacaccattcgtgtccacggtggagctgaggccgtttgaaagcttggcctacccgaccgacaatcagtcactctccctctatgaacggaagagcatgagatcaggtgctgacgtcgatataataaggttggagcactactactgtatttcctaatttccggccgtcgtagtaattaaggagcagctcatttaatttgcaccttaatataatgtacaaatggattggagaagaacctgtatattctctgattttactaactcctaattttctatatcaacctgtccttttgttccttgtggtgaaaaatatttacattaaggataaagtttgatcagactttaatttttataccctaactattaattttacagtaattaatggaagtgctcttggattcgtacgtacactattttttggaaagcatagaacccttcttatataagggg

SEQ ID NO: 17709 - DNA, 2262 bp, Oryza sativa
tggtgaataccggcggtggtacaccattcgtgtcaacggtgaagctaagcccgtttaaagcttggcctacccgaccgacaatcagtcactctccctctatgaacggaagagcatgagatcaggtgctgacgtcgatataataaggttggagcactactactgtatttcctaatttccggccgtcgtagtaattaaggagcagctcatttaatttgcaccttaatataatgtacaaatggattggagaagaacctgtatattctctgattttactaactcctaattttctatatcaacctgtccttttgttccttgtggtgaaaaatatttacattaaggataaagtttgatcagactttaatttttataccctaactattaattttacagtaattaatggaagtgctcttggattcgtacgtacactattttttggaaagcatagaacccttcttatataagtattatttttcaacataactcatttcctttttgatggttgatggtcaaagttttatattgtcacaaacatcaaattttaggactagtcaaatatttacgaccagaggaagtaagtattcatcgtcaatttgtttttcaattgcatgtttcctttcatattcaggatttcataaatacaggtttcctgatgatcagtacgatcgttattggtatgcgtgggaattaactggaaatgacccttattcaaacatttctacccaatcagccatcgaactgaataccacatttatggtgcccttgcgtgttctccaaacagcttttgtgccggttggtaactccaatgaactagttttacgttcaaagagaagagacagacttcccggtgatcacttggtgatcctgcacttcgccgacttccaggataacaagactagggagttcaccgtttcaattgacagcggcatgcaaagtggaccgatcagtccaccatacctgaaaggttggtctatcatcaattggtccagtgattctgaagatctgtccatcaaacttgttgccactgccacatcttctcttcccccgatcctcaatgcttatgaggtctacagtcgcatcatccatgaatatccaatgacgttctcccaagactgtaagctctatctgtctctaacaatgtacactaattaaatatatcagttgggtttcttccatgtatttctttccatatgctagttgatgcgatcatggccattaaacatgagtacggaataaggaagaattggatgggtgatccttgttatccatctaattctgtttgggatggtgtggaatgtactaatcctggtgatgataaaaccatgaggataatatctctgtgagtattattcggaatatttgcacgtgctatcgtacttgctttattgtatatagttggtacctttcatttatgttgtattgcttgaaattattatgcagtgatctctccaacagcgagttgcaagggcagatatcctataatttcacattgtttagtgccctcaagtatttgtaagtatacataaaattttcactgcctttcattagccacatctgaaattcctgactgacattaatggggatagttttatgctatttaaaatcaccggaaaacaccaactaaatgatgagcagttgcattctggtgcaattaaaattatataaacccatcctaactactccctccgtcccattttaagtgcagccatggtttccgtgtctaacttccatcgtccgttttatttgaaaaaattaaaagaacataagtcatgagtaaagtactattcatgttttatcatctcataacaacaaaaatactaaataaaaaattttaaataagacgaacgatcaaagtttagcgtagaaactgatagttgcacttaaaatgggacggagggagtaggagtaagaactagtggaggtttattgcatcgcatgtactatccatgtggtgccacatcttcgagagaatgagactagcagtaatcggtttcatatgtagttgagggatgaaaacggaccaaggctacagttgcatgaccaaaagtaggcttttctcttgtagttttaaatttgaaagacacatatggaggaatctttctttattacatatggggcaatctgaatctgaaagtagagcaagaataatatatattatatggtctataatatatcagaattccttcaacacatgtgcttagctttcaaaattcgtagatatcacaattgaaggcatacatcaacactgtatccgtccaactgtag

SEQ ID NO: 17710 - DNA, 1764 bp, Oryza sativa
  unsure (1)..(1764): unsure at all n locations
nnnnnnnnnnnnnnnnnnnnnnnnnnnnnnnnnnnnnnnnnnnnnnntgtgactattgtttcgccaagcgaggtgaggcgcagtgggtatgaaggttcagatttagaaataagtatcgagatggtttatttttaaatttaaaattttaatgttcaaaaaataacaaaaattcccaatgaaaagcgtgtgactatacttccattgtctgttgcataataaccttttacctacctaagagggtggcactggagagcacaatcatgtatagttctcttaacaatcatgtatatgtactttcaaagtgcaagtcacaaaggcaatatgatacatccaccgctctagtgtatttataatctttgtccttcaacatacaccagaaatttatggcacctcacaaaagggaaaatataccttctgctgcagcctacttatcgacacatctccttttacaattgaattgaagtaaaatgaagcactgaagtttaaaagaattctccttttacacatctcatttttgccataaaggaatttttttatgtgagattgccacttggatgatggaatatacctgtttacttttaaaaaaaaattcaagcgaattatttcatgtccgattggcactgccggcccttcatataaaactttttagtggataaatttgtttgcagattgttaccaagtcaggatgtctattgtttaatgccagattgtatcccactttatacagaaacttgtcatgcaaccaactaaccgggacaattccagactaccttcgcaaaagcaatggatcaattgttttcaggtgtgcctactttcattattattgatttcccttttagcattttccagattgtggggttgttcttcctgtaatctttgggcaccctaaaagaaaatagggaagggaagtgatactatgcttctcaaataaaaacctgcacggaaattaaagcacatcaatggtggatattaaaagtggattaacagagtaatccccccattagcaagggggcagttttgtacttagaaaaaactgagcccctatccatatcgatcgagcgatcgactcgcggcggcagtcaatttccgacaattccacctctccgctgccacccatgcatcatgctccctgcaggctgccaagcggctccgcgttcggggtggcagcaaacctctggtgagtagggatgccagccgccgtcatcggcgccgtgcgccgggacggtcgctctgctcggctgttgggaatagtcccatattacttatttagggaaaggccagtcaaggcggtcaggagttcgattgtccttgagggttgatatttgcttgcagagatgcagttgattaatgtttagaaggaagaatcgttcgaaaaatgcttagaatgaagatagcctcttatggttgtgatcttgtgggatgttctgctcaatgtggtcgtccaagtgctggtttagttgggggcaaagctggatccgaacgtgaagctcctccatagccaactgggagcgtgaggggtagcaggcgcagagacgtggaaggggccgggtagaggaagaggtgccgtcggggcaggtttcctttatctcgtcgaactttgccacacaccagaggttctcgatctcttcgagccgtgtgtgtcgaaacacttccgctcgcggttccggaaaatccttccgaagctgtctccgcctgaaccggtacctcctcaacgacagccgtatgaaccggtannnnnnnnnnnnnnnnnnnnnnnnnnnnnnn

SEQ ID NO: 17711 - DNA, 4639 bp, Oryza sativa
caccccccccccccctccttcctctcctctaagtggtttcttttttttggtaccgcattactttccatttagtaaatttatgcacataaagtttatacacctcaagtttacacatataaagtttagagacccaaagtttataaatcataagtttatatatccgattctaatttgaatttgaattcaaatattttttatataaagtatttctatacatctaaagtttatacacctaaagtttatagacccaaagtttataagtcaaaagtttatatacccgattcaaatttgaatttgaattatatctgattcaaatttgaatttgaattcaaatattagtttatagacccaaagtttataagtcaaaattttacatacccgtttcaattttaaatttgaattcaaattttttatatatagtatttctatccataattttttctaacttttttttatttttttaaattttatggtgtgttgtagtaggaagagaagaagggagaggaagggggagaagaagagtgtatagggggggagggacgggtgttcgctagaagtagggggaagtgatcacccgcccactagcagtaccttgatgctcgttgccttggtaggtgatcgctaggagtagggggaagcgatcacccgcctactagcagtaccctgatgttcgttgccttggtggatgaactgccgcccgcgctgtgaatccatcgctcgatcgataggatcaacaagaatacgggctcagatttttctaaggacaaaattgcccctttctaatgggaattactctgctaatatcacttttaattcccaccattgatgtgctttaattttggtgtagatttttatttggcgagcataccaatttaaaaccatggacttattgttttatgtaatttcagctacgagtctgacggagatatgtgcaaaaaaccaataacttcgtcctcaagaaacagagcagctaccttagctgtttatgtagcggctccagtgcttgtagtcgccatgcttgttgtagcatatttgatctggagagccaaaagaaagccccattgtgtgtaatactataatctgcattgaaaaacacattgtttaatatctgcatttaatactgctaaacatgttctttctccaccagtttctacagatgattctcccacggtaccagaacagataagtcctccaggacattggacaaatcattgggaccatctacaaaaacctgagaatcgtcgattcacatatgaggaactagcgaagttcactgatagcttcaaatgtttaattgggcatggaggctttggaaatgtctattacggctgtttagaagacaataccgaggttgctgttaagatgcgatctgaatcatcgtcccacgggctcgatgagttcttagctgaggtgccaaatatagttactattatgtttaaccatagataaaatcaatctgttttcagtaaaaaagattcaatacttagaatgccatatatgtgcatgtaaacttagtcgcatccactgtgaggtttcatacgcatcaagatatttgaccatttgttttgtcccattacataggttcagagcttgaccaaggtgaatcacaggaatcttgtttctttgattggttactgctgggagaaggatcatttagcacttgtctacgagtacatgtctagtggcaatcttagtgattatctgagaggtttgtccattgcaatctttaagtattgaatatttgggaaatctgagggaggatactgggcatatacattacgtagaccaactagtcattccttccttacaacttaaatactctgcatgaccgaaccagctcacagcgaagccaattaactcatgttgcataacagtttgcagaactatgacaagtagtactgcttacctggagagtgcatagttagacattttgagaaaaaaaaaagactggagagagcatagttagtctctacctaaggggcttcatggccatcgcttaaactcactaaagatatcataatatatttagagcaatttttggatactaaaatgtgccccaccagtctattggttttttgaatagtagatgtgagtagtttgtattaaagccaaactattagcaaggcctatattaatatggtaactctatatgtaccaatcaaatttggctctaaattggttctaaccaaagatgatccatgcaactctaccctacaaaaaatttagtagtgcccaaacttgccttggttctaatagtgccagttatttagtacgacagaaaacaaaaaactacccttaattctgctgccctcaagtatagaatatgttaatcttgcattaccaattttttttcataattgctcatcatctcattatctagacatctgattaatacaacacaataataaattgtgtggatgtttaaaattgtatacaaaataaatgtttttgcattattgaaggtctatctcgactgattgtgcagacatagtaatatcaagagatggttgtatctatctaataaattattacattgattctatcctttttttaaaggaataatactgttttgacttgtcaattaacaccgctcccccccctctccccctccccccctcaccttctaattgcgtataagtaatgtatgaaggtaaaactagcatgggtggaaccatgaattgggcaacacgcgtaagagttatgcttgaagctgcacaaggtatgctacagtaagaagacaatggcaaatacgcaaagaaagaatctatgctatgccactgaatttatcctactttaacaatttgtcatcaattttgtctccctctataatataaatggcactgactttacagtaagctattgtggtggatacttttctgaaatgcctagaatgcccttcgagttatccaagagttgacaattgtttaacccactagaagttttgaaaaaatatgaaagtttttgtgtacttagccttcttacgaaatatagaatgtgtgtatattttaaatttttctttcatgttttttaaataataattttatatagtgtttgaaagaggaatcatatacacaaaagatagccacatcacaataaaaaaggtacaacatgtgaatgatgatatacataaaggaatattaacacgagagtattttgttgccatataaaacataaattatattttttaaaagttaatacgtgcaaaatgaaaaatcttgaaatatacacactgttatattatgcaaggaggctacataaaaattttcaaatttattcaaaacttctagtaggtgtaacctcttgtatgtcttgaagagcattttaggtattttctaaaagtatccacccctaatggtatattgtagaaaaaattgacaaagtcagtggcgtattataagaaagacaaaatcgatgacaaatcatcgaactaaactgatctcagtgatataaatggatttctatgttttatcgctcatctcttgatctaactgtagttttcttgtatgtagggctagaatatctacataagggttgtaacctgccaataattcatggggatgtaaagacaaataacattctcttgggtggaaatttaaaagcaaaaatagcagattttgggctttcaaaaacctaccatagtgactcccagactcacatatcagccattgcagcgggatctatgggctacattgaccctgagtatgagcttctttctacacaattaatgctaattttgtgctgtgtattcatatattttaatgattctattcaattttatccttaatcacttggtgcaatcattgtgtttaacataatgtgggccatttttaggtactacatcaccggtagactcactgagagcagtgacgtttacagctttggtgttgttttactagaggtaactagtggtgaacctaccataatacctggaaatggtcacattgttgaacgtgtgaagcagaagatggtcactggtaacatcagctcagttgccgatgcacgtcttggaggttcttataacgtcaactccatgtggaaggttctagatgctgccatgatgtgcacagcagatattgctgctcaaaggccaatgatgtccgccgtggtcatgcaattgaaggaaagcctggaattggaggaagctcatggggacatgggcgacatggaaaatatagcaagagataacaagttttcgatgtccatgttgggtccatcggcaagatgaagaattaaccattgcataactagctttggaacatacagttggttctctgcttcaagtctaaaataaaagaacttgtttgcatagatgatttgttatatatgtgttaagacacaatgatttatacagtttgtattcgtaacagagctgacagtaagcaattcgtgagagtaggtcagtcaaatgctgagaaggtggttgtttacaaccaaatattatgtaatagaatcctctgctattttataagctgtttgttttcaatgtgcaacagtaagctattcgtgtgagtaggtcagccaaatgctgagaagtaggtggttgtttacaaccaaagattatgtactagaatcctctgccattttataatttaaccgaaatgttaacacagcctcttgcataattcagcacaactgcaaa

SEQ ID NO: 17712 - DNA, 3552 bp, Oryza sativa
  unsure (1)..(3552): unsure at all n locations
nnnnnnnnnnnnnnnnnnnnnnnnnnnnnnnnnnnnnnnnnnnnnnnnnnnnnnnnnntaatagaatcctctgctattttataagctgtttgttttcaatgtgcaacagtaagctattcgtgtgagtaggtcagccaaatgctgagaagctaggtggttgtttacaaccaaagattatgtactagaatcctctgccattttataatttaaccgaaatgtttccacagcctcttggataattcagcacaactgcaaagggcagcacctcatgacagagctgaggagcatgtgaggactcgaccatcaagcaagaacgaatgatctcattattcccgtttgttttttttttgttggggggggcgggggggggggggggggncntnnatnnnnnnnttnntnctgntnnnncnntgcnntnttgaancctncnnntttttnngacatgttttgttgattttggttaggcgtagttgcttaacacattgcaaagtcaaggtaagaaaaactttacttacgtggatttcttcccaattctaatcatgtgagataggatatctcatacggagtacagccacccctacaaaattgatttttctggatgagaccctttttaggttgtacacggaccataactgcttccgcctacaaaaatccctcccacggggtcagttcaaagcgttgcatgcaaaataacatttgcatgcggcctcttaagagatccacctgtaaaaatggactaaccttttcaggcgagcctcctaagtggccacatgcgaaaatcagatttttacagacgcctccttaagaggtccacttggaaaaatcactgcaaactaaatataaaaaccaaatccactccactccacctttcctctcttatcctctcctcctcctcccccccctcccccctctctgtctccctctccctcttgagcacgtggctggagcagcaagcgggtcggcgtttggtcgcgggtaggagcgactagcgttggacaggagtggtagtgagctcggcgacatggaatccagcgtggaggacggtgtgagaggcggtggtggcacactcgtattgggtatcggtgccctcggctacggaatctgatgcggaggacagcggactcaggcggccgtagcaatgccctcggctagggattcggcgtggatgacgacgggagcagcggaagcaccctcgaattgcatggtggtgccctcggttgcgggatgcagagctcggccgcgggatttgatacagaggacggcgggagcggcggtgatggtatcgggcgacaacggcggtgtcctaggctatgggatctggccggagtgatgagctcgaggccgacggatctggccgtgccatcctcggcaggggcggatctgccacccttggccacataagaggtgaccacgacattgggtggcgacagcggatccgacggcgccaccctcgggagggcggatcagccacccctggccccgagagggtgacgacggcattgggcggagttcgagggcagcagatccatcccccctccccccgcgggttgatgggccttctttatggatgggcaataaaatttactttcacttctgacaaagctacgtagcaaggttgtacatggtcagggctatactaggctactagcaattttttgcgtgagctgctcagttttgtgaacttcttctccttcatacttattattctcattgtagtcgaggagtatctagacggtaccttgacgctctctaggcattcaaacatactttcgttctcttccttactcaagtaatggcttcctttcttcttttgttccggatgatggccaccgcgttgttccatatgcttgagatcattacgtgcttcatgtgtatcttttgacttcctatatacacctaggaagcccagcaagttgacgcaaaggttcttagtgaggtgcatcacgtcaattgcgtggcggacatccaagacttcccaatagggtaactctcaaaaaaaatagacttcttcttccagatcgccgcgtgcgcatcttagctctctataggttggttgctagctccctttccaaatactactttcagatctttcaccatagcaaacatgacttttccattgcaatgtttaggcttagtacggtggcttgccttctgttcgaagtactttcctttcttccgtacaggtggcttgcaaaaaggaatcgacgatggcccatgtacactaccttcctacaatgttttagatacgtactttcagtttcatccatgtagtgggtgtgttaacaacagaattttgtatcagatccggaaaagaaggaacaagatcgaagcggatttgatgaatgatcaagttgtatttgaagtcggaccgcgcatcggctgggcattgtatcggctggagacagaatagaagtttggcttagccaatatggcaagtggccgatacgatatgacttgggctcgtttcgggtctagattggaataaccgtcattgtcaattagagatagagctcgattaaggcaattgtatatattaattaggatatttaagtcgattgttagagatttggcaacagaccgccatgtggtcttgtttgtatcttatctttaggaaagtttgagtcgcgttcataatggactatgtttgtactcggggtacaaatatgaaccccagagcattgtaataagggaaataatccaatacaacttcggcgcatcgtcatccgtttttgttcttcttttcgtcgagttctctcgacaagaggtaactcgtctcaatggcttgtgctatcggggctactatgtcgttttggatgttatagttcttttatcataaccatctgttgtcatatgtcttagttaatttagtcttagtatctcaatttagctctatcggctggtactcgttttggtattggctaaatcgttttactagattagattaactaaggcatctactatcttgaaaagtaattaattcgttgattgtttagactttaggtttctttacctactttgagatgcctcatccctagtcttgtctagaaccctaaaaactaatctgaaattaattataattagatatagaatcagagtttcagctgatctttttttaatatacatgctactttacttgttttatgtatatttatcacttatatagatagatcaacatatataaatacatcaagtctagatcagtaatcagctaggtcatcaaacctggtaattgatctcaatttgatatactagtcaccaacccgtgcgttgcacgggctattgtcatgatattgtgtaattttaaaatatagccagttagatttaaaactttgtccatattacttataatttacttattatttatttcaaatttcgaaatattatgtgtttgatatgggtacaacttcaagtttattaattccgactttctatttaaaatgtcatgctttattatttgggtacaatggagaaaaagtgaaagtcaacgatatttcctattgtatatttatttaatnnnnnnnnnnnnnnnnnnnnnnnnnnnnnnnnnnnnnn

SEQ ID NO: 17713 - DNA, 820 bp, Oryza sativa
  unsure (1)..(820): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgtcgccggcgaaatcgggagcacctaggccgttcccgaccttcccgcccctataaaatccatccccgcgtcctcctcctcgcttttccttttgccgccggcctctcccgagctctccatcgcccccacgccgtgtaaccactcgccgccgccgctcccgctactccggccgccgctagccgctgctagggtcgccgccgcaccgcgccgtcgctgccgtcgggttcgcgaggccgaactccacctcgtccgccgctcctccgtcgagattcgtcgccggaacccgcatcccctcgcgctcaggtgagccctacccctaccgccgccttcggccatggatgccggccgccgtggttcatctccctccctctaatctctctctcttccttccttagggcatcccgaagctcgtccgcccgtcgccgccgtcttcccgtggctcgccgtcgccgttagccatcgtctcccttagcgccggccactcgcggtgaggcattcatctcctctattccccttcctctccctcctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17714 - DNA, 675 bp, Oryza sativa
aggcgaattcgagctcggtacccatataattaatttgattgttaagactggcatgaagagggtaggtgaccacatcgatgctgttcgtcaagcaatcgcgtggttaactgcttctaacccgcggattgctgcatggaagaggttttgcaatgcggccggtgtgaaagctcgtaagtttgccaccgatgcagagcatcggtggaatgcaacgtatttaatgttaaaagttgttttaccttatagtagtttactttctgattttgttcagtcacgtggtggcccaagaaacagtgacgggtcttcagtactgaacgagcatgtttgggcaattgtcccaaaaaaaaaatttttttttttttaacccccccccaaaaaaaaaattttttctagaaacttttatgattgtactctaactttgtcacaagtttattatccaactgctaatataattttgcacaaccttcttgaaattgctactttatttaaagaatacgaaaatgatgacgttctaactgaacctgtctttcacatgaacaaaaatatttgaaatattgcgaaaaatatacctatgttgtatgctcttgcttttgttttagatcctaggtgtaaattaaggggattgtctgctattttatcacttgttggagatactatagggggatccctctagagtcg

SEQ ID NO: 17715 - DNA, 547 bp, Oryza sativa
gcgaattcgagctcggtacccttctctttctggttccgtttcctcttcctttcccaaaacggcaccacatctgtttcccgcacctttcctttctaggcaacccctcctcccgtatctttttcccctccccctctcggacttctcccagccgtgcgcctcccccctctcccagccatgctcctactttgccctctcccctacgagtccctccctctccccctctgccgggcctcccttggcccacctaatcctattcaatcttcccctatataagccgacctctcccctcctgtttcctttttttttgtgttgcagccacccctagcctaccttccccttttcccccttttccccccttcgggggttttttttttttttaaaaagccgccttcttcaacaccctagccggcgatgccctagtcgccactgccgctagccgtcaccccttgccgtcgtcgtcttggtcgttggcgtcgtcttctcaggtgagctcttctctctcccatgtcgtttaccggtgtagtttatccctaggatttaatctaat

SEQ ID NO: 17716 - DNA, 560 bp, Oryza sativa
  unsure (1)..(560): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcag

SEQ ID NO: 17717 - DNA, 474 bp, Oryza sativa
  unsure (1)..(474): unsure at all n locations
nnnnnnnnnnnnnnnnnnnnnnnnnnnnnnnnnnnnnnnnnnnnnnnnnnncccgacggaagggaggtatcgaaagcccgttgtagaatatgtaggcaaattttatctgctcgttcttctggtggtacaggtcacctcaagcgccatgcggagtcgtgtgccaagaagcaaggaatacaactccggcagcagcaacttatggtaaacccagacggtacggtacgcagttgggagtacgatcccatggttgctcgggaatctcttgtccggttaatcgccaggcaagatttacccctgaactttggggagtcccctgcttttgaacattacattcagcaatctcataaccctaggtttaaagctgtgagtaggcaaacatcaactagagatttagagaatgtttatcacaaggaagcaactgcacttaaggaactgtttagtacatgtactttctctgttagtgttacttcagat

SEQ ID NO: 17718 - DNA, 499 bp, Oryza sativa
  unsure (1)..(499): unsure at all n locations
tcggtaccccgaggagtgacaggccctttgcccatatatgccgctatatagccagactaaccccctatgcttttggtcttgaaatcaaattggttcttggtgttcatactcatagggttagccgatgaggttacatctaatccagtgatcatggtgatgtcgatcagggttggagtcatcggcccttggttgaacaaaaaggcattgatagtgttggaccaaatataagtggcggcggccatcagaggttcatctttagctgaattggctatggtaagggcaagcgcttggccgattccaatctcgtcctagtgaactttcttgctagccgatacgcgcttataccatgtagtccaacttttctcgggtggagttttatcgagagatggccaagatttgaaggtatttttatagtgacctagatttgggttggccaatctgaaagnnnnnnnnnnnnnnnnnnnnnnnnnnnnnnnnnnnnnnnnnnnnnnnnnnnnnn

SEQ ID NO: 17719 - DNA, 147 bp, Oryza sativa
cccgagctccgtagcacccgctcgtcgccggcctcgctcggcgtagttccgcccaatccgacgctagcgtcgagttcccgaagccgcgtagatgctgtcaccgccgggaatcgacctctcgtgacctcgtcgccgtttccctcttct

SEQ ID NO: 17720 - DNA, 157 bp, Oryza sativa
cgcgatctggagagtgggcctggccacagtgaagtggtgggggcgaaggccagctccgtgtatacctccacgggggtaaaggtacacagagagctcacagtgagggggaacacggtccacggagtaccccgtgtactcaggacacgagaagccaagg

SEQ ID NO: 17721 - DNA, 337 bp, Oryza sativa
  unsure (1)..(337): unsure at all n locations
gaacacaggagtagggtgttacgcttctcagcggcccgaacctgtctatgtcgcccgtgtcttgtgcacttcctctcccgctgacgttcctcagatcgagggcgaagaacctcacttagcgcctccggccgaaccggcaaaggggggcctgcgcggtctcccggtgaggagccccacgctccgtcatctggcgcgccaggtacggggcgcgcgtgtcttcctaagccctcgtcctctttcgtgtgcgccaagcttctcccgctcagcccaatggccgaannnnnnnnnnnnnnnnnnnnnnnnnnnnnnnnnnnnnnnnnnnnnnnnnnnnnnnnnn

SEQ ID NO: 17722 - DNA, 256 bp, Oryza sativa
acaaacgatggctcgtttgggggtgcaaccaaaatacaaaatgaagatcatgttattgcgattccattcctctacttttctcggtcagtggacatcggagtaacgccggcggcgagtcccaaaggaggatgttttccggtggtgatgcatgtgcttctacaatcatgtattggttaattgggtgcatgcaagaatgtcctataggctgaagggtgctcaccgagatggtagacatggctggggtagctaggtttat

SEQ ID NO: 17723 - DNA, 1921 bp, Oryza sativa
gtacagatctatctccgaaccaggaatgtaccattccaaaccaggagcaaatcaaattattaccagttatcgcatcatttattatggtgaaaagtgtgagactaatcacgaaagacattgttatacccgctcataaccgcaggcacggctattcgaatagttttactctggctagaagtgtaccactatacccacaagacatgattccacacatgttaccatgccttgaagtaccaccacggcactacaaagggggaaatcgtgacagtacccttcgcacaacacaactcaaagcagtgcaccgtacctggatcataatcacctccttatagacaaggcatggactccccagcgacccccgtgggcttatctccgccacttctcagtctggtgccccgcaataaatcatgctatataaaaggtaaagtcgttgcccatgctggcttgtggttggcacggttaatgtttcacaactgaaactcgtgaaccgtctttaattgtcatgagcacgaccatcaaaaccatgtgctcacaatccaccattatcaagttttagttggcacattaattaattaaccaatcacgattagccatcatgagctacaattaaatatccatcattaagtgatagtgaaacattagttatcccaatcatgtgctaatgtttctaagcatggctaagcaattatatttaatatctagctgaaccaatatataagtccaactagtcaaattgtcacccatggtatcaaagaattaagtaagcaatgcaaagtggtcataacaaaggaataggttcacaccacccggtgacattccaaaaataaatgcatggttgaaataaatagagaatttaaatataggatcaacatgctcaaaggaattgtgtttgggatccgtgtgacttgccttgcaatattcggtcttcaattaatcttcttggatacttccaacgcactcacgaaccttcaaaacgacggaaacgacaagctaacctgcagaacgaggaaaacactaagaaactccaaataaacagtacatataaagtaaacaaacatgtagatcatgattttagatgaattagagtcaaactagtcccggttcggatgacttatctctatcgggtgtattctaaaagcccgtcacggatgactaatctctaatgggtaggactctatagcccgtcacggatgagttatctctttcgggcattagctaaatgtccgtcaaggatgagtttagaacaaaaaaaataaaatttggctttttggctagcctcaggcctttgctagccatgcccgctgcaaaaatgacagaagcatatatatacatagtcccattcccagcaaccccattcccagcatcaattcacaaattccatcacagccatttcatatagacccattcccagcatcacatcagccaattcacattcatattccatcatagcacagccaattcacaaaatcaaacacatatacattcacatccacaacccattcacatatatatcattcacatccatttttctctccaaaccgccgacatgcatcaaaacctgcaaaaataagttataaattggaacaattttatatgtaactagaaatgcaagtatacagagacgagctacctaggactttactctaaagaatataattgtattacaaagaatatttacaaaaatcaaatgtttgtcacatatgcattgcgaatgttctgccattgcgagacgagctacctaggacttcactctaaacatccctttcaatgacaagatatcatctagtatgaattgtgctagctcctctctaatgatttcgaagttgatttccggaatccttcaaataaatttctgcacgttcggcgccaacatcgtccacctctgttatggtgtagacttccttaggaattttattctggg

SEQ ID NO: 17724 - DNA, 1806 bp, Oryza sativa
  unsure (1)..(1806): unsure at all n locations
ctccggccctaaggaatatggttgctacacacagacaaccaaaaccctaacaacgtgcatcttcttgtttgcagggtcttttatgtagaaaatctgttcgacctgcttcgctagtacgaatggttcgtctgcgtatccaaccttggccaggtccactaatgtgaagccttccttgtcgaccttgacacctctgcggatattcacccaactgcaacaaaacaaagggactttgaagttcagatagttcagctcccatatctgctctatgcggccatagtatgtgcttgatccagcctgatcctgatatgcatctatacggagtccactgttttgcactgtgcttttctcatcttgtgtgacggtgtaaaatgtgtatccattgatattgtacccttgccatgtgttaacatcccaagatggaccccttgccaacctttgtaatatctcacttgggccatcggtcgaccgtgctacatgatccttcaaccattcgttgaagcgaaaaccatgttctctgttgatccaaatatctgatcgaccaatattgtcctgtcagaccttcgctaaatgctcctcaaagtatggggttacttcagccatatgttgcagcactgcgaaatgagcctgcgcataggaagcttgatcgggaacaattctttttctgccagttgtgccaacacttgccaaccttccttcgtggcgagacgtaggactcccgatagnataagtctcagccatgtaatcgatacaaaactcaatggcttcctcggtcatgtaaccttcaatgatgcttccccctggttttgctctgttccgaacgtaggacttcagaattcccatgtacctctcgaatggccacatttctctcataaaagctggcccacatattttttttgcttcactaggtgaatagtgagatgaaccatggtatcgaagaaagctagtggaaaatacatctccaactgacacagggtactgacaatatcggcctgcaacccatctaggtcttctggatctataatcttctgaccgattgcattgaagaaggcacaaacccgttggatcatgtgacggacttgtggtggtagaatgcctcttatagcaattggcaagatctgtgtgattagcacgtggcaatcgtgagacttcattccaaccagcttaagatcctccaatttaacgtacttacttattttcgcgcaatagcccgaaggaactttaatatccgccagacatgatagcattgcgatcttctcatccttcgacaatgtgtggcaagctggtgggaggtacactcttcccgtctacacatctgtaacaggctgaagttcactgcgaatgttcatctcctgtagatcgagacgcgcattcaacccgtcctttgtcttggcaggcatattcaacaatagccccagcaagctatcgcacacatttttctctacgtgcatcagatcaatgcaatgacggacctcaagatcttcccaataaggtagccgccaaaatatggattttttcttccacatcctcttcttgtcctccttactatgttttcttttcttatcaaactcattagtaatgtccttcaccatgttgtgtacctgatctccggacaaatccacaggggcagacccaagttctttcttaccattgaaaattttcttctttcttctaaaggcgtgccgtagggggagccatctcctatgacccatgtaaaccatctttcttgatttctttaaccacctactgcatgtatgttccatacagtcagagnnnnnnnnnnnnnnnnnnnnnnnnnnnnnnnnnnnn

SEQ ID NO: 17725 - DNA, 641 bp, Oryza sativa
  unsure (1)..(641): unsure at all n locations
tttaatatccgccagacatgatagcattccgatcttctcatccttagacaatgtgtggctagctggtgggaggtacactctcccggtctacacatttgtaacagggctgaagttcactgcgaatgttcatctcctgtagatcgagacgcgcattcaacccgtcctttgtcttgccaggcatattcaccaatagccccagcaagctatcgcacacattcttctctacgtgcatcagatcaatgcaatgacggacctcaagatcttcccaataaggtagctccccccccccggggnaaacaaaaaaaaatttaaaatgggggggaaattttttttttcttccacatcctcttcttgtcctccttactatgttttcttttcttatcaaactcattagtaatgtccttcaccatgttgtgtacctgatctccggacaaatccacaggggcagacccaagttctttcttaccattgaaaattttcttctttcttctaaaggcgtgccgtagggggagccatctcctatgacccatgtaaaccatctttcttgatttctttagccacctactgcatgtatgttccatacagtcagagcatgccttctttccgttcacgatttgtccaaaaagattacccagcgcggg

SEQ ID NO: 17726 - DNA, 296 bp, Oryza sativa
aagggatatgactccttgaggacccgacatcttcatcatcatgtaggtatagtacggaacgaccatgaacttggctagcgccgggcgtccaagtatggcatgatacgccgtctcgaaatcagcaacccttgaacatatgttttccgtccggtagttttcccgagtgcaaaaagtaaccgaagagtgatctagccgagtggtgtagcagatagccctgggatgactccgtgaaaggggcgttactcggctttagttcctctcgagggatctgcatgtcgtccagggtcttggcgaaa

SEQ ID NO: 17727 - DNA, 373 bp, Oryza sativa
ccacccgatgacattcaaaaataatgcatagttgaaataaaataatagctttaaacgggttcaacatgctcaaagggttgtttgggatctgtgtgacttgccttgggcttccgcaaacgcttcggaaccttcctcaacgagaaggctctcctccggaacgtcggaaactaaagcaattaaacaaaaatcaacaaaacagtacaaaaacaagcataaacagtacatgtggatatttttaacatgtagatcttgattttacaaaaatttagcaacttgaaccacctgaaacggatctacggttatttagttatgattttccgaagatttaatctattacaaaaaagggaaaaagaaaggatgatgatgtcatgct

SEQ ID NO: 17728 - DNA, 396 bp, Oryza sativa
gcacagtatggtttgggacttaacctgttgttggtttgggacccctctcgtcggcatatggtaaacttgtgtcggctttcgaaatgccttgtcatgaaagcttggaggtctcccgacgtggctgatccccacgggctggatgatccgggttagtaatgtcatgtgggtaaagtgtaccccctttgcagaggttaacaaactgttcgaacagccgtgcccacggtcatgggcggatgtgaggtgattcctagcgtagttttgtttgactactgctcgtgaaattgctgttgtgaaaatgggttcgatgtttgaaaaatcagcagctgacgggatcagctaggcccgggtggccgtttggaaagttgttggccgggtggccgtttgaaaagttgttgg

SEQ ID NO: 17729 - DNA, 885 bp, Oryza sativa
  unsure (1)..(885): unsure at all n locations
nnnnnnnnnnnnnnnnnnnnnnnnnnnnnnnttttcgaccgcctcgtccgcggccttttcagccatgtttttccgcctcctcttcttcctcccgttggggctcgccatcacactcttcgacggcgtccacgtcatcggaatcggaggaagaagaaccctccgcttcctaggggcaagcttcacctgcccgcgcgtcgcaggaggcgaagagcggcaaaacaatacctgtcacatagacaataaactttatttgcaggaacaatgtaggtttcggcatgagcatcggtcgaaagggggcgccacataccataccacatggtttgcacggtctcggccgaagctccaatctcacccttgcccgtgaggggcttgttggcggtatggcaatgagggctacaaatagtcccatagggcatgaggccctttttttttttttgtcgaagccatgcgaacagtggggattgaagcccgagacgtcaagattagtcagggcgaagtccccccatggcgaagactatggaataacgacggcgagaggcggggaatcacatgggtaccttgccaagccataaggcctcttgggcgaaggatgcagggcgaagagtatatgccgaaggcgccatagcaagttcgcccccgcaaggaccgaagaagtctttccagcccatcaagcctaggggctattgggccgatgatcgcccgactgcccatcaggggcccgtgaacctcaattacactatgtacccatataaatgtccctttcataagggcaaccatgtaatttcccatgtataaccacaaccctagtagtaagaaccagtaatgagggctataaatgttcccatagggtcatgtaatgggggatccgaagaaaaattctcaatt

SEQ ID NO: 17730 - DNA, 377 bp, Oryza sativa
caaaccagctccactagtaagacactctcaattttactagtcaattctagccgattttgtctaacacttgtctttttacagcttcctcctcctccttcttcccctgtacaacaatcattgagtgaccgaactccatcggctgtagggagtcatcatattgtggaagaagaacaaccagctgctcctgctatcccagtaagttttcctttgatgcaagaatttagatcggctatattggcttagctctcaaactttctgaacttatacctataggttctagccgatctcttctattttgatatcagagattatcttgatgaggcagaaaaagatacttcaagcaaagctctagctcccttatctgataatgcaaagaa

SEQ ID NO: 17731 - DNA, 456 bp, Oryza sativa
  unsure (1)..(456): unsure at all n locations
aattcgagctcggtacccgttggagatactataggtgtagattatagttctttttatactgaggttagacgtaaattatatgaggtttttggaagatatgaagtaaagtttcaggaagttcgccagcagagaccccctcctatccccactacaggtaagaagaagatacagtggggtaggatttggggtggatcgtcttcaagttcaatccaaggtggtggcagttcgtcggctacaagtggagacgcctcttcgcatgttgtggccgaagagttgtccggttatttggacagcgacgccatccaccacgaagcacaagatttcaacgtcctcgggtggtggaatgaccacaagataacatatcctgtgctttcaaaactagcacgggatgtgttgacgnnnnnnnnnnnnnnnnnnnnnnnnnnnnnnnnnnnnnnnnnnnnnnnnnnnnnnnnn

SEQ ID NO: 17732 - DNA, 418 bp, Oryza sativa
  unsure (1)..(418): unsure at all n locations
aattcgagctcggtacccgccaatatggtacagaaaaagaaccctcatgcatcctacaacaacaagaaagtcaagcctgatgtcaaacccaaggctgcaaccaactttaagaagaaaggcaagggaaaagcaaagggagactgctttgtgtgtggcaagtctgggcattgggccaaggactgtcctgagcgcaaagacaggaagtctgccaacatggtcattggcgagggcggaggaacatcggggtacggtaaaatattacctacagttctctctgtttttcactcacctgattggtgggtggacactggtgctaatattcatgtatgtgctgacatttctctgttttcttcttatcaggtcgggagnnnnnnnnnnnnnnnnnnnnnnnnnnnnnnnnnnnnnnnnnnnnnnnnnn

SEQ ID NO: 17733 - DNA, 883 bp, Oryza sativa
  unsure (1)..(883): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaggacaatcgaactcctgaccgccttgactggcctttccctaaataagtaatatgggactattcccaacagccgagcagagcgaccgtcccggcgcacggcgccgatgacggcggctggcatccctactcaccagaggtttgctgccaccccgaacgcggagccgcttggcagcctgcagggagcatgatgcatgggtggcagcggagaggtggaattgtcggaaattgactgccgccgcgagtcgatcgctcgatcgatatggataggggctcagttttttctaagtacaaaactgcccccttgctaatggggggattactctgttaatccacttttaatatccaccattgatgtgctttaatttccgtgcaggtttttatttgagaagcatagtatcacttcccttccctattttcttttagggtgcccaaagattacaggaagaacaaccccacaatctggaaaatgctaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17734 - DNA, 481 bp, Oryza sativa
  unsure (1)..(481): unsure at all n locations
nnnnnnnnnnnnnnnnnnnnnnnnnnnnnnnnnnnnnnnnnnnnnnnnnnnnnnnnnctgcaacccatctaggtcttctggatctataatcttctgaccgattgcattgaagaaggcacaaacccgttggatcatgtgacggacttgtggtggtagaatgcctcttatagcaattggcaagatctgtgtgattagcacgtggcaatcgtgagacttcattccaaccagcttaagatcctccaatttaacgtacttacttattttcgcgcaatagcccgaaggaactttaatatccgccagacatgatagcattgcgatcttctcatccttcgacaatgtgtggcaagctggtgggaggtacactcttcccgtctacacatctgtaacaggctgaagttcactgcgaatgttcatctcctgtagatcgagacgcgcattcaacccgtcctttgtcttgccgggtaccgagctcgaattcgcc

SEQ ID NO: 17735 - DNA, 621 bp, Oryza sativa
  unsure (1)..(621): unsure at all n locations
nnnnnnnnnnnnnnnnnnnnnnnnnnnnnnnnnnnnnnntgctttcggcgtatcggctggccagtttttgggatttcttgttcatgagaggggaattgagataactcaaaggagtgttaatgcaatcaagaagattcagtctccaaagaacaagacagagttgcaggagatgatcggcaagataaattttgtgagaaggtttatttttaatttgtctggaatgttagagccttttacaccattattgaggttgaaagccgatcaacagtttacttggggggcagagcaacagaaagcgttggacagtattaaggaatatcttagctctcctctagttttgattcctccacagaaggggataccttttaggttatatctgtcggccggtgagaagtcaatcggctcggtcatgattcaggagctcgaagggaaagatagagttgtattctacttgagtcgtcggctcttggatgcagagactagatattcccctgtggagaagttgtgcttgtgcttatatttttcatgtacaaggttaaggcattatctattgtccaacgaatgnnnnnnnnnnnnnnnnnnnnnnnnnnnnnnnnnnnnnnnnnnnnnnnnnnnnnnnnn

SEQ ID NO: 17736 - DNA, 606 bp, Oryza sativa
  unsure (1)..(606): unsure at all n locations
nnnnnnnnnnnnnnnnnnnnnnnnnnnnnnnnnnnnnnnnnnnnnnnnnnnnnnnnnctttttcttcttgagggaccagatcgatgtggtccttcagaatagtgaagttccgcctccctaggactccgcatatcgtagggaactttttgacagctttcgtcggagccgtcggatatccaacatcgtccatctctgttatggtgtagacttccttaggaatcttattctgggtcctaggattccggctcgatgtagtcccagtagtggccgtcgacatcggttcgccttgctgtgacatgtcctatgtcactgttgtacggggagaaagtactttttaaacacaaaattgcatctacacacattctcttatggtttgatatacctctatctcctacctacgttcgcctcatcgacgaaaccatagcatccatactcaatagggccggagcagccgggaactcgacctcgacatcagtataccactcgaacttgctatcaatgtcactaacataagatagtggcaacggtagcaagttctagtgggatatggatgtcgaggtcgagnnnnnnnnnnnnnnnnnnnnnnnnnnnnnnnnnnnnnnnnnn

SEQ ID NO: 17737 - DNA, 970 bp, Oryza sativa
  unsure (1)..(970): unsure at all n locations
ccccgatagcttcgctcggtaccccgtcccaggtgatcacttatcaggtctccatggcgctcctggttttgctcgcttactactacgaaaactctttttgcatgcaggcgagaagcatatttgcatacggttgtgcccatcgtatgggtaagaaggtctgcaaaaatcacgtttttcacatgcggccggcgtaaccgtattttcacatgtggtcgcttatactggctacatgcgaaaataaattcagcaataaaaaaaaaaccaaaacaccctcccccaaccctagctgccaccggagcgccgtatccccgccgcccgagccaggcgcacgtcgttgccggcgccagatccatcactcccgccgcccaccgtcgtcaccagccctggatctgttgcccccgccgcccaccgtcgtcgccggcgccggattgacagcccgccgtccacgccggcgcgggatcggctgctccaccacctgttgtcggcgccaacgctggatccgccagccccgccgtttgcgcaagggaggggcgcccttggcaccgaatccgcatgaggcggtgccgcccctgccgccgtggcggtgagggggggagggttgcctcgtcgtcgttgtcggcgttggcagtgagaaggggatggcggtggcgccgctgcccgcgttgccgcccactcgctggatccactgtcccaattgcgcgcccgccgtcgccgtagctgcagccgctccctagggtgacgaatctgaccttcccgagggaggcgccgcctgatccgccgcccttgctcccggctgccggcacccactctcatagagggagagggagaggacaaaataaaaagagagggagaggagaggtgagagagaggggggagagtgatataatagaaggggtgagagnnnnnnnnnnnnnnnnnnnnnnnnnnnnnnnnnnnnnnnnnnnnnnnnnnnnnnnnnnnnnnnnnnnnn

SEQ ID NO: 17738 - DNA, 570 bp, Oryza sativa
  unsure (1)..(570): unsure at all n locations
nnnnnnnnnnnnnnnnnnnnnnnnnnnnnnnnnnnnnnnnnnnnnnnnnnnnnnnnnnnnnnatatccgacggctccgacgaaagctgtcaaaaagttccctacgatatgcggagtcctagggaggcggaacttcactattctgaaggaccacatcgatctggtccctcaagaagaaaaagaagaggcatggaggaagttcaaggaaagcttccgataccctacagaggccaaggtaggactgaagcggcaggctatccgcaagatggggaattgttggaaaaatttcaagacaacgctagtcacggagtacgtcctcaaccctgcccagccagaaccatttgtgaaatacccattcatcaccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17739 - DNA, 536 bp, Oryza sativa
aatccatacttccccctttttccggttccacatccccttgccttattcctcttcatccccatccccaacactactagctattcatgtgtttagaaaaaaaaaaaaggttgctcctaacattatataaatgagtggtgtattgctatatttgtgtatctatatatgtgtgtctaacgagcaaagctgcagcaagcaggggagtggaaacctataaaagataattctacaaggtgatttgcttaagcttaaatgaaatttgcccactaaagatcaaatgtatttgactctaagtacccatttagcttccggtttgctgtgaagggtgtattcactgattaagaatggattctgatgatttatgaagcaataataaagcaatcaaatattgtattatcaggtatttctttttcttgatgttatgagttttaaagcaggaattgaaatgactgtaatattgacatgcgttatttgtctttacccaaagtgacagttatgaaataaatgtcctttcaaaatttgtggtttgggctgcagga

SEQ ID NO: 17740 - DNA, 297 bp, Oryza sativa
gccaacacagatccgacaccatcggccaagcacaagattttcaatcaacagcaatatacctaaaccctatttttcctccttcccttctttagtatgccctcccctgccaccgctatcacacactcgcgcacacgatgagcattctgcgcctcctgcgcagcgctgggccacaaccctaccaaaccggcacgccactgatcggcctcaccgactggccggaaggggtcaacggtactgacgagctcccattcacccaccctgcccagactcatcccctccccctgctctttcccaagg

SEQ ID NO: 17741 - DNA, 243 bp, Oryza sativa
cacgcacaccatgtacgtacacacggtaacagcaaaagagaggaaacttaacgggttgttccttaccggccgggtcctcgtcatcattcgacgacatatactagctcttttctgaatttatctccaaatatatatataatctaaaatgtcatataaatgaaaatggagggagtacttggctggtgatatattaataagctaaaaaaaagtctctccttcgaaacttatgcttgaaaaaaccga

SEQ ID NO: 17742 - DNA, 578 bp, Oryza sativa
ccacctgactgatctaagaaagctcgccatctacaagctcaacgtctgaagaggagataaaccttttgagaatctatatcctccatcgagtacctctgtggctactctctgcacaccctcgtaatcgaggacgtctcatcggagactctggaatcactaggtgatctttcttcccctcccaagtttctcaagtcccttgagctgtctggcaagtgggttgagctccccagatggatcacacagattgaagaactcacaaagttgactctctcggtgacagttctgaggacagataacttgagaagtatcagccaattgaaaaaactgttctctctcaccttttgcctttcaggcgcaaagcctgatccactgtcaacagccattcttgaggagaacaagaactactctgatggggaaatcttagttccagcatgaggatttgagaatatgaagctccttcatttctctgatcctctactgcccttgctgaactttcaggagaaggctatgccaagccttgagagacttgagctacggatcaggattctcgagggactttttggcatacaaaacctgca

SEQ ID NO: 17743 - DNA, 27715 bp, Oryza sativa
  unsure (1)..(27715): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttaccccattccgttaagatgactaactatgtagggtcaaaattcattttgagtttgctctatcccttagttttttttttactaaacaagtggaaattcgtattaaaataggggcaacatttataaaatgaagcttaatgtaaaaaaaaaaggagcaaaatcataatgtcctcggaaaagtagggacgaacaccgttaaatcatgttaacaagagcacatacaaacttcagttaaaaatgacaaaatcaaaaacttcaaaaaatagggatacaatcttaactgaagtattacaaaatcacaaagttaaaacaaaaggtaaaatcgtagctgaagttaaagaacagaaataagaacacaattgtccatttttacccagagatgactacacggtggcccataaaccaggctgtcttacaaggtgatcttgtgggctttgtctgtaaggcctgtgaggccatctgaggtccgaaaccgggcctagctcgtccagatgttaggacgtcaaaattgcttgttagttgattggaataagtctattttgctccctcctctcttgcttcgttgaatcgtatccctcaatcacaaaaccggatataacaccttgcacaatttcaaaaaccagttcaaattgactctttgggtggtttcaaaagcggtttttccataatgacagatcgacttggtctaagtgttttcacgtggtagcccaatcattaaaggagttgaatatagaagggggacggctaatgggcggcgatcacaggcccacctgctccccctgtatgctcccttctctccccctttctcctctctttcttctcttcatactacagtacaccatacaattttaaaaaataaaaaaacaaagttgaaaaaatttatgtatagaaatacaaatactatatataaaaaaaattgaattcaaattcaaatttgaaatgagtatgtaaatttttgacttataaactttgggtctataaactaatatttgaattcaaattcaaatttgaatgggtatgtaaacttttgacttataaaatttgggtctataaactaatatttgaattcaaattcaaatttgaacgggtatgtaaacttttgacttataaactttgggtctataaactaatatttgaattcaaattcaaatttgaacgggtatgtaaacttttgacttataaactttgggtctataaattaatatttgaattcaaattcaaatttgaaacgggtatgttaacttttgacttataaactttgggtctataaactttaggtgtataaactttagatgtatagaaatactatatataaaaaatatttgaattcaaattcaaatttgaatcggatatataatcttttgatttataaactttgggtctctaaactttaaatgtgtaaacttgaggtgtacgaactataggtgcataaatttattaaaataggaaagtaatacggtgtcaaaaaaagaaaaccaggtggaggaagggggatccggatccgatcgccctgggcgatcgctcgcccagtagcaattccggcccgcaatgccggtttaccagtggcggactggacaaagttggccgttgatatcggcggggttggcaaataagttccacatcccgctgcagccgaggcacacgcagcaggctagaggggctcgcggtggcgttccacagctggtcctctccatcgccgccctcttccgcctcccaatcaacgtcgtccgttccacacggcggcaagcagcaacgacggaggaaaccccatgggcgctgacacgaggtcctccaaggtccggtgctcgccgtggaggcggcgtgcgaggtctattatgtacacgcgggaaacagagaactgtgtcgccttgacgccgaacagcctagcgacgtcggcgatccacggcgttgggaactcgaagagtgcaacgacccgccagatccttgcgacctcctctctatctcctcgactcctctaggctggccggcgtgcagcgcacctcctttcccttctcccctctctccccagatgtgggaggcaagcaacaagcggcgggagtggagctgggcggggcggctggtgggagatcctagtcgcatgacgtcccgtgcctcgtcgcgcacaacgacccaccgctcgctctcgttgtcgccgtgctctcatgcatcgatggcgacatctgcccgtcttgcattcacctcacaagccaccaccatgtcaactgagggctcttgagccaccgctgtcaccgctgccacctccgcaaggtgtcattcaattctgccaccaccgagcatgatttcggtagcaccacctatgtggtggacataggcgaaccttaaccctagcttcggcgagtcgctgcaatggatagctttgtgaccttctcccgctgtcgccgatgttggatcctcctagcggcgagtgggacagtggcggcattcgaggtgtacaatatctactaccacctggccatggtggcctggcgccaccgcctcgtgcagctggttggcataagctctctcagctcgtcctcgatgaccctaatgtcagccgagtcttcggcaaggtcggattccgcaatgaggacatcaagctcgccattctctgcccatgccgctcttcggctgcctacccatgtgtagctgtccgccgcttctcttcctttgcagcttcgccgccgcagacgacgctgttatcccttatcccaccgggaaccttgccggctcggggggagaagaattgtcgccgcatcgccaagatcctctcccgtggtcgcaaccccatgctcgtcatcacgggtgatgcgagagaaatagaaggactgacaagtggatcccatattttttttaatttttttgaccattgtaccttacaaatcggacccacttctatttcaactcctttgatgactgagctgccacgtcgggacacttagaccaaggcaatttgccacgtcagcaaaacatctttcgaaactatccaaggagtcaatttccaccggtttttaaaattgtgggtggtgttattctagttttgtggttcagggatgcgatttaaccagggtaaagagatgcaggatgcgaaatagacttattcctagttgttacttccacgtagattcggcccatcctcatacccatgcgctctggatgtaggcaggaatgtaagtacgtaacaacatatacacaaagtgttggaaatatagtcatatatcggtatattttaatccaaaatattaagacaataatcatgacatgaataatgtgaggtgatctagtgataaaattaaacataaccaggagcatgcttaagataaaataagcatcatcatcatgtagagaacgcaataacattgcgactaacagaagtaacaaaaacagagatagcggtagaatgttatacactatgaaattccatccctggattgtgaggtagaattgcctccgttggtgttgtcgatcggtgcaccagctccggctcccggtgcgccagctcccgctccaggtgcgccatctccagaagacatgatgcaaatgaaccgacgacgaacagaggaagaagagcagtcgtgcggaagcactccccaaaaacttgatcacccgcctacccggtgcagatctcaggcgaggtgtggtttcggagggcttgctcgttccgatctctcatgtgcgcaagcgatcagaaccggggaagcagaagcagcacaagcggtgcaaggaggaagaaccagcaatcggagagaaagcgtagagatctgatcgggggtctctgtttcctaatagcgcaggagaggaatccgcccgttgccgcagtaacgacgcgatcaatgcgtattgaattgcctgcccgttacagaggcaatctcgcggggttggattccggtccattgcaaaaggatcgagagagagacagagagagatgcagacacaacgcaacgcctcggcctccccacgccctcgggccggccggctcggctcggcgcgcgcgcgcgcttgtggctttccgatccccacctcaaccggtcaacagggagcctccaataactccctatttaagttgagatactccacttttaattcccagtgtggtattattatctttaacatttattatgggcccttgagattttaatagaaaaatcgggcctagcccatttattctaacacaaagtaagtaacaacatccatgaagtgacctgcatgagaaaatactcctctctcttgccactcttttttatttctgccctcctctctctgtcactaagtcctctccccactcctctcccctctcccctcactctcggtgagtgagggccacggcggctatcccatcatgggtctggcagagggagcgagaggctgacggaggagtggccgagcgcagatccagcggcggccggctgccgtccccagccctgatccagtggcgacggccctcccccacgcggatccggtggcggccctccccgcgcggatccggtgcccctctcccttccgcgcggatccgtcggtggcggcgacgcaatgaggacgacgatgacggcgacggtgatgggaggacaagcacgccgacgccaaccggagggcgaggacaaggatggcgttgacaatgagaggattctagggttagcgtatcggggtagtggggtagttttcaattttcagaatttatatatattttttcatgattttttccttttctcatgtggtcagcttaagcgcccatatgggaaaatccgattttcgtagacctttgagcacaggtgggccgcccatccacatgcaaaagtcgattttagccgcataaaaaaaaaccaaatctgtagtagtggttactcatattgaccaaaggcaagcccagcataattcaagagtattaaaatgaatatctaatattttttataaaagaaatagatatatatcgtatgtgatgcgtatgtgtatgaaaaacaaataaaatggacgtcatattcaaaccaagaagtcatcatattcaacacataattaaatatatatgctatataaatatcatttttttaatgaaggtactgccaggtctttacccaacagtttgatttatgctatataaatatcattactactatatgataatatacatgccaactattaggtttttggctgtaacttttctttctacttctctacattttgaataacagtttgattttatgctatataaatatcattactactatatgataatatacatgccaactattaggtttttggctgtaacttttctttctacttctctacattttgaatatacaaccttaaaattctagattcacccctaatattaaccagttacaaccatttcacattttgttagagtgcgcagcccagtggtgggccacccaagtcacattgggcctgttcctccacaagcccaaccgaaaccacaactagacctacacaatccaaaagactagtctgatgggtgagaaccgccccccaccttttgagtcgtgctcccccatcataaattaccgatgtgggactaaacccaacaatctctcccgtcacatcaacccatgtgacccgatgaagactccatgtgacccatggaaattgttccgggttccaaacctagggcttgtgggtctgcatgtgacccaaggaaattgttcagggttccaaaccttgggctctaatactacttgttagaacccaacaatctcccccgtcacatcaacccatgtgagtatgtgacccatggaaattgtttcgggttccaaaccttgggctttgataccacttgttagagtgcgcagcccgacctaccaactgtgagccacccaggtcacattgggcctgctccaccacaagtccaaccggagccacaactttaggtcctgagcctacacaacccaaaagactagtctgacgggtgaggaccgctcccacattttaagtcgtgctcccccatcatcaattaccgatgtgagactaaacccaacacatttaatttctcatctctccttaatcctaaattaaacatcagaaattcagaaatgtttgcatttcatgacaaagagagtaagtatatattaagaacacaaacttaattcctacgaataactagtgaaagtttatctttgttcctatgaataacacaaacttatctttttatcatgaaaacacgttgttttagatatagatatagtcgcgctagcttcttaattcaactttgagtaccacaatactccctccatactcacaaaggaagtcgtttaggacaatgtttaagtcaaaccttgggaatataaatcatgaataactctcaagttgttgagtttgaaaatgtaaaaattatatgaatatatttgtcttgaaaaatactttcataaaagtatacatatatcacttttcaataaatatttttatagaaacaagaagttaaagttgtgttttggagaccgtgtcgctgtcctaaacgacttcctttacgagtatggagggagtatctgacagttggacacttggaatattaataaatataggattcgcggagctattaacacaactgcatcgatctctctgatattgcagttagcaaggaattggaccacacgttcaaatattaaagtgtgcattgcatatatattagccaatgatcacctagaactttggagaatgtatggctagttcgttggtgttcatattgtacttgcgtaatctcttcgctctgcatgtgcgtgtcgttgactagtgaggtgtgatatatcccagctagaagacacactaattattaacttaagcacaccattcccatgggtctaatttcttttgccaagttcaactacttgactagccggccgtgcatcaatatgcatgcacaccactacgtactgatcgtatgatccaactatagcgtgcaaggatcggggcaagagacgatgcaaacattaggtgaactattttaatccctcgaacagatgattccttgtttgttgaaaaaatcatactgatagttatgaacaaatctttaaatctttaataatattcatacaacaaaaatgtaacaatctatagaataggcataaactgaactcacgcattaagaaaataaaaagataaagacaacatataaataatactagtattttttttctcaatgtgttgtcaagtttgaacttgtttttcttgagcatgcaattaaacttgagagaaaaaagagaacggatattctctctagggattagaatatgttcctacaaacatagggcaattcgaacttaagccctacgtttgcctctctttgatccattaaagaaaaaaaatcaaaattctgaatatacaagagggctaattaagaaataccctcaagtggtaaagtattttttcccttgtgaggggatatccctaaattctcgaatgcatttaaataattatgaaacaatttgataacacagatcaatatgtgatatatcatttcctaaatatacaaaatcaaaattggtttttacaagttgaaacaaaagatcgaataatccaattaagaacatgccctaataatttggtttttttattaaattttatatggcgtatttaaacctaccttgggtttaaggattttttaacatataaatttttattttttttaaaatttaacttttggatggatttggaaaaacttaaggacttatttggggttaccaacgaaggggtccccgaccttccttggccctggactttaattaatttggggccaatgtgcttggatcaacctgtcaaaagcctgaccacactttaaaatactatctttgtgtgcctatatcaagtagccctttgaatcgcacgaatgaaaaacggaaaaatacagcattctgataggaacgtaggtgtaaatcagatgattgcaaaacgcggaaaaacacaggaatggtcgtttgattggaccccaaaaaaaacacatgaatcggatgagaaagataaactcaaggaaaatttttcaagagattgaagctcttgccagtggcggaccctctcttgtggcatgctgtggcactggccatagctatgccatgcaaggattgaagagtatttatgcatttggccattagcatgttgatttatgtgctgattaattggttatttgatttgataaaagtttgtttaattcaggatgtagggatttcgtagaactgccttatgtctgaaaagaagactaacacaacccgtaaaaaataagtatgctgctttagtaaatttccactagtttattgcttttttccttgagcagaattattgattggactgaccatccaaaggtctggccataaacagagcacatatgtaaaatggacgcacactcttgtgaaaattatttcactcgtgaaatttacattacaaatttaggactattgtcgttaacgttttatttagtgtgtcgtatattcaatgagtgcaatttgcagtatagttcgtgtaaaaaaaattataaacaaacgtagtcctatcatattgatccgccatagctaaaatttggtgttggttccgccactggctcttgctatgttttctctaaaatctccattggattgcctatgttatagatatcgtaaaacatatgataggatttaatcatttgttttgaaagccttcatagaaaatttttctatagaattgaaatccttcgaaaccgctatgttttttctacaaatcaaaagcgaagatacgttttcacaggggaggttatgttggcgtttttctcccttcaattgtagaaacttcaaacaaagttagggcgttaattaaccgtgccaatgccggtcagcgactgctcctactagcagttgcaccaacgtatatactgggtccaggtatatttgagctaagctggcggtataataataacaaacatagttagagaaagctatcgtataaacttacagatatctccacatgggagccgtgcagccagctaggtaattaatctgcagaaagcactaattaatcctagcatatcatctcgcatgatcatcgatgcatgcatagagatatctcaaggcacacgtactccactaatccactctataaatagcgaagcacgtaccacgaatccctcagctcgtaccagtcgtcgtcctaagcaagaagaagctaagctagctagctgtgatcggagaggtatacagtgatcagtttgattgtgaatttgtgatcgccatggctgcagcttcgtctactacgactcgtttttgccttctccttgcgctcgtcctgccgatgatttcctccgccgccgccggcgacgacgcgctgccgctgcccatgacaccgtcgtactaccgcaagtcgtgcccaacactcgaggccatcgtgcgcggcaccatgctcagtgccatcaaagccgagcgccggatgggcgcctccatcctccgcctcttcttccacgactgcttcgtccaggtagatgatcctagctaagcttcatttcttcctgctcattgggcggatgatctatggagatcttgaagcaatgcaagctcacattgcttgtgattgatcagggttgcgatgcatcgattcttctcgacgacgtgccgtcgaaggggttcgtcggcgagaagaccgcggggcccaacaccaactccatccgcggctacgaggtcatcgacaagatcaaggccaacgtcgaggccgcctgccccggcgtcgtctcctgcgccgacatcctcgccctcgccgcccgcgaaggcgtcaacctggtatgtacgtgtttggttaccgcgtttggttaccgatggtgatttcggggccggtttcgtaacaacatttctgcactgcacacgcaatgcaatgcagctcggcgggccgagctgggaggtgccgctggggcggcgcgactcgacgacggcgagcaagagcgaggcggacagcgacctgccggggccgtcgtccagcctcgccgacctcgtcgcggcgttcggcaagaagggcctggcgccgcgcgacatgacggcgctctccggcgcgcacaccatcggctacgcccagtgccagttcttccgcggccacatctacaacgacaccaacgtcgacccgctgttcgccgccgagcgccgccgccgctgccccgccgcgtccggctccggcgactccaacctggcgccgctcgacgacatgacggcgctcgccttcgacaacgcctactaccgcgacctggtcggccgccgcggcctgctccactccgaccaggagctcttcaacggcggctcgcaggacgagcgggtgaagaagtacagcaccgacccggacctcttcgccggcgacttcgtggcggcgatgataaagatggggaagatatgcccgctcaccggagcagccggccagatcaggaagaactgcagggtggtcaacagcagctgagctagcaagatgatgatcacctactatttcttgattacttttcacagttttttacggcgtacggttatttcaacttaactcatttctgtaataagttcgtttgttttaatctccgaacttcttgtcacggtatttgtaatttaatttgtttatttgtacctctgagcttgttgcagtatttgtcgtttaatttgttcgtttgtaactctgagcttgttgtgatattaattatcaagcaaaatcggaaccattttacatttcaagaaaaggaaagaaagcaggaggtatttttatcacctaggtgatgtgatttaaatagttaaataaaaatgtgaaacaaattgacaaaatatcacttgaagatatgtccaagtgtaatcaaatctattatctatctatctatcttctattatattatattatattatattatatactaaaagtccatgaaacttcctacaaacgctctcaagtcgccacgtggcgctctaataaaatagagaaaatcctagaaattctaagaaaaagcaaaacatctatcctttgattttcacttaaattagtgagtccaatattatacaccgttagataaaatcgatcttaaaacaaactaaataccatgagccccacctatcctcctcccgcgcatgggcaggtggagtatataagtacctacatggtagtacgtacgcttccttccttttttttttccttttttcttctttttaccatatatatatatatatatatatatatatatatatatatatatatatatatatatatataatggatatattttttaaataatcatgattttataaacaaagaatctaccatcacataacttaaaccggtgtactctttactttgcactattattttcaaataatgcactgttttaaaataaaatttacacaataatatcgtgtacctatcaaattaataatatctatattaactaatttatacgtgcacttaaactgatggccccattatataaatcatcggatctattttttattacattggcctattattctcaagtaatgcactatttcaaaataaggtttacaccattatattgtgtacccattaaattaacaatttaaaatctatattaactaatttacacttaccctataactggtggacctattattataatcatcggatcaattgtttgctaataaataaagcgtctgaaattctctttttgcctgctgcacaatgcacgcctgcacctttgcctttcgcacgtgtgacaaagcgtagtgtctgagacatctaagatgatcacaaccgctgtagcgctaccgctttgccacatatcaaatcatatatggagataattaattttgttaataacatgaaaagaaaattaaatgtgtgatgcagcgagagaataattaagcactatgggttgtgtttttctcaacactaattagctctgtttaagttgaaaccgagagttgattacataataattataattataatgtatttatgttatgtcgtatttggatttcgtactatttgttcgtacaggtgaaaggaatcattatgttataaatgtgagcgcaatattgatgaatatcaatagaactcttactacgacaagggtgataaagggagtttaaggccctctcttttttcccaattccatttttggatttttgtttgcacgctttccaagtttctaaatggtgtcttctttaaacaacattctaatttttttagaagtcaattcattcgtttataccctcaaatagctatcacataaattatataattcatcaatttcatcctaaaccttaagtactacattttttttcatgcaagtcatggtgatcagtaaattggtgatcaacggatcatcaaagttgtaagataaatatgtaagagttactctgaacaattgtaaataggtgtcaaaattaatttctattaattagacatctaaaggtgtcaaaattaattgctagccacaaaattaatttctctctacgtgtatataaacatggacgaagttggaacaaatattaccatatgtcccatacatatatattgcgcagttaatattctaattacatgtgttaagtcatttaaaattccttaaaatgctctcaagctgccacgtggtgctctaataaattagggcaaatattagaaattctaaggaaaaaaaatcaaagtatctattacttgattttcacttaaatcggtaggtccaatattataaaccgttagattaaattgatcttagaacaaactaaatactacgaggtcccacctcggcataggtacgcacctacgtgcgtgggtacgtacgcttcccctccctttttttcatttttctctttcttctttttttcccatgcatatgcttccctccctttattactatatcatgcgccttcatgagacgatttaatcaaaagaattttgagtatcttgcactcgcatttttcatttgcagccatactacacgtacgatatatatatagatggactgtatgataattaaccagcaatggtttcttatttagtcgagaaaaaaaaacatgattcaaaagtcgtaagtacttaatccatctcctactcaaaagttgtgaatggttttttaagataccttaagaaaaatagaacccttaaattattactccctccgtcacctaatataaaggattttgatattttgcttgtattgtttgaccattcgtcttattaaaaaaatttggaattattatttattttatttgtggcttactttattatccaaagtactttaagcacaacttttcgttttttataattgaacacttttttttgaataagacgagtggtcaaacagtgtaagcaaaatatcaaaatcccttatattaggggacggagggagtataaaataacattatccaaactttagtttgctaaagtttgccctgaatctatgagacaaaatttctaaataaacaataatcttacctttcaataatataatataagtgcccgcgcatacacgcgggccatcttcctagtttacttaattagctttgcatgtttgtaactttgtatatggacttctagcatcacattgacgtggcacttatgtagcagtttgagtaaaaaaataaatggaacaaaaataaaaactaaaaaaactaacaaaatatacgggacccatacgtcaaccaaaaaaaatagtggaacccacgtgttagtgggtcccactacctcacctcagcctcttctcctctctttctcttctaggcctccatcctccatccccgccttcatcctctagcgctccggcggtggtagcatcccacgacggcggcgtcgaagcgggtgaccgccggccacctgtggcttgcgggctccaagaacgccagcggcggcaagaggaagagagaggactgcagcgaggacggggggagaggagtggcgtttcagtgggcggtgggagaggaggggcatgcggtgggcggcaggagtggagcggccactctccttccctccagatctccgcctccttgctccggctccaccgccgccggcgacaggacccgccgcgccgccaacgcttctgcgtggaggaggaccgaccgcccccgccccttgtcccagcgcatccatcctcgccgtgcggaggaaatgcggaagaggtcacccggtttgacaactacgtcgcgcgcgacgggcccttgccgactcctcctgcagctcctaggccagctgcgtgaactgcacctcagcttccgccaagccacgagcacatgcccccgtcacggaggccgctgacaatgacgactcggccgcctcccctctcaccccactctcctcctgcacccattagatccgcccgatcaccaggagtgtggccgccttggaggcacaatgggcgacggagagaggggcggcgaccatcggggagaagggcgacgaccagcgggaaggagcgaggcgacagtcacaatgtcactgacctcaaccgccacggggagttctagggacctccgctcccgcctcaccgccgcggggaggctaagcatcgaacccacggcaaccacgcgcatttgggtcccctcccggctatgatggatctgagagccagtcaccgttggatcccctcctgtggcgtcttgtccagtcgccatcggatctcctcccgccgtcgttgagttccccttttcggaggccgacatcaccattccctccctctgcataactgcttcccccacgtctcctgcaggtggtggtcttcattacggtggaagaggagcggcgaccttgtttccctttgagcggcgccagtgaagccacccgccggccttctccctctccacgtgtgctcgccagcagacgagggagctcgaggagggaggaaggatgaccgggcaggagagggaagaaggaggcgtcgtcgccgtcgtccgtggagaaggaggcgttgacaggagaggagggtaatatgtgggtcccatgaattcttttatgttttatctgactgatatgtaggcctcacatgttttttaatttttaatttttatattttacttccagtgccacattgccgccacgtagaacaaggaccaagtcaaattagctacagaagcgtcatgtcagctaagaccatcatctaaactgtcgagggaccttgtttgccctggttttgttagttgggggactgattgtatctggttttttggtggaaggacgaaaatcagactaggcgacaatgagggacctcaagtgaacttattcctttggttctgaacaattgggcttgtagttatgggcctagtcccagcatgagccatgcatgggccttctatctccgaggactgtccaagaatacaactgtaaactagcttcatggctagaccgggtaaaaaaacagaagtttcacggtgtgggacacctccatcacatctctatatatgtatcttccacaaactctaatgccgcttattataaaacatgcaccaaaattgaaatcgtaaaccatacacgaaggagggtcatagaagattcaaaagtgacgatgacctcgaatcacgatatttgataatttagttcaaccgtagtctatatccttaagacactgattacagataatccctccctcatccaacataactagtatggtggcccgcgcagattatgcggctagcatattattatattttctctcatataatagtatatatgttttcttatggtattattcaaatatattaaaatgataacataattttaaattttgcaataactttataaaactactaatgtgtaatattcatattgtattttatatacatattagttattaattatttttaatatcaaatttaagttatttgtaaattacatatattcctatatggactctagactcgtcttttaatatttcttatttttttaattccgaactttctgtaaattgtatttttatatagactctatgctcttcttccaatattatttacttttattctgaatttttattatttctaattgtatttctatgtggactctaaactcatctttcaatatattctttaattattaatttcgaatttcagttacttctaaattgtattcctatattgactttaaactcttcttcccatgtttttcttaatttcgaattttagttatttgtaaattgtatttttatacggactctaaactctacttttaattttattatgtttattccaagttttagttagttttaaattcctatatggtttctatactctacttctaatattccttatttttttaattctgaatttctatttttattattaattgtatttctatatgactctatactctacttctaatattccttatttttaattccaaatttctattatttcctaattgtatttctatatggactctatactctacttctaatattccttatttttaattccgaattttagttatttcctaattgtatttatatatggagtctagtctcctcttctaatattccttattttttaatttcgaatttcaactatttataaattgtatttctatgtggagtctagtctcctcttctaatattccttattctttaattccgaatttcagctatttctaaattgtatttctatatggactctgctttttctttttctccgattaatgtgagaggctatttctaaattgtatttctatatggactctgttttttctttttctccgattaatgtgagaatttataggccatgagagcgaacgtggaggactggaggctcctttttctattcctttaataatataatagatagattacaagatatcaaaaatcctcgatcaacaacgccgctaagaagtcgttcgagagaacctaggagagagatgtaaataactttatcctaacacaaatacactaatacctagtaaaactctaaatcctactaatttataatcaactactttgtacaaatatttgatacatactctaatattatggctaagtttgatttagattattgagcaaattattgtcatggattaactactcaataatagtaaattgataaaataaatattgaaagaaacccactcaacaaatactactccacccaaaaacatattttcttttgtaaatttagacaagtacagtgagtagcttaaaaataatttaatagaacatttttaataaaatacattttttgacgtgtgaattagtaaataatttttttaataatccaatgaattagttaaaatgaacgtggccgtcagggcgtaagtcgtagtcatccatgataaaaactagtttgacctagcgtgcaacccttgttctcctaagctgtgtttggaggtgggtgttgggaacccatatcccatacacggaaaacggagcggtccattaacgggtgattgattaaatgttatcttttttttttgaaaatggatcaatatgatttttttaaacaacttttgtatagaaacttttttaaaaaacaaaccgtttagcaatttgaaaagcgtacacacggaaaacgagagaggagggttgggaacttgctcttgcaaacacacccctaatctcttgggaaatatgaaaggtgtgaaaccagagaatcttttgaaacaagaagctatcccccgtggatcttgttgtgaaaattaaggaatcaagatatcttggacactggcgggaaccaaacgtctaactgagatgatgccatagaaggccgctttatccgtaaatatctccttgtttttattttacctataaataacactcctatactcaatgaatggacacgttgtctttcgttaaaaaaaatctggtgtgcaactgggaattaggaattagcctgtcatttccagccaaatcggtagcatcgtttaatgacaaaaattgacctgaccgtcagaatcagtaactatgtgctaatttattaaatcacgtacagcttttcacagaccaaagccctcctgaacttttctaacgaggaaaagtaatagacctaattaactactagtggtgtaatttaattatactgtgctgtagttaagttttcctttccatcatgtcatgacgtgtgtgatttttactctggtttactggctactgctgtcatattatatcactatcgtattgtcataccttgatgcggtgtatcttccagaaaagaagaaattagatgatcacttcgacgacaagcttcgtcttgatcttttctttttggaggaaaaaagagagcaagttttgtcttgctgatccaatcaacatcggaatcacgaaagttatttctactccaatccatagtacaagataccgcagcaagtccggggaaaaaaaaacaacggtggcagagatgtagggatgaaagcaatgattcattacaaggttaacaccataaataaaaggcagtagcaaaaaaaaaaaaaaaccaccatcacacaccaacaacatctatacaaaactcagaaaaatactagcatcggaccgatcaccgctaaatgcgaccggctgccactagaccaacaaaaaaaagccacaaaccgaaccggccaaaaccaaaatctgacagcaagcactgcactcaactctaggtgagagagaagatggaaccgctctcccccacaaggcctgccaacatcaccaatttgcattaggtagggcgttgccgtaagaagacaaacatttagagagagcacacacaagctgcctaagagaggtttttgaggggggacctcctgacgacgtcttcaagtagaaaaacgacgatgatcaccaactcctcccgctaccgccgccgccgccacccttgccagccccagattcgggcgcacccacgccggatccgtgggctccaccactgcctctgtccaggcccatgccgtccccgccaccgccggtgctgtcgtgtcgtcgccatcattggcactaaggctgctgcacagggagacgacttcccttgatggagggccaaatcctgatagggagcattggatctggccagaggggcacgagatctagcggctccaagctgccatgccgcctatactccacgctctctgccccaccaccagcgcctcctccttcgcctagcctcctaggtcggacaacgttgtgtcgcccctagccgtgaaccgttgccttgctccgaggcgccggtcggtcctctccgctcgctgccgaaatggcaccaccgaccttcacctgagtccacccacgccggatctggagaggaggaagttgtgagccccgttgccgccgtcctggcgagccaccagcttttgccgacacttcgctcgagcagcagcgagggaaggggtgagaggatgttgggttgcggcggtggctagggttgccgtagccttagccgccctctctgggaggagacgcgggggcattggaaaaagtctgttagcccaaccatagttttcaattttctttggggtcgaaatacaagcccccaagatgattcgcaaatttcacagaattagataaaactgagtttgggagatctctgaattttgagcaaataaattcgaggaaaattcaaagaaattgtgaaccctatccatcggcgaaggtcctgcagtatccatgcatgcctggtctgtatatagaccctatctaatagttacttccccgtcataaaatacaacaatttttaaccttaaaattttatgttaaaaatataataatttcttcatctacattttcttttcaaacaaccacaacattattcccgcatttaaattttctactcatctcattttctcaaccaattacaaccttaccccatttaattgtaccaatttcttgacacgtacccgtgtccaaactttttatattttagaacaaatataatataaaattagaaattagtcttagtatagccccaagttgagtatagcttcaccgctaactgcttatcggaagctctttagctcttcaaaaattagaccgtagttaaattgtctgaaccgtaaatctcccctcttcggcttctgccccgactagagacatgcaaaccgatcggcgatcgaagcaattaccaccacatcttccaaacaccaatgcaactacgcaagttggccaagcagcgaggcaactagccaagtagcgcatggacacacgcagcataggatggtcgcatgtaaacactgctctttttctttaaaggtggggacgtggggtgtactctgaatgacggcagagaacaaaggacaagagatcacaagcaagtgtttttccaaagtgaatgaccactgtgctagtcaacatgtactccatatatactatccgtgttttaaaatataataacttaatactaacttacaatataacactatgaatctagacatatcattttcatgtaaagatgtgtttggttggaaagatgtccctagataggtgatagcaatccaacttttgaaggtgtttgattggtgaacaagggtagctataggacggttcgaagaggaaatattctaaaatacgttgaatgagtgcatccggccaaattaaccgaatgaggatattaattttgatcattagtaattaattggcgacaattattttttttaattagtaataacttttcaaaattaatgtcaaggagatataattagtatagtttatggtgaaactaataataattaacatatgttattattacttactagtttattattttcctcctatccgttctataaaaatttggatagccatatcaactcaccaaataaaaattggaccatatatcccaaaaaatatgaattgttatatcctacctaatcttaaccatgaacaaaacacaccataaatttatgatactgggttctatgtctatttattacaatatgataatattattttttttgcgatgtatatgataatagtatatattttgagcagaaagaaagtacttcctctgtttcatattataagactttctagcattgcccacattcatatatatgttaatgaatctagacatatatgtgtgtctatattcattaatatctatatgaatgtaagtaatactagaaagtcttataatctgaaacggaggtgggactagataatatcacgcataggaatgggggccaccggccggattcctgaggaggaagggcacaaggcgcaacgagacggacgcggcacaggagcgacgagcaggacatgcgcccttcgtcgtccttcctctctctgtctctcgttgacgacaggtcggaatatcggagcaggtacgtacgtaaggtggcgtttttgttttgcccgttaattagcgtggttgacgcggcacggacagtctccggctccggccaagcgcaaacgaacagtcagtatgtacgacgatacgatcgacgagctgtacatgtttccaaaccgccagcgatggcgacagggacgacgaaatttctgcagataatatgcagctagctgctgtgcctgtgtacgtcgtcgtccgggcagtacatgtgcgagtgcgagccatagtagctccagatatgcgtgctgatgtgtgtcaaaccagtggcgcctcgggacaggtggtgctcccagtctttccatgcgggcgaaaaggacttttgcccgaccgcatgcaaaaagaaaaaatcgcgaaaaaaataaaattcaaaaaaaaaggaaaccctagctggccggccgctcccgccggccagctgcccagttgcgccgccgcccgcccacgcctccagatctgggcggcctgaggcccgccgccgccgaccacgtcgccgcccacatcgtcatcgaccgctcccgccgccggtcgccctggttccgccgccggccacccccgctgccgcccgccacccccacccccgccgcctccagatccaggcagccccgccgcctccagatccgctgcggcccgccacccctgccacctccagattcaggcgggaggaggtccgccgccaccgaccatgtcgccgaccactcccgccgctagattcgggcgggaggatacgcccatcgcccgcgtcgccgcccgtatcgccgccatcgtggaaggcccgaggtcatcgaggctgcccactcgccggatccgctgcccactcgcagctcccgccgccgtcaaggaaggctcgaggtcgccgactcgccgacgccgcccactcgctgaggctgcctactcgccagatccgccgcccccgctgcgcgccggccgtcgccgtagccgcagccactccctagggcggcggatccggtcctcccggggcggtgccgccggatccgccgcccgccgacgccatcgccgcccggtggcactctcggagagggagagggagaggagaaagaaagagaggagaggagagagagagggggagggtaaaaaatagaggagagagagacatgagttaaaaattttgaagtggtgggagggaaaagagagtggagagagatttggggtcgtatttttgcatacatagattttcgcatgcggctccttaagtggaccgcatgcgaaaatagttattaaaaattaatttaaaaatatgagaacttcgaatcaaattttatgatattaaatcaactcatataaaaaggttgccaaaaacaaagttgtagaactcgttgagatctaccaattttcttttggtcatttcttcatccaaatttgattggactatataaaatttgaactttataatataagatattcaaataattttttcacatagtaaatgatttcaaatagaaaagttgtcaacaacaaagttgtataacttatcaagatctacgacttttgtattggtcatttttttatatgactttgtttgaacagtttgaatttgaatttcaaaatatgacaacttcaaacaacattttaaaatacaaaatgatttcaactgaaaaagtcatcaataacaaagtggtataactcatcaagatctatatcttttattttggtcatttttacatccaacaaagtgatttgtaacattgttcacaaaatgtacatatcttatatagttgaagattatctatcttatataatttggggcttactctacagtgttttccttaaaaacaataaaatataaaaccacgttgtcaataattgagatatgtctagtggttgtagcacatgaaacaataattttgtttcaatttcctagtggagttgtgtgttgcaaataagccattgtgcaaacatagggaagacaatttcttgtgttttattcttataagagaaaatactacaccatgtacagtatatcatgtggtttccagttccttgatttagacatctaggtttgtgcgtgtggttggttcctggtgaaattaagaagatatatatcgatcaccatctcatcagtttgtctccatagcgcccatcgcatttgccatgcaagtcagggcaacaaatctcgatccactgattaattgaacacggtcgtagtagactacttcgtcgaaattatgagaaagcaaagcagcttatacaatacacaagtcgtacttgctgcctgtgccgtcgctaataggcaagtgcactctgctttttgtatagtcagcttttcacatatacaaaggcaagctgtacgtgtatcgacatcttcaattcctgttacaagaaagtccaaagtatatattcgaggttaagcatatattgtgtgttaactaatcttgatacgccggtgagaatcggatcaagtctgcatgggcatgacgccgttttgaccatcttttttgcgcacgaaccaagaaggtcgtgttagcttattttaagatcgatcgataggattaactgcttcggcattttctatgagcttatgttttttcctttaaaaaaagtaacatgcccttacattaggttcatattattaggaaatgtgttggatgtcgataattggataaagaataaatcatataaatttttttacctaaccgtttttatcggggaattttcttttttatgtgagaatgcatgttgtgcgcgagggaggaggacagacaactccgcttggaagtatactacctctaggttgataatacttaatgtttttggataagtctgatgccaaacttttaaatctgattttaatcatggataacttttaaaatatagagataatatgtatagattaatcttaaaatatatatttatgatattttgtgcatatattataatagaaaaatagtgatccaaattattttggcgactgtccccttatccaaaacgataaagtagtatgtctacatcagcgtgatattataattaatagtatgttagggtgtgaatctttcgtttttatttatttaagttttagttgaattggttaatacataagtaacttactatctccgtcccgaaataattgtaattatagattatttagaatatattaagagctaagaagaaaacgtatcttatacacgtaagttttcacttctacaaaaccatgcacatcagttaatagatattactgaaaatttcagaaaaaaaattgaacataatgtaaagtcttgtcgtcaaattcatcgtacacatagagagggaaaagtaacttgcgttataacgtgtgcactcgaagcttgtatccacagcatatgctatattataaaacatttgtaaatttatgacgtcaaacaaagtttgactgtgaggtatagtttggtgataattaaaaatttgagaatcagtacccaagtagtacaaaaggacaactaccctgttctaactgccctccatttcaaccgattagacccaggaccgtaaagcaggaaaaccatgttgttgggtaatttgctggactgataaagaaagctgcaaatggcatcctccccaggtgtagctataatgtaacctctcaatcagcattcctgtctagctatccttttcctccccggaaaccgcaacatactactccagtctcacttttaagtgtagtcaaaagcttttttcaccatttgaccttccattttatttaagaaattataaaaaataaaaaataataataagtcaagtatttattatctaataataataaaaaaattctaatcataaaaatattttaaataagacagatggtcaatcgtcgaacaaaacgggagactacacttaaaatatgagacgggagagtactcaacaaaactaacgcgacaacagtagcttttgactgcgttttcaacaaaccactcaagcaaccagagaagaggatcaaaaaccacactgatactaatcatgatcgatttcttcctcgtgttggctacaatgatgctgcatgctgtacttccaacttgtctccatttctcgttgatgccaaaatggcaggctttgtgcaatcaaaacgaaaccctctcatgatcaaagtacaccacaacaacactctagctactggctactcctatcactacgcaaaagttgttgtaccaaccaataaagcgatcgatctcctactaccagtagtccagcagcaacgaagcacaagacaagaaattactcctccacccaacgaaagcattatttattttactgaccaaaagatcacctcacctctcccggctggctccgatcgaatcccctcctggattttgatacatcgattggattggatatgatgcagctatccacgatggagaaactgtgcgtgttctctcgcgtgcaccgtcatcgtcgtctccatcatggcgtctcgccggcgcctccagcgggaggaggaggcgccggcctgatgtccttgagcacccccactacctgctgcatcgaaggcctcttctccggcgagtgcgccgtgcagaggaaccccacctgcaggcactccaccatctcccgctccgccaccgtcatcgttgtctttgctgctccactggtgccgccctcctcctcttcctctcttagcctcgcgtcgacgatgttgaggctctttcggttccggatcacacctcgggcccagctcaccgtcgaatcatcccatctcacctgtcctgtcacaagctcgaacaccagcacgccaaagctgtacacgtcactctctggggtcagctctccattgttactatccacggggtgtatgtagtccgatatcctaggctctaggtcatcgtcgaggaggatgttggttgggaccagattgccgtgcacaattggacgtcccgatgatcctgcccatccctggtgcaagaacgcgagccctcgtgcgattcctagtatgatgtggtaccgggtaggccaatcatctatggatttcttgtcctgctccgtggtgtcccacatatcagcaccggtttcttccatgtccatactacttgccggtagctcgtggagccaccggtagaggttgcccttctctatgtactcgtataggaggagtttctcctttcctgctcaaatgatgcaaaatttgaatttcaaattcatgaaaccaaggagttcaattgttattctatccatactttatataatatattgcgatgtaaaaatgtgtgaatttcaaaggattttcgttgaaacatactgttcaaatccacataaattaaattgttttacgtgaaagcaaaggaatttaattgttattctattcgtagttatatactataatacaatgtaaaaaccgaatgattttttagcaaaagaatagaagaagtgcagttagatcagctatcagttttcagcatgaagccattttcaaatttgtttttgccactctatcatacactgaaagatatgcttttggaattttgtctagactacacattctagtcaaagaacaagacaaattttagtggaaaacatgagtattatttctcaagtcattatctaaaaacaaattagttatattttttttcaagcaaattggctgacctgcaatgcaatagccaaggagcggaagaatgtttgggtgcctgagccttgcaagttcccggagcccggcagccgccgccgcgacgtcgccgtcgtcgccgccgaccccggccaccgcgccatcgacgacgcgcacgacgacgtgcaggtcccccgggagcacggcgcggtacgcggcgccgctgcggccgccgacgtcggcgagctgcgactcgcgcccgaaccccgacgtcgccgcggcgaggtcggccagcgtcagctccatcagcggccgctcgaccagcaccaccggcgcggtggccgccaccttcaccgcgcccacggcgacctcgtcgtcctcccacgccgccgccgccttcttccctctcttcctccggcggctgaagccacacgccacgcaccctgccagtgccatgaacgccaccgcggcggacacggccaccacgccgcagaccacgacgacgacgatgagaacgacacgcttgtgcttcttcccgccactggacggcgtcatcgtcgccggcgccggagccggagccgacgccggcgggttgtcctcgatcactagtgacgtcgcattgccggctctgaggaaggcggagcggccgaacttggtgacccaggtggagttcacgacgccggagaagttgttatccgatatgtccaaggggctgcagga

SEQ ID NO: 17744 - DNA, 10226 bp, Oryza sativa
gcggcgagcccgtcgacgccgacgacggaggtgaacccgttgcgggacgcgttgagcgacgccatccgcgcgctcgccccgagccgcagcgcgccgccgagccggttgcgcgacacgtcgacggcccggagcagcggcgcgcgccagagcgcgccgccgccgaagccgtcgtcgccctcgagggagttcccggagaggtcgacggtgagcagcccggacaggttccccagcgccgcccacccgacgacgccggcgaggttccgcgacgagtacgcgagcctccgcacgggccggcacgacggccgccgcggcagggggaagttggcgacgttcttgaacgcggcggtgacgatgccggcgtcagggagcggcacggtgcagttggaggtgctgtttcgcgcggccgcaggcgccgtcgccgcggacgccgaggtggcggcgacggcgacggcgaggaggaggatggcgtggagcatgggcggcatgggcgtaggcggaggagggggggggggggagggatgtgtgtgtggtggagcagtgggcggagacgagggagacgacggcttaatcaattttaatcatggggacctgaccgcaacatggattactgtagcacacgcggttagtacactactatacttgggctggctacttgcttgcttagctgtggaggttagcgattaatctggcttaatcatgacgggttactaggctaattactatatgacatgggcctcttcagattccagcccacaaagtttgctggtggaggctccttcgaagagcacggtttttgcgacgattttgggccgaattcagcccatctaggtcagctatttgctctaggtgggccgcgaattatctggaccgtcgactgaattaagatccgtgaggaggcatccagaccatgggcttcatttagcccggattagtcctcctacgatcgaaccgcaaaccattttacatggagaatatttcttccaatacccactaagaaaaaaattcattttattctcgcgaactatttcattagatggcttacccccccccccaccccaaaagtatttgtcggcttattttacaccccccccccaactatttaaaatggtttagtttgctccctaatgatatttctctctttttttctcttttttttctctatatataagcagggtttacttcttcggtttagccgatttgatcggaggtcaccgatacctcgaaatttcagtccgaaattttgaacaaaatttagttaaatttgagcaaatattaccaaattcacaaaaaattaaaaaaaattgaaaatttcggacgaaataatatcatatcggagcggtccaaaatttccaaacttgtatattagtcatattttgcaatgaaatttggtactattgatagatgcattataacttatctttgaatatttttacactttttagcaccatttatataggttcgaagcgatgagactgatttaaacattgaggttttcaagcaaagtcatggaaaaaactgaaaatattttgaaagttttggggagtaaaatgatttttttctagtaagtttgtaccggctcaatggtgtgccattcatactatctctttctataatgccactgaattttcaacaattttaatatgccattgagatggatagttttccataatacccaaaacatccttatagatctataagattgagaattaatttattctattagaagtttcaaaaacttatggttttcttaacctccttacacaacattgaagtttttatgtttcatgatgtcattcatgttttctacaagatatcttttgtggcatatgagaaaggaatcgcttacaacaaattaaagatatataatagcacaaaactattttgtgtagcatattaaagatgatttacattaaaaaggaacaacagcaaaagtattaacatataacaaacaaataatgttttataaaataaatagtaacgcaaaaattgtgaaacttatacaaacttctatgacgtgctaagaggctagacaaaagttttcaaaactttttgaatcatgtagtggggtcaatcaattgtcaactcttatatatactagtaatatgcatgtgccaacgctacgacttaatggcatattatagaaatgaatgataaacttgaagcatattatagaaagaaacaaagtcgatggtaaatcattaaactaatgaaactaaatggcatggagtagatctgttttataagacatttacaggaatcattctcaagaaaattcccacgttttgaaggaggtatgactcctgtggagtggtaggttaaatctataccatgtgttgcagttcacaaaaagacaaattttgtagtaacacaaaattgggagaaatttggtcttgttgtatggtgagctaggagcgagggcaggaagtttcaaattttgaatttaaataagagaattactaacattctactcaaatttgacatactcccccaaccatcctctcgcggtctcactcccaactataaatcatttagtaagggacattgctatctctttttctcaaatcttaatctatactaaacaatctaacaagaaaactattttgagacggagggaaaaatactttttctgcagaaaataaagagatgattcgccattgtatatatagagttgctcataagacacaaccagattctttttctccgtagattgaattcttatagtctcacatgttctttttaagtgaataaggggccatataatttatgttattaagtatttttcagatttttttttttaactatgtgggccacacacataaaacatattaggtccttaacctttccctgagtttagttacacatttttttcacttgctagctctgacagtactagctaggggtcagcaggctcaatccacgagcttggaatttttctacccatgtcgacaaaagactacaagaagacacacaaaatccatccccaagagagaactgagaaggcatccaaactagtactacacacaaaagtaaaagattagcaacaagctgcaaattaagctaccccatcactactacctaatcctgacatcctgtggatgattcccctgatcaaagttgaccttgtcccctccctaggcccatccgtatggttttaaaaatattccagattaatcatcttgttgctcacaggctagccagaatcatgcatcacattggatggccaattaattaattattttctctccttcctttctaatgcgtctatagggagattactaaagaagaaattaaaactttgtagtgtcccgggtagaaatgtttcgctctcgtcacatgacacgacatgccgtcccaaattctcattcagctatggtcatcagagattccggaaaagtaattatttggacgctgggaaagggatggcatggggaaaaaatgaaactttttggtgtgcgttttctataggtctagctagggttcttgtctggtcttataagctactactagctaggtcatggattttctagagcagctcatttctgtcgccaaactatacgttccatatgggtttgtttgtcacaactccacctctcctggagctaaagctttgccaaacagtttcagtttcagctccacctaaaataggagtggaggtaggtggagccgggtttaagctgctctataactctactccaaaccaaactcctggagctaaatttaggagttagagctttaccaaaggtgatggtaaattggttatactgtttcgtatcgccctgtctgcaaataaaacactacctcaataaaaccctctctgtttatttcattgggcttgttttaccatcttgcattagaggtaccgagttaaaaaaaatatcattaagtttttttttttcatatgagtgtccaaatctaacagcatagtagtcacaaatggagagtctggcacgcgaattattattagttaaacttccgtataagtagaaatggaatggtggttttttatatatgttgattagtcccagtggatattgctggtcaacaacttgattgacacggacaaacgtaaatacctgctacacttaaatcgatttgatttggaatgagtcggagctcagtgagatccttatcaaaggaatcattccaagttgtatatcgcgactaaacggtatatgaagtgttttaaagtaattggacaatttcacctaacatctgctgatgaatcgtcctcacggtgattcattttagcgattcgaggaccaaagacatgctcatggtttcattattccgatctgaattgaaggttgttcagagatcgagatccatgattaatttataaattcatgtgcatataaatatatatagtatcaactgttgggatggagttgttgagcttgaactaaaatctagagagaaggctgatctaactccatagacaattaattctacggaaattaaaataaaacctaaacatatatgtatatgtatatgtatatataaggaaatgttaattaattgcattcatgcaatgatatgtaatgtaaatatatatagtctgtgctatgtgtacatattatattttgaaggtatatatagaaacctggtactacagtgctggagcacttgcggggcatgcagggcattgtatgccaacaactccagaatatgccgcatgcatgtatgtacttaattaattaagaaaaataatttaatcgaaataatggttagctatattagcaaacagttgctagcttggcctcttaatttcatcgtttgttcgttgtattatcagtcacaaccaaaatttatttttttttattttaagttttttattatagtttattttccagtacagcagtactgccatttaatccactaagaacataaatgtaaaaaaaatattgtcttttcattgcttattttaattttttagtgacttggccgtagatatatcaaacatcagattgatctctacatgtgtatagtgtaaattcatcataagttgtcgttcaggggaaatgtttttctttccatcttctactggttaatttggcatttagctagtggattttcctacgcaattttgcacgatgcaagattttaagtagaattggatttccatataattcttagtttctatttccatatataagtacaattgcaataatttgtatacattttttttaaaaaaaagacttctatcacatagatacaattgtcgtcatttgtatactaatacatttgaaaaaagtttcatacgtactatagatacggttgcattttgtatacatctatatatatatcaatcaatctagctacatcatatataatctagatccaccacaaccacctggtgcaatttttttctccggttaaaacggtaatttataaacctccgtagtgaacgtggttgttcttttttttttttaccttgctctgaatataatatacagtagatacaataagcaaggctgttctttttttttctttagcatttctcgtttagtttattttttaactaaaaacatcactgctagctatctagacttcttttctcacccctttaatcaatttaagtccatgcgcaacgtaaatatgcctttattaatttgcttgttgcttgcccaagtactgaccaacagtttctccgcgtagagctagaaaagacagcagaaacgactaactaatcatcagaaggtgatgagctgagataacactttacactacacatgcggccatgcatatgtgtgtaatgatgcaacaattaaatcgatcgagctcgtttgttgtgttgtcacacaaatcagcagcaaattaaacttttttttttcaaatttccacctatgtaggagaaagcagatagggcatatgcaaatcgatcccatgaattccgtgacgacgcaaccacattctgccggcccattcgtgtgatcgttcgtccccttttaatttcgatcggaaagcacacactacgcatatgaggaggaagcaagaggcccccttttttgcatgcgtccccctgaaccataaacaaccaaccaatttgaccaaaaggggtctggctgctgtttaggtttaattttgatgtttactagttgattacccatggttggaatgtatgatggataagttggatctacagaataacagatggttggttgttgagtgtgatttatatatatacatgcagaattatatccaggcctacatatatatcttttgcccggtcccaaccgtggttcttttataaatttcgggtactctgagcatgatttacagtggagtgattttaaagtcaggaggtaccgagaggtactatattttatcgtgtaaaatttggtatctctcagtacctgttatactagaagctaggtaatttgtactagaaattggtacctcttggtacactgtaaaatttaatttctctttacagtaagaaacgaggaggacctatagtttgcccgaccgcatcgggatgcactcatgtgtaatccttatccatggtttccctgtgtgctatgcttgtttcgtatttaaatctatggtattaattgttgactttatttgttcaagcttttaaagctctgcccttcaaattaatagctctcaatatttagtttgaagacaaagaaaccatatgtacatattttccttttaaaaaaatataagcacttttacaatattacaattttgtttgatgttattgttatattctaaaagaaaaacagaggtcaaagttacacaccaaaacctaataaagtatatggaggtaataaatgttttttttaatattgcgcacacatctaaatattgtttaaaggagacatttatgcaaactatatattgtggtgtaaccagacatccacctgagctaggacagtgactagaagagaacatctgcagtctgagagtatatacgtacgtaggatatatatatgttcatatccggaatgaaataaatacacatggacctgtcaaacatttgttcctttttagctagctaatagctgtttaaacaagcctgtcaaagggagcatgcagatgcacaggcacaggcaggcagaggtcaaccaccaaacgctttgtttttgtgtcacggagtgcagctcagatccacacgacaagggggtcagtgtcccaagcgagaaaactattagggcaaagaaatgcttttggaatccagccagattggcagattgggtcacatgaactaaccagaggctagctcagctgctcagctcagctcacactcactcgtgcatggatgcatgcaaaacctaataggaaagcaaaaaaaaccaagaaaaggatctcactgctgctatgtaaagtatgcttccaccatttagtccatggtcaccttcaccaaaagctcttgtctttagctactaagttaattaatttgtagcctttttggctgttgtaatctgctttaacctgatgtgtagtttccctctctctagctagcttagcttctctctctgtttgtgtgtgtgtatatatatgtgtgtgtgtcctttgcataggtgtgcataccaaacacaaggacagggtcaggattatattgaggatagagatataatttctagcttggaacagtgtttcaaaaccagtcaatgtaggaggagaatgcttgtccaattccctcttattttattaacacatcattagccagtagctagcttgcttatgcttcttccccatctctccaccagtactactacatatcattgcttccctcatttcatccccttcttccttcccctttcctagctattccacctgcacgcgcgtacgattccgatccagccatggcagtgtagatcgaaagagatcaagtagaagatttggtaagatgcttgagaggtagatagctacctagagaaggctgatcagcatcagcctgagagagatgaaggagaaggaagtgctagttgagattgttgaggatgatgagctgaagagatcgattggtagaaatcagctggacctcaacgaggaagttatggatgtcgagagcgaggagggagaagtcggcgatgatgaagatgacgaagatgaggaggatgacgacgacgacgatgatggtggtagcaccaccgatgttgccggaagcaggagctccagcaacaacagcagcaccaataacgtttcagagagcaaattgaagggcgacaaggatagcggtggcggcaggttggaggggatcaacggcggagagcagagggtgccatcggtgcggcagtacaaccggtcgaagctgcctcggctccggtggacaccggacctccacatggcctttgtccatgccgttgagaggctcggtggccaagagagtaagtagcctaaaaacttcatcttctttttcttttgaaacgagcaacaccagatagtgcgatgtttcatattaacatagcagaaactgctagaacttttatcacatggtatatatgtatgtgtgtagctgcctgcatctcttgcaattatggattatttgcttttcttctgagtcctaaactccaatttcttgttgtgcttttattgttttctcaccgatgatttgcatgtgttgatgtaggagcaactcctaagttggtgcttcagatgatgaatgttagggggctcagcattgctcatgtaaaaagccacttgcaggtaaatgatgctctaaagtgctctagaatttctacaagttaaagagctagattcttaattcgtagtcgatatctacctcgtatattcgcaattccattaattctcatggattaattagcatgcatggattccaagtttccaactaatttttgatccattaattttgtttcagatgtatagaagcaagaagttggatcacgagggtcgccagatcagaggagccatcgcctcaggtttaataactttcaatcatcatgcatgcacacaccaattctctccacatctctgcacatcaatttatttcattactctcatctttttctcaagaggttgtacattttttttcatgattaattttttgcttctcatgtggttttgcagtgttctctccaatggatttccatctgatgagaggcgatcgacgcttccacgacatgctcctccagcgagccgccgcgctctcctcctccaggcaggagcacggcggtttcttctcctcgagaagcggcggcggcggcggcggcctaccgccggaggccagccggctgtacggactcctccaacaccggcagtctccggcgatagcgacgatgcaaacattagacttcaagaacagcagtttcaggtaatcaaagtgccttagctaagttcgtatcttctctgccgagacgtacgaaaccctaatttctgcgagtgtgtgtggtctctgaatctgaaggaaccaagagtggtcgttcagcttcaaccaccagcggaaggagacgatgaatccgtcgtcgtcgtcgtcgaccaccgcggcgatcaggcggtggccttcagccgccggcgcggtcgccgtcgtcgccggcgagcgacaaagactagcggagagattcggctactacaccgggaacggtggcgcgtcgtcgacgtctctgccgctcatcacgagggccgccatggcggcgccgccgccgatgtttgcggcggccgtggcgccgccgggacgtgatcaccatcgtcttccgtttggatggcacgccggcggcggcggcggcggcggcggtaataagaacaggtcgtcgtcggatcccgtggtgatcgatgaagccctagattcccgccgcctcgaggttcgtgcatgccccccattcgtatttatccatgcatatcatcttatcattctccacgtcgacgaacgctgtactccgtttattccaaaatatagcagtctaaaaataaattagacatttcataaatttcatatactcaatactcaatgttcaatttattattattttggaacagagaatgacaagcatcgagtcatttctgaatctctatctgacacgcgcgcccatttgacaacgtaaactaactaactttttttttatcacgacattgcatgtgtggttcagcatcagcagaagcatgtagaacaaccaaggatgactccgacgacgacgaccacaccggccggcaagcggccaccggagtggtcaccaccggacctgcagctcaccttgtctccgacgaccgcccccgcggccgcagacggcggcggggccaagaggagcaagacgtcaacgacg

SEQ ID NO: 17745 - DNA, 19772 bp, Oryza sativa
cacacccacaccccaagtgccttccaaaaactgcacactgcaccatgcaaaatgacagcaataagattgttaattaattttaacctcttgtccatctctctacccagtagttttatctcagtacatagatatatatgtcatggtcatgcttgcttaatgcttggttattgtcttctagggagttagtctgcatgcatgcctctctctagatatgtatgcatgcatgatcaaatcacttagcttgttcttttgtgacagcatctttgggaaactaaaccatcacaagagatcataagtatcagtgtgcagaagttccagttaatctaatgtgccattaatttaatatgtattaaattgtttactttttcgatctgtttatctataagttgtgcgatttttcttagttgctagtcacctagactggcgcaatgtgtgtagcctaagcttacacaattagtagctcaaactttagtataaattcactacaccatttcttttacttttattttcctggataaattacatgcacttttgtgcctaatttagtactacttgtttttatcgttttgcagtcgtaagtatgcccaccaggcaccagtgtataattttcaggtttgacactttagaaattattccctccgtgttgaaacattttttagcgtttgtagacatacaatgttatgacatatatattcttttttataagtgtctgtagacatttctcacgataaaaagataagtggtagatgaatagctaatgatcaatcactcaattcaggaaaaatgatgtataaaggccatcaaaccttcaaaaattattccagttaacacttctgagaaagcctctacaaaatatttaaaccattgtcacttctgagaaaccattgtgcctccttcctctctagctgatacttttctgttttgagcagcttttgcttttccttcgaatttgggtagacatgtgggtgtgttagcgcttcttgctagagcaatggctttgtactatttaatgggctgattttaggtccaatattaatatattgaacatttatttcatattttaacatatatttcatattaatcaacaccatatcaaaaattcgtatgcaaaaattttacatgtcgaaatgtttgtatgtaaagtttatttatataaagtttttatacataaagtttatacgtgtaaagtttctgtaaaaaaaaattatgtgtataaagtttttaagtagattttttttaattatgtactagaaagtttctaagtggaattttttattcatctaggaatattaccgagtagattttataatttggtaaacagtgaacttttttatctattccgagaagaaattctgatgtaattacacaagatgctaatctataagtgctattcagatataactatgcggtaatggagcatcacatgcaagcgtaccaaaaataaaaagatccatagggggagcgcccgttggttggcctgctcaaagatgtgggtgtgctggacggttcaggacatggatgtcgatgatcttgcgggctgcgagaatgtgatcgatcgtgtactaggaggcctacaaatgtgttaaacatgagaaataagtctattttgcctctgttgctcctgatttaatcgcctcccttgatgaggacatcctagctacacacgtacatcaacatgacgtaaacaagggtgataatttacgtcgtacatcacatgatgaaaataaagatagcgtaaaccaagttgaaagattatttctcagcaagaatgatcatgcattccattgtccaattacgcgcattcgtactaggaaaatacaacaagagatgaactcactctttgctcaacttaacccaaatattagtgagaattttatactatctaaatgctctactttgtattgctaaggtttacaaccgaagacatgatcactacaccaagaaagatgagttacatcgaggacgacaagggttacgccgagtaggaatcaactcatatactaccagcagctatttacgccaacgagaagataatttacgctgcaacaagtcaacttccaaggcttgtgtagcctagccaatcaaagagatggggtgcatggcatacatggttggaaagaggaccaagtctagtttccaatgcaataaaccccaccttgatagcattttccaatgaggagttggactattttactgaaggctacgtgagagctgaagggttgtgcacgaacccgagaaaactctgagcattctcatttatgttagccttgaccaccagaacatgacttcttatgttcacgctaagctaggagggttgttcctagtgcaaatacccctccattatatccacaagagaacttttattcaattgaaaatctcatgtatgagagattgctaaagacttcataagtgccttacctcctttgtaattgtgagtttcttagaacttgtgagaaggctcctttggtgccccctaattcgtgcttttggctttcggatctcttgtgtagattaatcctagattatggttttgtgattgctcggtttgacgggtcatagtccaggaggctttagatcattctcaccatcaccacttggttgcatccaactttggcacgtgtaaaactagttatcattttgctgctcgcaacaagttatcctcgaggtcacggtttatgccggtgccacttgcttcaatcctactgtcgtgaagatcaagccacccctcacgagtgagttaatttgcatccactacaggagttctgggcttctgtgacgattacattatgatgataacagcctgtttcctgtcactgcctgcctgcagtgacgaaatggctgtcatcacaaaaggtgagtcactaaccagcttctgtgaccaccagaggacatcgtcattgatacaatgacgaaagttctcctgccattgatgaatgacgagacaaattcgtcataacaaattgaacccacgcgtatgatgacatgtgatgttgcagatgacaaggcaggtgatgtggcaaatgacgtgccaattcacattcggcccatatagcatgggcttttttattttcaattacaatcagcccaattggcccatatattttttgacccaactacaaatttgcttttacatttttttcattatagcccaatagtacaattctagcccatactatgggctagcccaattaaaaagcaatcacaaaatataaaccataaccatttgcataattatattataatcacattccagccataattaattttccagcccatacaaaagcaagttccagaatatagtttccaacatgttccatacaaaagcacagaacatgaatacaaaatgatccatccaccattgaactacacaagtcccagccgactaccaaagttactacaggtagtgccaagttccggcaccaaaaaattccacctagcagccactactaagtctcagcctgcatcttgccaatagccagcaaaaaaattccaccaagcccccactacacttttggactgcatcctgcagcagccaacaactagtgccaaaaaatcctatgttccagcaaccaacgaaaaaaaaaactccggccaccaaaagcgccaacttgcaagcaaccagcagctagcaccaagttctagcagcaacatacaccatacaatagcagccacatacaccaccaagttcaactacactaacaccagccatcaaattccaagctcatccacctcattcctgccatcaaaaggtgcatgttttcagttgctggtgaataaaaagtccattttgtttggacttggaggcaaacaaatgaataaacagtgtttaaagagtaataatccagcaagtaaattgagtaataagtatcttgatatgcctcttttccggcaagtccaaacaaatggatcttttctactcacaactaaatccaaacaaatggctcttttgcagctaataatccagaaaaaatagagtatctagatcaattaatcaaatgactcttttccagtcacactaaacaatatctaatttcacagtaacaacaactataaacaatccagcaagtaaattgaaataggcagagtaataggcaattttgatacacaccatgaacaaaaaattcagccaccaatgaaacagtacctgaggatacaagtgcacaagagacaagttaaagctttgtacctgagcatacaactagcttagggaggactgatctgaccctgtccaaatgctatcatttgtcgaaggaggctctgagtatctgctgccatcttcctcaggctctcaatctcctcagcttgtttttccactttcgcatcagattcttgtgcctgcgccttcaatctttcaagctcctcctgaaagtactgcagactctagcttctttgcatctagttcagcttgtatctctttcatcacattggttgtcttggcagcgggctgctgaattccgacgttgcgcaaaaatgtgtttgacttcggcaacactttggaaacagcttcaatagaagtcttagcttgctgcccatcttctactgatggtgaagtgagggcttcccaggtatgcatatcctcctagcaatcaaagtagtttcagttttgcattattatataaataaaggttcattgcataaggtatttaataaaagaaggaaagaagaggtaatagcttagtacttactatagctttcttcacaggttcactaaaacctttagttttgctacaatgcaactccttaaagagatcaattgcagtgggctcactgtctttgtatttttcttgcttctgcaatgttgagagatggcatgagtaatggttatgttaaagtacatagataacacaaaaacatgtcctccagaacaagcattccagttgacattgagtctttttgttaaacattgacagtggttgccatgtataaacttaattgatgtcaccccaaataagtataagcatgacaagagcaatcaaaccaaattgatacagatttatggataaaacatgagcatatttttacgtggtcaaagtgtgagataatatgctactctccctactaaagctttaaatcatatagcattatgcagagccactatcaatatgcagatatatatctccactggatctgaacacctccatcaggaaacacaaaaactacatccaactagatgacatcatcattttttttcttaccacgacataggcatgtgcaatgtaagaccgagatccggtacgctgttgaaactgaactttttcacgattcagttggttttggcacatttgtcctgcacatgacacaattacatagcattagtaatagaaccactatgcatctgtcatttccatgcaacatcattttcatttgttttcgcaagtcactattacattaaaaatgcaaatagagctgatccaaacagagctataaactggactatggaataattattttgccacctgactatcaaatttatgttgatgtatcttaggaagctatgtggtttaaaaaactcaggaagattacatgaattatcttatagtcaatctgaaaactactataataaatctagaattatcagatgtagctggcatgttccaattcctactgacagattcaaaagatctcaaatgtacctcatatccaatatgtgtatatccagccaaacatgactttgtgctcgaatccaagtaataagctcacacaaaatgaaatctgctaaacagtaccttgtgctctgggcttgaccacatatctaccaattttgtccattgctcatcggtcatacacttcaagggcgatgtagtcctcacttgattagcaggtaccccatcaaagtacttctttttgagcctatacctcatatggcgtgttccacaccttaggatgtcttccattgcagctattacaggatcgctgtggatatcaatggagaattttccctactcatcaaatagcataacattaagcttcaacaaaagtagaaagtagaaaggaactacaataattatatgtaatgttcgatatggctaatgtattatttcttaaaggtgcacctagttgcaccttgggcatctagttttatttaaatgtgcatctatttttacttatataatgctggcagcacatacagtagcattgattcaattagtggaacagagccttaccttcagtttgccctttaagttatcaagttgactactatcattcttgtagtctgtccaacttggatatattggtatatgctgcctgattatgatcccactctctgaggccagctttgcagtttgcataggagcctctggcctttttttcccttccttgacaatgattggtatcatggtccctaaacctttgcttatggaatcaatctctttgcccatgctcttcccccttgtctccacttgtatactgctagtgagggtgcctaacataaaacatttacaagtgtcaataaaaagatcctgcacttgatatgaatgaagcatagcacatataaggacaaaagaacaagaatccaagttacttgccttgttgagtagtgctcaatcccattggctctagttctgtacttaaagtgaggttgcctaacaaaatacattattaaacatatgttaataagaagatcccttcacttaatatgagtgcagcataccacacatattgacaataaaataacagtagggtagccacttgccttgtccagtattgttggtgtcaccctgattctggtttgcagacaaatcaggttcgagtccaacctctgtggcttcaatcaggctagtggtggacacttgtttcatagccctttgcctagtgcatctcattgtttcttctagattttcaagtgctagcactctcttagatgctcttcctgttccagttgtgacacaatcaccagtgatggccacatcttcccctagtaacaaagcctcacaaagcaaacaaagacatgtacaaataagttgcagaaacaaagtcatgaaaaacttccttaaatatccactgcgaataaatatgtcacagaatatcaatataaatgtaaaattcagaatgcaaactcaacatatctaagacctaatcttacgtctttgacaatagtttccaaaaaaattgcctaactatgccggagtccatataaggcaggggctaactaacaatatatttgtaccaactgtacacgtaagggatagagtactctcccgacagattaatcatatttttcatactctatgaccaaccattaagtttggattcagtgctatgaaccagctattggcacttaagcaatactgcaattgttcaacatgtttaaccaagtagatcaaagaattcatatgcaaaatataagtggcatctaaactacatcatacatgtattgaatctcactaaacacgcatagctcagtcaattagagatattgattagtagaagagtttagtactagagttggtacctttgactttttgccaacagctttcttctttgcaactgaactctggaatatttgtgctagtttacggatacccagctgattagcaaatcgattgttcctcatgatattccaagccctcgacgtgcttaagtccatgtcttcctcttctgcacatacattgcaattatatttagtgggtatgaaattagttagaaacctatagtccccctacaccaccagattgacaatttggaaaattttaaatcgagaaaccgaaaatcaccccacgcacagactcatctcccagcgcccacctcccaatccagggccgcccaatccaagcctcgaaaccctaaggaggatgagctgagaagtacctagcatctccatggcggccgcttcatctggaaggaccgaaggatggcgggaatgtgtgctgttgccaccaagcaccattgtcttgctcctaggagggaggcaaggggttgccgcaggatctggaaggacagaaggagggtggggaggcttgttcttgccgccgagcatcttcctcccaggcgccatcgtcttgctcctgggagggaagcaaaggggtggccggtttggaagccgagcaagatctgcaagaaggttgttcttgcccggcggctgtgcagatggagggagtgggaatgattctagggttagcttcagcttcacctatatatgtgtcacactcgagtgagtaaaagtcctaaattgacctcatttgggtatgccagttcaatagctggtatgggcataaatgacttttagcatcaaaaaaagtggcggggcaggcattttgatttcgcggtaacggaggcgcacacgggatgtgaaaatttggcctctttgattgcagcacataattttgttggataagattatagctaatcttataaaagtttataagatcttgtgttaacaaatctccaatataaaatcaactataattcttgagcttttttttacatatgttacatcctcaaaataaaaaaagttagggtttgagttttctttttttacattcgagtgccatttcttaaaacaggtgtaactttctcactgcagcattcattggcgtcggcggtagcagcgctaagaaattgtatttgcctactactccgaccttctatgttcatcggcgtcggtggcggcggcgctacgatcctgcaccaatcatgtggggatgttgtgcctcgagctagcacaagaaagacggctctggccctggtagccagacggggcacgatgcacgacggtcgatggggaaggtgatgtgtctggcggtggcagccctgcgcttcgaaggggatttggttggtggtgggcatcagacgtatcagcgacgtatcgggtttgttttgattatatggaaatcacgaaattaatacgtatgtatcgggtttgttttattcctccttctcgattcctctttctgtttcctcacgcacgtgcccaagcggacggagagccggtgggtcgaggcgacagtcggcgcggcgactgcggaaggtgacgggggcagaggaggtggggccagcggttggcgcggccacgacgggcggtgcggcaatggagaagggcagcgaggcagtggggcacgcgagaaagccccatccatagtgatcggccacctccgcgcatcccccacccgtccttgcatacgccgtctcctcgcatcccccactcgtcctctcatcttccgcctcctttcgcatccacatctggggtggcatggctccctcaaagaaatcgattcaagcgcgccgacagttgcgcgacgctactggcaagttcagcggtcgcgtctctctgggaggggtgcgtggtgcctcgacatcggcgaaggaaggggcgcgccaggagctcaaaaaatttaagtaattattaattcttttcctatcatttgatttattgttaaatatatttttatgtaggcatataattttacatatttcataaaagtttttgaataagacgaacggtcaaacatgtgctaaaaagtcaacggtgtcaaacatttcgaaacggagggagtatatgctaatttggaccttaatggtcagttatggtacctggtgttctggatgctgatgcattatatatctataatatatgtatgacttgtcagcaaatgtgtgatctcatgtacatttgttgaaaatcatattgctgctctcttttaatctgaatttcctctccacttaaaaattgctgtcagcagatatattcaaaggagtcccctcatacatatacttcagaaaagaacaaatgcacaaaaacacaaacatcaaatattcaaacaacatcatacacaacaatcaaatcctcagatcacaatttaaactgacagccatgttctaacagcaggttatggtgggacttagccatacacagatattttactcaaaatcactatattcaccatcatcatggattggcccttcattttcactgtcatattgtctcacagtttcgtcagcatcatcttcaaagccattttcttcaacttccaattccctttccctctggatctgatcaactagggaagcctgaacacaaataccatcttcataattgctaggctgctcgttgattgaagctctctcaagatctgcaacctgaaaactagtattttcttgctcatcatcttggtatgacaattcatgctctgcctgggccggcaggtcatcattttcttcttcgggcacattccacaagtgcctatgggaaaatttttgaacaactttccaaggctcaccatgcttgttatcttctaagtagaaaacctttgttgcttgtgtggcaaagatgaaaggatcatccttgtaccagcaactgccatggctgacacttttgaaatggccatcatctttaatcctagacttcttgctacaagtgtcaaaccaattacactgaaataaaactactgtcctttgactgttcgaatcagagttgtactgcaactgaattatttctttcaactgaccatacaagtctatatctcctccattatgtgagccctcaaccatgacaccactgttttgtgtttttctacttctctcacggtccaaggtgtgatagcgaacaccattaacaagacatcctgaaaataaatgaactctaagatgtggttcacttgccaatgcatataggtcttcattgacttcttctccatgcacaaattttctggttgcaagctgtaccaatatattcagagaaaaaaattcagagaataaggtcagaaccaaaactgattgcaaacagtcctgtatcctgcaaaatgaccaataaattcaactaggagctaaatgacttacgtgtttattaaaccatcctgcaaattccttagcaagagccctatcaacatcaacattgccagcactctccaactctgtcctgcatatcctgcaagtattgcgcactgtcatgtgaggtgtaaaaaattacagcatagggaaaaaattgattgctccaataaaagacatactctataaatggctcgacctccggagtattgttgaggatataccaaagcatcttgtcataatccttctcattgtacgtcatcctcgatgcaccaagaagagtgactccatgctggaaaatagataagccaccttctctcaaaactacacgctctctattcctgccctcacaattgtgtcgtgtgtcaacatcatcaaaatacctagagcaagcattcaagcactcgtttgcgacatatgcctctgcaatggacccctcgggtcttgccatgttcctcacaaaacgcttcaaagtaagcaacctacgctcaactgggtacatccatccatactgaaccggacccctaaggattgcgtcatcgattaaatgaatggaaaagtgtaccatgacatcaaaaaaaaggtggaaaaattttctcaagcttgcacaatattattgggatttcacttctcattttgttcaagacatctaccttcaatgtcttagcacatatttgctgaaaaaagttacctaattcagcaattgcttcataaatttccttatccaggattcctcggaggcttacaggcaatatcctctgcagaaggatatgataatcatgcgttttcaatgcctgtactttgcattcatcagcagaaatacaccttgataggctggaggcatatccatctgggaatttcacattctttataaaagcacaaaaagcaagcttctgggttttagtcatcgtatatgaagcgtgtgggagagtgtacgaattcccatcaggcttcaagtgtaaatttttcctcacacccatatcttccaaatcaagccttgcattaattgagtcctttgacttccctgtaatgtcgagaaatgtcccgagaagggcctcacatatatttttctcgatatgcattacatcaagattgtgacgtaacttcaaatttgaccaatatggcaaatcccacaaactcgcccttcgcttccagcattgaccttcttcttgtctctttctctttttgttatcaggatggttcccaggtttaacatgtgaaaccctcgccaattgctcattcagctcatccatagtaaattcctcaggctgctcacgttcttcggtctgtccatcgaaaaaaaattttgtcctccaaacatggtcccgtgggagaaaacgtcgatggccaatataacaaatcttgttccttaatcttctagagcaaggatttttgtcacaacgaacacaggcatagtaacctgtagtaactctgcctgaaagtgtgctcagtgctggatagtcatgaatgcaccatataactgtagcatgaagatcaaatgatttcttagtcagagcatcataggtagggacacctttccaaagatctaacaactcatcaatcaggggttgcaagaagagatccatatcctttcctgggcttgtcggaccaggaatgagtaggcccatcatgaagttggattgctccatacattcccatggaggaaaattataaggaataaggaatactggccacatgctgaacgaggcgctcatcttcccaaatggattaaacccatcagtagcgaggtcaagttggacattccttgcatcttttgcaaaccagtcatatttcctatcaaaatccttccatgcctcgccatcagctggatggctaagttcattgtgcactggttttctcttcaacttgtgccattgtgcctgctctgaaagctttttggatgcaaacatcctttgcaaccttggaaccacaggaaaatgcctcaaaaccttgtttggaatttgctttcttgtatcttcatccttccatcttgaagcaccacatactgggcaattatccattttagccaactcctttctaaccaaaacacagttattcggacaaacatgtattgaatcatatccaagtcccaatgcacgaataactttcttcgcttcagcataagatgcaggaatagaacattttgggaattgtacacttaacaacttcaaaaaagcatcgaacgcaacattgcttattctataaaattacttgatgtgtagcaacttcaccacaaaagaaaatctggtatagggaccattagggtgtagttgctgtttcatctcttctaatatggttgcaaacttggactttgttgctggttcatggtcttcggctgtgtacaactcatgtaccatctcatggattcgatcatcatctgggtcatctttaggctcattcatctcagtttcaacattgcagccaatatcaccagcttcaacactgcagccaattatatcatccaatgcttctccatgatgtatccaattagtgtacgtgctagtcatcccataaatatataagtgagtctcaacttctcctttatgttgatgtaaccgattcaaacacttacgacatggacataatatctcctgactatcatccaaattagcagaaacaaagttcatgaactcagtgacccttctagatgttccttgctaaatagcctagtattcacccaacttctgtccatctgcgacacactgaaataaggcaataatcaaggaatcaagaactaaccaatcatcataacaaactgctattccttctagctttctatcactgaccatgactcactacagaacatagcattgaattttgattacctctgaagtcgaagaaatcaaatcgaagtcagccttcggagagaactggagcagtcaggctcgccggcaggccggctctgtgctcctacagctcgggaggttgtcgcggttgctggccatcgcgccgagcacgcgacgcgctggatctggcctagtgggcagcggccgaaagcgtggccacggggtagcgccgaccgacgagtagtgagcggagggctagcagctggcggagaccacgggctagaagctagcggagggcggcgctccggcgcctcgaccagggagctggcctcggcgcgctctgctttgctgctgccggctatggtgtggtgtgcggccacgggcaagggcgacgccaatttgcaatctcttttttttctcttcatccacacacaatctacaaatataaaataacaatcctaggtcacaaaaaacaattgtctcgactggttatcgaagtggatgtaaaactcctctagaattaagtcatgggttcgaacccaaagcttgcttcttttttatgttttcccccctttttatcctatataattctggtgcagcacttgttcatgggttcaaaacagtcaaaggtaaggcccatgtaatgcaggttcaaaccaacttatagccattttagttttttttttaagttttttcattcaatcataaaattaaacgccatatttctgattttttaagatgacttcaatctaaaatcctaaaatgagagactagaattgatatagagaagaagagtccacctaggacaaacgatttgtggtctagtagcaatgtagtataacaagattttttttgtttttaaaaaaatataatagttctatattttatgacgatatactattgtcatcgtgctatcgtcacagagcccatacagtatattgtgacgatgattatgacatagacacggtttggtcataaatagttgtcatcctgtgaacaatcgtcataaacagcctctgtttataacatatatgtgttctgtcatcaggtaatcgtcacagaagcccagatttgttgtagtgatcatccctcaaccataaacagggtataatgcattcccatcttcgaaagttgctgcaattagacttctttggtggctgagaaagttgttttttgttggcatgaccagttaaatatggctgactttgctgagtcagcaggtgggacccatatatcagtgacttcctcctcatctcatattctttctcacctcttccctctctctttctctttcctctcttccttctttcacctctctcactgtccatccgtcctgtagccactggccaagaccacgtcgcgtcactaccgccgtcccctctcctctcaccacccgccccccccatatccgcctcttctttacctgagccgctatttgctttgtgctttcccctcagccccactccaacccaccccacagctccatccacttatctcctcatcactatggatccgatattttgctatggcgccgttggcatctcgccccctcttgctagttgtggtggttgttggatgtggctgtcagaggtgtctcggtaatggtaacagaggatgagagaggatgttcatcgtgcaggtggatatggatgcattcccaacccacgcactcttgtacgaggcgatagtgacggtgacgtcgggtgtgggggggttgggggtggaggaggggagtggcgtgagggcggcccactgatccacatgtatctactccaccgtttctcacggctttttcgcacgaatgttgctggttgcatgccaccaccatcagctggcggaggctcccgtggtggcgacagtggtgctagagtgagttcggcatctcgccaccacccgctcattgtggctccttaggctgttgtcctccccgtcgtcagcactcctcgtagactccaactttggtgccaatcttgtcatcattatcatcgacactagcatctccctcacctaccgtagctcccacgaccacaggcttgatttagtcacgcttactcgtccccaaaccacattggagagcctttgctcgctaacaaaacacactggagagccgtcgcctcctccgacccgaaggaagctgccttcacccaagccatggacctccatcgcaagcgcctgcgtgtgcctcctttctattgccagtttgccggccccgcaatgaccattcccccctgcccaccatcaccgtggcactcgtttagctacggagggctccgccttgttgcatttgtgtgaggaagaagaggagcgaagaacagaagaggagagaagaattccttcctccaatccctaacttagcaagttaaccacggtcaacttaccacgtcaacaaaaactgcttcctgaaccaaagatggacgtcacactcggttttatgtttgagggaggcaattcaatcaaagatcaagagatgaggaaggcagaatagacttatagcaacagatgaaagcacacacattcaggcccatttaggcattgtcttcctcctcacaacgaactcacacgcggcggcggcccacggtctcaaatccctccccccgacgtgcgggccccacctgtcaccctctcccatccgtgcccaccgattcgcccgttccaatccgtttgccctggtcgctctctcgcatctcgcgcgcctcgtgagcgaaacgaaatccctaattaaaaccgcttaatccaatttaatcccctcgtctcccctctcctcctcctccctcctcactctctcccctcctctcccctcctcctccccccacctgcactaattaatcacgccacgagacgagatcccccttctccttcctcctcccaccgcccgcctcctcctcctcctcctcctcctccgccgccgccgccgcgcgcaggttgctatcggaggggagacgcgggaggcccccccctctcgtctccgcgccacccaggtcagccgccgcctcgccctctcgttctcttcatctctctcttcgcgtcctgtcgaatgctggtctctgcttgcgctcgcagcgtgggggccccgatccgggggggcaccgccgcggttggggcgtggggaaggaggaggaatggtggcgatggcgcgtccgcggggggcgttggtcaacgtgggggggcgagggttcgacgtcgcgtcgcgtcgacggagggtttgcttggattagggcagggcgagggcgcggatggggtggccatgctttgcgagggcgtcaacgctagttggtcaacccctcgatcgggttaggggttttaggttgcggcgggcggcagtcgagtggctgacttctaggttaatttttttttcctccgagaacacccagctttgctggatttaatattataaggaggagactggctctagtttattgatggatttcattggtcatggcccgtctgttacatcattgcttagcgtatgtcaccagcctaattggtctatttgagacgaaactagttagttttgagttttgacctgttcataaaggctatggtggcattttaacatttgctatatggcctcttccaccgaatgttggggtgataggtactatgattaatatgattaatggctggaacttggatttagagttttggcgccaaggggcttgataccaattttcaaacattggattagtgtacatgttcgtcaaacattgaagtgtgatcagatcttcaccttttatgtctctttcttatccttttgtttgaaatggaagttagtgtggagtttgacagtgactggagtctggtgtttgatagtgattgccttgaaaatcttagattgaagggagactggaaactttgaaattcaggctagtggatcccgctgtggttattgttgacatggaactgctgtagatatgtcatatcatgttcttgtttaagtgataatttgaatcgttgaaatggtgttaatagtgtgcttagtatacttatcggcttgtttccacagctcaccctatcatcatatcatgctgcatatactatattgctttttggtgaaagactgttctcaatgatgtttgtcactctgtgtaagtatgtttgaagtttgagctcagaacaacttttttattgttccactcctttgtaacaaactatttaaacttatacagtgtaagtatcgtgccgttgttactttttagtaccaaagtgtaggaatccaagtttttattacaaaaataagaaacaaatctgttgttcatattgtacaagtcaaatacaagaaccagtaatccatacagtggtggacccaagaaaattatgttgtgtgtgcatgcaagtctcacgcagaacacaacttaaataaagtgcatcactgtcatcaaactatgcatggcaagttatcattatgcaattagtacgcaaaaatgcaaataaggatttcaaatattgttcttaaacaaaagattcagcatttccatatattttatgaagaaaaacaggaagttgcaaccactgaatgcgagctgatcctaggaaaatttcatttgttttccctacccggcacccccttggtctgcccctgtccatagcaagaagccaaaaccaagaagatgttttacattaacttgttttggcacaaatttcaataagggtgtttctaccatgcgaaaaagcatggatagcaattgcttatgtgtgaacaaggatatatgatgtatctgtacaatatagctgttgatgtgatatttctaggaaaggtaatggaaatggttataacctataagcacctaagcgtgcgtgcgctattcaaccatgataatgtggagattatatctttcagctgggctagtggttggattcttctctggtcaagaaatatatgtatacagtattacagtctgtgttgttagtgtagctgcatggttgatgagtcgattttggttgtcataactgtgcacttagccacttactatgcccagcgaaatactcaacataataattgaatcacttttttgtgaatgagtgtagggctatattcttttactggactcatgatccttttttttattaatggcacttcaatgcagctggcgtttagaacgtaacatgtcattggcttttgactaaattctacttgctgttgaatatatactatctactgcagtttggcatcaatatgcagaagtcttctctattccattattgtgttctagttctagaataggtgctattgtataaattatatttacattagatcttttgagcttctgcattcctaaattataagtgatctcatgcttgattcaattggttgttttgctccattatgcaggttgaccttgtagaatgaatccataaaatgattctttatttcaacatatattggagatggatgatctgccggatgatcaaggacaatccgacgcacacccttcagatccaaattggtggtcctcacatgcggagcacaagctcggatcaatttctctgactaaacaggaaaggaattcgggttcgccaggatcttctcattgtggggaaggtgaccattcattatgggctgcccagacattatggtgtactgggtgtttatcaagtccaatacccaatggtttttattcaattattcctgtaagtgtgaatttcatacgaggcattgaattgttaaataaaaatataagtgactcatctgtacattttaattttaatcctcgttttaaaatttgtaggataagaaactgaaggagcgttttgacaccatcccgtctccagatgatctttattcccttggaatagagggattcaaagctgagataattcttgtggatttagagaaggataaaaaactatctgctataaagcagctatgtgcagcattggtaaaaggattgaaatcgaaccctgctgcaatgataaaaaagattgcagggttggtaagttcttcctaagattctctatgcaattgaagacaattgtgacatcttcactggtaaccttcagaataccacaagctgcaatcacttgacaattgctttgcaaatggtttacaaaatcttcttgcttgaaactattccattttattgtgctgcaaccttttgagtactacttgattcttttaagtatgtagtggattatatgttttcttgaaaatagaaattacaataactctattgatagcattgattatattcttttagttacttttattatacatttaaaaatttc

SEQ ID NO: 17746 - DNA, 1111 bp, Oryza sativa
catataattacatcagtgtggcattttaatgtgtgtagggcattccgaatgaagaataccatgaatatgatgactcatccaaacatatgtctgttgtggttatgctgaaatctgtggagtttctagttgatcttatgcgttttcctggacaactagttccattctcatccaaggctataattacatcacatatatctgcagctggagagagtgactcagctgattatgattcttgtgattctcctcttgaacctaatagtcctctgtgttcccaacggtatgcttgtgtattccgttttaatgacatgtgtgtcttgtcatggttccttttggcgattttgccccttgacacatatctagtattattgtattggtataaaattcatacagttccagatgctatgtggtcctgaactatgtgtatcaaatttgaaccagagcctggggtcatccctaattgcagtgtctgcttaaacgcgatatccaaacatgtgaaaaatactatctccattcatgaagctatagcatgttgagtagagataatactggtcttttccatttctttaggtttatgatctacctccattttgttcttttttggtgtacagtagcatgtggagcatttactgcttgcaaatattgtaggtgttggacagcaactactgtatgttatgtggtgtttttcgtatatgaggagtgagatgagaagaagcaattaccaccaaattataatcgtattgtcgctaggattagatttcaaggattaattttccttttaaatttacacaaaagatttgcttgttaaagattttgttaggagtttgtctggcctgcttctttttatataggagtgaaggcacgattgaatagagcaagcagaagttagaatctaatctctccccctctctgtttcctatgttccaccacggcacctgggaagcgagggctctggcctcgctcttctcgctcttctgtcggtcgagcacagctaccactgaggcattcgggccctccccagatcctaacatcgtagctatgagagttccaatttatcaattgtacccatttaatactacctccgtcccaaaatataagaatttgggctgcagga

SEQ ID NO: 17747 - DNA, 3363 bp, Oryza sativa
ggacatggcatcctattaccagccatcgcatgaaattaataggatgcaacgtcctcatcctagatggaacaactatgtcatctcacgggtgaatccattcatcgatagtgtggttttgtgaaactaaactaccaaaataaatgtacttaagtgctaagtgtcaaaatatgtgttgttttatgcaacttgaaccataaaacttgtagttttgtgaaatttactcttatgtttattactaaaactgaatcattatttgtgtgttcctctgttgactacagtttttacaacatttgtgtgctttaattttaggaaatcaaaatttttaattttttctgatgggccatattgccattttacgtgttttttttctttcagccaagagcaagatgacaacaataggtccttcaaagtaccatctctaagaaatatcatgcttaaatcgacaaactctatggagggtaaattgcgatggtgagtcataagatataacatatgctgctcggtaatgttattttatcttgttttcatgttttatttacttattgtgaagtacttatctatttattaatttcatgcttttatcagctcatcacacagtgaaccaaatgtggccaattccttctgtggtcgcagccggaggaaggttgtggaggaacatcaaagaactgctagctcaaggttcctattttcacccttctatctatttgcacgatatctgttgcatatttggccaaaaaagggggcccacttgtgtttctatcaatttttattcagatttcttgtttgccatggccattgctccatttctccaccctctggcccttaataaggataatagttatgcaaatttggaccattaatgaacatatctatatctggctacatgaaaattgggaagcatctggtggaaacatcaattaaataaaattgtggaaaccgctttacaaactatgtatagtcctaaaaaattcccaaaaccttaccataatatcacaccctgtaccaccacatattctcgaattatgaagtttcacccgtcaagtaacaggtgaacacccacaccctatatagagccttaaccacccttatcccttcaagtcttctgtcccatcacgcttcctcctccacacaactcgatctcgcccttcttcaagctctggcgagatctggatctccttccccctgtatctctcatgccgacttgagctccccagtcaccaccaactgagatctgtcgctgccgcccccctcccccccaccatccatccatcccatcttcaactccggcaccaccgacaaattataccctccggcaagatctgtctcttcgccgccaccaccagtccgttcttcaagctcagcaaaggtaacctctgcgcccctccttttccgtcctgcccctgcttcccaccactggtcgcaggtgctctccagcttgtccaccgtaagatgccgcccccctcgtgcccgatgctaaccctgctcaccaccctctcctagatcatagcgggtggcatcacaagtgcccctgccattcctgtaaacctgaatccccttctctctcctcatccccaacctgtcccagaatcctaaccctgtcctcaccgagccagctcaagaggggaggcggcatgcttgacttttccctttttggcacttccagttattagcaagtgatcgctaatttgctaattagggaagcttcattgcataaacccttatgtttcccatcttctatttgcacattctgttgcataattggcaaaaaaggggttttattgtgtttcttttgtttgtattctgaattcttgttttccatagccattactccaccctctggcctaaaatgtgcagtcaacttatgtggatgaaaatttgggaaacaatcaattcaataaaatcgtggaaactactccactgattatgtatagaagtttttttttatttaaaaaaggaaacattaccataatatcatatgcaggggagatgctataatacgatcatgtaaaatttcaagatcaaattcaaacatgagaattttcatttgctttgaagattcatattgatatagtttaagttgcatttctctcctttttgtagtccagagcacccattgtctagaacacggggacgctctatgcttggtgatagacagcatggagatggtgtagctgtctcaaggtacctcagtaagtttctcttttgtttaaatttgtttgaagtcatgaatcaagaaacaagcatattctgatctgtttatcccctctgatttgaaatttgaatgcaatgcatgaagcatcaagtgcagtatctatgatggtccaaatatgtcgagtaatgtgaaatacattaatagagtattaaagaatcctttgttctgcatgtagtcgctcgatgaacaattctggattaattaatattgggatcaatacttttaagagcgattacaaggacccaagggacaaatcagcttatatatgcttaaattcaaattttcaaaaacttaatgtggatccagtataagccgtggaagattgcttggttattttaaaacggaatggttccaatttataagttctaactgattcaactgttgttagttgtaattgtcagattccctagtttttttgagttcccagttgaaatttgtgctggcctgcgattctattcagaagaagcaaaacagtcattaatttagacccatctgaatggagttctttagacacgagggaatgaaatgccattacttttgatacttctcttattcgtggtatacatggtatctttcacatgtaggatttgaaatttgaacttcaaatataagctggtttctccttgatgttgcacttaaaggtaataccaccattaaaagtgtccagtgctgtcatggaaaacttatggaagatataatcagtgttctattatcttagcctcatatctttggaatacatgaaggatttaacaaagtacagtcaatacagtttctaatccagtacaactgttatcttcttgagttcttgacatgattttgtatgtgttgcttgattataggtcagatggcgcatcaacatctaatatgcgtagaggacggcgaagaagtataagttttacccctgaaattggtgacgatattgtgaggttggtaaacccgacctttaaccctgagcaatgatacaatgtggttaattgaattgtttattcatagttttgcccaataatacaacttaacaacaatagtaaaatccttgcttgcatctaaatactcaatggaagaaaatttcattttcaaagaaataatagaactataaaaattggttatttggacaatccaggtataatttatccatatcatgcaacctggtt

SEQ ID NO: 17748 - DNA, 4674 bp, Oryza sativa
ttatacaggaatcacctcatgatttcaatgacaatgaactacatgtaagaggaccagatgagcaagagggctcaagaaggcaagttagtaaccagaaggctgtgtcattaccttcatcgccccatcgattgcgcagtgatggttctggcctcagaggaccagccgagtttctgacagcagatctgatgtccacttggaataaggttttgcgatcttcaccatttctgaacaagcctttattgcctttcgaggaatggcatattgagttctcagagattactgttggcactcgagttgggataggcaagtacatggttcgctatctatattctgctacattcaggaagtccctgcattatgaaatacaccacttcgttagtttttatcttttattgaactttttagaaaatcataatgaatgatcaattatcccaatataaataaggatgttttaagttgaccttttagagtcaagaaacagcctcttggtagaatgtcattttaaaactgctaactcatctgaatgttttccagggttctttggagaagttttccgtggtatctggaatggaacagacgtagctataaaattattcctggagcaagatttaacaacggagaatatggaagatttctgcaacgagatctccatacttaggtattacatatagctttttgcaataacttccgttatctacaatattatgtcctaatgttattccctcttttttttttcccagccgtcttcgacaccccaatggtattgcctccacatacagtcctcattactgtagtttcattttccttttttttttgttttgattccattttctttgatgatcagattgttcttattgtttgaaatttaatataactagagatgttacctaagaatggttgtttggctttgaatttcagttatattattccttggtgcatgcatgaagcctcctcacttatccttagtcactgaatatatggaaatgggttcgttgtactatttaattcatgcaagtggccagaaaggtaagctcagttggcgaaggaggctaaaaatgcttcgtgacatatgtaggtgagcagatgacacatgctttactgatatttgttggcagttataattttcttgagtgtctagctcctgatacgtttctgtgaattcttgttgtcatgtctaacactgatctgattttttttccctgaaggggtcttatgtgcatgcaccgtttgaagatagttcaccgtgatctaaagagtgcaaattgccttgttaacaagcactgggcagtcaaattatgtgactttgggctctctcgagtgatgtcaaattctgcaatgaatgataattcatctgcaggaactccggagtggatggcccctgagcttattcgtaatgaaccatttacagagaagtgtgatatcttcagccttggagttatcatgtgggagctttgcactctgagtaggccttgggaaggaataccgtcagttcaggtaaccaccattattcatctctttgtacttttttcatttgaagtatacatctaacgggatatgctgtgtgcttcctcaaggtggtttataatgtggcgaatgaaggggcacggttggaaataccagatggacctctcggaagcctgatagctggtatgatttgagttatttcttactaaataaatgcccatgcgtttgcaatgggtaaacatgaaccttcttatatgtgataatatttttcagaaaaataaatgtcagtattttgttttcgttgaacacaccattcatacttttgttacatggatcacttaacagtttttccataattctaatattaaaattagccataattgacctttccattagaaacgtgttgtagaaacccaataataagaaaataataattggtggaaggactaatgtgtaatattaacaatttcaaggatcacttagtaaaaatattgtagcctacaatcaatggttggttgcatctattggtgctcctgctgtcattttctagacttgtattagtttcttctgtatagtaaaccaacatttggaatgatttaggccctgcttgtttcagcttaggattactataatctggattattagttataatctgaaacaaacaggtagattattatgatagattgttataatctataagccagattagtataatctgataatctcctctaaatgtgcttttttttagattattgggtggctaaagactcactacccttattctactataatccattgaaacaaacaaatcatagcttattctattatagcttattataatccagcttatagtaatcttgctcaataatctggattacaataatgttaagttgaatcaaacagaattcagggccttagtttataaaattagaacttgcatggacattttccttttgggatggtgcttgttgtgaaatttctctaccataaagctatacgagttaacaatctgcataaatcttttcgcaaataccatttttttctatataaataaaaaagatcactgaacactgatattcctgatttcctacactctaatcaagtagcctgatgttgacaagggttagaccagcctgcagtaactgcttggttcttggtgggtggtaaaggaaaagttcaaaaatcccaatgtctgtttttgcattatataagaagtgtttgagtactgttcggagttaaaagttttggagattcatacagattggtagaaaatgcaaaattgcgagtctggtattaaagatgaaatttggaaagtataatcctggtgtgagccctttctgaaacctgttgcattttgttttatagattgctgggcggaaccggataagcgtccaggttgccaggagattctcacccgcttgcttgactgcgaatacaccttatgttgagataatctgcctctggtctgtatagcggttttagaggcagcgaattggttcggcttatacatcgtttctttttcccatttctcatcattttgacatcgttgatgatgtaaattggcaacctgtactataataagcaagcctcaaagcatctttaatgttacaccattggtcgtgtgaccattttccatggtactccctccgtttcatcattttccatggttccatggtaccattttacccgcagccatcatttaccaaatattggacctccgagttttgtccctttcccagttacgaagtgaatttaactgttctccatgaacatgttgcgaggttactgctttaaatggtgcttggaattggctgctctcttcaaggtatcctctacgatttttagtcatacatgtttattagttattactcctgcaagtcgtactggcattcctatacaatcaaataagatgttaaccctcctagtttttttttaattttttaaaaaagctccatggcatgtttagattatagccaatataaatcttgccaaaactttagtaggatttcttatgtatttactaagtcggtaacaaactaaacatacatttttttgggtaactttaaaaaaaatggtatgattaaaaatggcatcaaagtgaatagccgctagttccgatattcaactcaagggatttgttgcgtgtcggtcaactggaacttgtttagcagtcgggtagaaaactagaaacacctgcaaataatctgaatgggacgctccattgttcagcattttctaggattaaataattgatagtcttggctacgcatataaatccacaatatctacaccgcgtggttataccgacacctgaacaaaagaaagtcgcacggataccaacagaaatcaccattttatagctatcatatactgagtatgccgcaagttaatccatagattagggctagaaccacgaattagtcttcacacgacaatagcttcaaattcattatttagtgttgggatcaatcttcttccaaaagaaatggagcatctgacgtgtcttttggaaagaacgactcagctgacatccgaattccgaaagtaagtgatcacatttcaagtttttgaccaaatttcaccgaacgaaagtgacaccggctaagaccgactcaacgatcctcacgcacggcgttcttccacttgccggccacctcctcgagcgcgcggcgcgacgccccgtccggcgaccacgccctcgccgccgccgccgcctgcagctccctcgcccggcgacgcacggcgctccccttctcccctggatccatgagctccttcaccgctgccgcgacctccttccgcgacaccacgccgccgtcgccgccgtgtgccaccggacgtagcgccaccccggctacctccgtcaggatgaccgtgttcatcttctgctcggcgtacagcggccacgcgatcatcggcacgccggaggacacgctctccagcgtcgagttccacccgcagtgcgacacgaacgccgccgtcgccgggtgcgccagcacgcgcacctgcggcgcccacgacgccacggcgaggccccgcccgctcgtcctctccacgaagccctcggggaggaagttcatcgggttgctgtggcccggcgcccatggagtaaggcagcctgcccgtgctcggcatgcgcaccacccagaggaagttgtgggcgctcatctccagcccggcggcgagctcggccgtctggtccacggacag

SEQ ID NO: 17749 - DNA, 25954 bp, Oryza sativa
  unsure (1)..(25954): unsure at all n locations
gggaagctgttcaccaagaagccatcggcgccgccgtatcgccgcccctcctcgagcacgtaggcgtagttcggatcggcgcaatcctggaacccgtcaggaatttcgtcgtggcggagcggcgcgcaaccggggagcacgagcgggtccgggaggtcacggtactcaccgacggcggcgtcgtcatggagctccacgacgctgcgcacgacggagatgaagctgatgctggtcgggaagaacacgtacccgggcacgccgagctcggcgacgagcgccagggccggcgtgccgaagaagtcgcacacgatcgccgcggtggtggagccgatgccgacgacgagcgcgcggagctgcgggacgaagcggcgcatgacctcgtacatcaaacagccgccgacgtccgccgggggcgggagaacggcggtggccacggaggccggcagcgaggagagcacggcggcgtcggttcggagaggccggcgagcgtgacgagcgtgggcgcgacgccgtggtggtcggcgagccgccgcgccagctcggccatcgggatgaggtggccggcgccggggctcgccagcagcacgacgtgcggccggttatcctccgccgtggtgctcgccaacggctccatcggtcgtctgtaagacggtgtagtgtgcgactgtgtgttgtgtgtagacgacaatacgagtcgtatatatagcccacggccacgcagctcgagaaaacatatgcgtcattagcaattccccaattataattgtggcagttgacgatatcttttcttcaacaaagctaccggtagctattagtgaacagtgtgccccagaacctagtgaatcttaaaacgaagaaagattatgtgatagtgtagcagccggcggcgatggctcctacaagacaaatctcggttttgatccttctcggacctgtttttttagtaactatataacattcgacagttatttttaaggaaaaaaaactttcacatgtaactaattataacagttattactgttttgctatacttttttgtgctgttcagctgccgatgtaatagtcaggctaaaaaccctaccccttagctctagtttcagtgctgtcttttgaggttgctcttgttgtcttctctacaaaaccagctaatgtggtagccttatgtatctttctgtctgtacccggaccttatagctctgttcatttctagttatggaaatggggcgtcagcccttgataaaaaaaatagttaattacaacgtatctagtatgaaattgttatataactattacataactaataacttatatgtaacttgatcttttctttcaaaaccacatggcattgcaagtgcctagcgtagcggtcttgcaagcaacaagtcaagggttcaattctcgcttgggcacgtgcgatttttttttatatctcggtatcacgaatctcgaagaacatccgacggtggaaaatttgaaatttttaaagaaataaatcagtcgaaagtttttttagcaaaacccttttttttgttaaaagacatttaaggacatgtttgtagcatcttgtgattgtagtagtttcttcgtcatatagggaaagtgtttatcatcctatcgagggaatactcctagttttttatatgctatctaaattgttataattttcttttaaaaaataaataagatagattaatatgaaatactatcactacacaaatatgcaaattcaaattaaacttctacatgttgtaacaaaaataacacataattataaacatactttaattatttttatttttatttttatttttttctttttttggtaatttgtagaggttgaatttaggtttgcatgttaatagagtgatatattttagagtaaatttcacaaaactacaggtaatttgatcaatctactacaaagctacatatttaataaagtgtaacccaaaactacaaatttaaaatcatatttttcagaaatttataaatttaaggtattatatcataaaactacagatttaatatcatattttatcacaaaactataacttttataacctcaatagtgctatggacataaactttaaaatctgtatatagttatttcataacttcaatattaaatatgtagttttgtgatacaatgctataaatttgtagttttgtgataaatttcacactaaatctgtagttttgtgatacactttttaaaactatagttttgtgctagtctggtcaaagtatatgtagttttatgaaatttactctatattttatattaatctaagttgtgaatatatttgttaaaaaataatataactatttagatggcatgaaagaataagagaatgtctccttgagagatggaaatccatctttctatcatataatttaactatgtgtcattattactaggttataactaaataccctttgggcttaactatttgtcactaaaaagaggtgatatatgaggagaattgtaatgtcccgcttctctcaggctgggcccacttacatttggcagcttttcttagatatagattgcccttacagaccaacacaagtcttttctgtacactttgtccttactcgtgtgcatccgagaagaatttcccgagcttttcttggatatagactgccctcacataccaacacaagtcttttctgcacactttatcctcacttgtgtgtacctgggaagaatttcctgatcggtgatgagaagcttttcttggatatagactgaggagaattgtaacgtcccgcctcccctaggtcgggtccacttacatctggcaacttttcttagatatagactgccctcacaaacctcgagaagaatttcctggtcagtgaggccgggcccacttacatctggtagcttttattggacatagactgtgataccattatgtaacgtctcgcctctcccaggatttctcggtcagtgaggctatgcccacttacatctggcagtttttcttgcctctcccaggattttccgatcggtgaggccaggcccacttatatctgtcagtttttcaaggatttcccggtcggtgaggctaggcccacttacacctggcagtttttcttgggcatagtttgtgataccattatgtaacgtcctgcctctcctagaccgggcccactcacccatcctgaaatagtgaaattgctccaggctaagcatgtttaacctcagagttcgttggagatcggctttcagaaaagaagttacaacttgttggtatgagtattctattaatccaggccaggatgtcacatgtaaaatgtaaggttattttctttccattgcacgaatctttgactcgatcctacacttaaaaatttagaagttgtgggacaaaagaactggcgaattaatgtttcttctagcgaattcgaaaaaaagaaacacggcgatatacaatagagtttctagaattatagtggattcagtttgtttgcatcgcactactaggaaaagcattatcgcaagcggccgaaaagggtcttcgcaggcggggcgatcgtccgcctgtaagccaacgactgtgaagatctccgatcttcgcaggcggggcggccgtccgcttgcgaagataattttcgcaggcggacgttggctagtccggtccgcctgcgaaaataggaatcgtccgcttgcaaaaaaaaaaacttccgcctgcgaagataggtagaaaatattgaaatttaataataatttgcccgtaaattacttttaaattatttaatagaaattcttgcaggtagatttttatgtacatatatcggaagattatcaagcatttggtactgagaaatctacatatattgcataactcaaaagtgttgccaaaatatatatatatattacaatatttttttacattgtcacttcaaataacgtcatctagttacgttatggcatagcagtgttccactcccgaagatccttgaattcgtcacttgccgctagggcaccctctgggtcgaagaaatctcctttcacatgacagcactaatggtggatgaagtggcacagatcacgctggacatttgtgattcctgtatcgtcaaagcttgttcgacattctaatcttggcaactgcatgcattgaaattaatcaatatattagtatcataaatatgtggagctgtctagtacatagtatagagacttacatcctccgcgttagtcctgtaccgtccattaaccctaaggaattcgcacgcataatacccgcaaaggaccgttccttgcggttgcttgtgacacttcaggacatatcatagaaaaaagtagttaaaattttcaattagtgaaacaattggaatacattaagtgagtggagtattaccggccaataggtacgtactagtagcttctcccgtgttcgggtttgttctccacccttgaacttgtagtattggtatgcactgtatggatgtcgtaccatttcacagtaaggaggatatttatttataatacattcatatacaaatgcaagagtcataataacttactactataagattgttagaaattctttgtattgcttgtgactgtaatcgagagggtccaagactaccacggttccgtctttagggtggataagtaaacagatataatgatcgctacatattaacaacattatagttagttagtaccagctaaaataagacatatgtgtataagataaatgtactggacttacttaaaattataagcggccatgacgactctcttattttgaaagtgcaagaaggctcgtccaatgtactgtgcgacagtaatcaatttctccttgtgcaagcccttcttgtattctgctatctcttttggattcttgcccttcagctggtcagaccctggtgctagcctcacggtatgctgtgtttggcagatccgagttggatccaagaagccgatgggttcttttttcttcttagcatccatgtaatgcatcctacagaagaagtttgttagtaacaatcacatggatttgtattgtacatatttttcatctaattacttaaaactcatactcacatgcaccaaataccaacgtagttgacgtccatctttctgacgatatatggctggagatctgagaaatccctttaaaaaggccccccaatacgtannaccttctttgccgaaacaatctgccggtgatcgagctgttatattgcccaagccttttttgctggcctccatatagaagttatgtaaccttctcatctcccatggtgcttctttcagtgcccattccagcaagagtgctttcccatgttcgtacttttccgggcaatcatcggttgcgaagtatgttggcccggctagttcagcagccttctgggggtcgtcatctctgagcttggcacgttccttaccccctctaaagacggttaccatgaacttctccttgttctcatctttggacttggagtcatggctcctaagcactcgtggcacctcggggtctttcgcaggagaagggtcttcaaatatttctggctttgtaccatcccattccaatcttggtacttcttctttgtctgacccgactgatgccacaaattacacctctggttctgccactgtaatctccatgggcacatccggcactggaatctccatggctgcctccggcggtgcaatctccatggctgcctccggcaatgtaatctcaagtggcacttccagcactggattttccttttgcatctctggttcctccgccttatcagtcaccttcctcttaggaggcctcgaaggttttcccaaccccggtttaggcaccacaggtttttgcatggcgtcggtgcccaatccaaaggatatgtcattcttgtgccagagaattacaagatcgaccgcatccccaagtacggatacaccatctgcagtcgggaagtcaatgtcgtaggactcaaacccttcgtgaaccacttgcggctacaccttggcatagcatcgggtatgaactcttcattgtatgttctcccagggatagcaatggctgtagcggcctcaagagttttcccggagcgtccaatgggaacgtgcaatctgcagggtgtattctccttgaggtcatcgaaggggtaatctagctcagattctttggtttcggggcgaggcaaaatcatgtgcttgacgtagaaatccatcatttgcctttcaaactccgcacccccttcgtctctaagtttatcctattttatcggcaaaatcatgtgaactggataaattttctattttatcggcaacgctctacagctccggattttcaaacgatacttttccttcatccgtgatcttcggagttctagctcttacccagttccttgatctctgtgtccactcctccattggtaccggttgccccttcttcctcatttcctcctcctctttagtccactgctccaccattggtgcgtatcccgcggagcctaagcgatgacgaaatttgttcttcttggccaactctgcatacttttggctcctttgaatttcttttggagagttcttcaaggtcagaaagtcgtcccactgattgggggttatgttggcatacgtcgaaaatggtgtgcgtcccgtcttcacaaatttcttgttcaaggtggttttccaaccacgccaagacttagccattgtttacagtgcacaatttctcactgctgcctctgatccatccgggaactggaagattttcttcaactctttccataggacttccttatccccatttgatacatgatcccagtccttgaccgtgatggggatcttttcccttaatattatgccacactgtgaactgaatttcgcacgtgccgtcttagcgtcgagcggctctcctttaggcgaaacatgggtaacaacatggaacccttcatcctttctattcacgcttctctcgcccttccttttcttcgtgattgctgaccgttcgctattctttgtgccggttgtgttagctggtacgtcgtcgtctttggacggaacttttttcttcggctgccgttttgatcgccatggcgttgtttcctacgagaaggtatacatggaagtttcgaattagctcgggctaatagttatcacggtgaacattttacatattaagtctacttaccccttctttagggggaatgtagtccttgttgccttcttcaccgtcgccctttttccttctcttcgggcttgggcttggacaaggatcgcttggcgacgagtactcctcgtcttcgtcacctacgtcgctgtcggaactaccttccggtgcgaccgttggttccggagcaaccacaacagcaagggactgctcctgctcccctgaacccttctcttcagtccctttagtactatcggccatcgtttcaaacctctaatataaaaaaaaagagttatcgtccacattttaaacaactttgtaaacaatatgtcgtatgaacaaatttaaattctctgagatttccaaatttaactattatactaaattaattagtacaaactaatttaaattgcgaaatattattaattagtacttactattatgctaaattaattaatacaaacaaatttaaattgtgaaactaatgactacttactattatgctaaattaattagtacaaacaaatttgtacaaaatttgatatgttattatcaagtagtgcaataattgacagttatatttcatcgacatgttgattaaaaaaatggaaaaggcaaaaatatcctccacatttttttaaaaaaaatgttaacataccctccaacatgttatttaaaacatttgacaaattcacatatcctgcaaaattgaacataccctcccaatttcattcacatatcacccacattcccaaattcacattcacaatcaacgtataacccctcattcacatatcacccacccctcatgcccattcacacccacatgcacgcacatatataccccctcacacccacatgcacccacatgccgtgcgcgcggtagaggggctggcggcagtgtaggggccaccggtggccgcgcgcgcggtggaggggccggtggcggtggaggagctggtggcggtggaggagctggcggcggtggagcgggcgcgcggtggaggggtcggcggcggcggcggcagagtggtggaggtcgcgcgcggtggagcggcagcaaggggcggtggtctcggtgacagcgcctggacgacgacggtcggcggcggcggaggacgacgttcggagagtgaaggtcgcaggcgggcggcggcggaggacggcggaggcgtgcggcagcaaaaaatttcggcagcctgacggcgccaaaatttctagggttcccgcctggacttagaaattttggcgccgcgggcttgcccttatatagggcaacgatcttcgcaggcgggcggttcgcctgcgaagatcttttttcctatcttcgcaagcgggccgtccgcctgcaaaaattggtacagagttgaatatatttattccaaaatatacaaatcttaatattattacaaaatatacaaaccttagtattattacttttcaaatgtataaatcttaattgcacataaaaatattactaatttaaattttttaacaaattttttacactacaaatggtaaaaatggtaattgcacataaaaataattacagttttcaaatattactaattttaattttttaacaaattttttacactacaaatggtaattgcacataaaaattagtacaaactaattaatatgcaaaatgttgagtacaattgttcgtcaatttgcgatatgatcacacatcaccttacatgccaccattaaataactactaacttcttagatgcttacatgcctctcaacaatcattaccctttaacatttttgcccacaccgtccgtgcgcatgtaaggcttcacggtcttttgagtagatgtctcgacattcttaatcttctgtacaaactgactataaagtggcatactatcgtattggttgtaatcttcgacatcttcaatcccatccactcccaatatcttttgtttccctgatagcactatatctttcttcaaatttgaagggtctttcacataaaacacttgtgccacgcgattggcgagtacccaagggtcatccttgtgacccacactcgccaggtcaacaacagtaaaaccgaacttatcaacattgaccccgttcgggtattttacccactggcacttaaatatagggaattgcattgtgtgcccatagtcgatttcccatatttcttcaataaacccgaagtatgattgttttttcccggcttcatcaattgcctccacacggacaccgctgttttgcgtacaagtcttactatctcgggctcttgtgctaaacgagtatctattaatgtcatatccctgccaagaatttactgtagttgatggaccacaagccaaccgcttcatagttatttcatctcggtggtgcgacccttattgttagcttgtattagttcgatatgttgatcgatgtacggctcgacgatagcaagctgatgaagcacgctgaagtgagcttcttggaatgatttgtgatcatgggtgacgaatctcttctttcctatcgttcccctgccactcaatctgccctcgtgtcggggcacaggtactccaattgcatatccatctttgaggtaatcgatacatcactcgacaacctcttcagtactataaccctcaaccattgataacactggatgtgcacgatttcggacgtaacccttcagaaccgccatgtaacgctcgtatgaccacatttgatggaggtacaatgggccaagcgcaaccatctgcggcactatgtgaacaatgaggtgctccatcatatcaaaaaatgatggagggaaacacatctcaagttggcactgtgtctcatgtgcgaatgtacggagatttcctaactcttcgagactactaagggcaggttttataaaagaggtggatgttgcatctaatcttgaccacatcatcaactaataaatgtagagataacatgtacaatatatcacatctatactagttctaatacactagccccaatgtttgtttgcccaatctactcttcctctctctcattttgtcttgaattttgtatagtggttgcctcttgcatgagaggtgactgcttatctctctcatctcttctctcctccacctcactccacctcactattttagcttatgtggcacctaggagattgtacttggatgcccatagtacttgccctaatgaccttctgtgacactgcgttgaaaaagtagcacaaccttgtgatagcaacctttaaatgctccggttttattgcccttattgcaattgcaagaaacacggtgagcaagacatggcagtcgtgtaaattataaccagataccgacaaatctttcattgaaactagtcgactgatgtttgatgagaaacctatgggcactctgacatcacggagtgagttgcaaaatgacttcttctcctcaggtgtcagtgtgaaacaggctggtggaagatatactttgccattcttttctccttcttgagggtgtaactcttccctgattcccatctcgactaggttcatccttgattgcagaccatctttagtcttcttcggcatgtccaacaatgttccaactatgttgtcaaacacattcttctctagatgcatgacgtctatggcatgctgaacctccagatctttccagtacgggaggtacttaaaaaatatggaatgcttattgaatgggggagggagtttatcatctggcttcgaactgtcatcttgcttcttactatcccctcccttcgttttcttctcaggtttcttgcgctttgtcccctttgatggtttcttagtcatttttccaaactcgcaaacaattttctctgtcattgcacacaccttttctcccgatgtaggttttggtgcaggatcagtctcttcagtaccatcgaactctgccttcatcttgcggtacttgtgatttgtgcgtaggaaccgccggtgccgcatgtacacaagcttgttgtaacccgggagatacctatagtacgttccattcaagcagatcacacatcctgttttacctttaatttgacctgaaactgaaaacattgttggataatcgttaatggtcatgaagatgatggccttcactgtgaagtattcccttaagtactcgtcccacactttcaatccctctttccataaatcagccatatcttccaacaatggtttaagaaacacgtcaatatcaataccagactgacggggtccctgtatgaggatacaaagtagtacgtattttcgcttttgacaaagccaggtaggaagattatacatggtgagaagcaccggccaagtactatgtgagctgctcatgtctccaaaaggattaactccatcagtactcagggcaaatctaatgtttcgtgggtctttagcaaactctctatactgagcatcaaagtttatccattgacgagcatctgccgggtgtcgaatcatcccatccttcttgcgtccttcttcatgccagcgcattagttccgcatctcgcgggtttgagtatatccgtttaatgcggtctttgacaggaaggtaccacatcacaagctgcgggatttttctctgtcgtccctcagttgcttcatagggttctaggccagtattgctattcgacttgtaccggcttgcaccgcatgttggacattcatctaaagaagcgtactctttcctgtacagtatgcagtgatttacgcacgcatgaatcttttccacaccaagtgaaagggggcatatgagtttctttgcttgatatgtgctggatggtagtgagttaggcctcgggagcattttctgtagaagttctaacagactgttgaaactggtatcagaccatccatgtctcgcctttaacctcataagttcaagaactgaccggtgtgttgtgaactcactatcacagcccttcgactcatcgtacaaaacttcctttgctgccttctgtaaagcttcaaagttatttaaccctctagccgaccccatcagtacctcgggttctgcatgacgtaacatttcctctaggtcgattttgtcctcaacagaaccatcgtcatgcaccatgtcttcaacttgtgtcggaactacattttcaggcccgtccacttgttcttcaccatgacgtgtccatatttcgtacttgtccataaatccacgagttactaagtgctccttcactttaaaagcatcgtcaaagtcccaggctatttcattcttacagtcagcacatggacaaattatcttcctcatattgttcttctcagggtgtgccttagcaataccaataaatttagccacttcgtttctatatgtagacaaaaacctcggccaatgatacatccattcccgactttccatatctctaaaaaaatacacgtaaaatatttgcacaattaataccaaatttgtagggtttattgaaaaaacttatcgctattcaaaactaattaactaaagttaagtgtaaattaataaaaaatcatagtttatttcaattttttttacatagacatgccaaattagtacattaggaaaatctacaaaatcatttcatcggcatattacaaaatactataactattttttgattgcaccgaataaatagacatttaaaattttattctctctctgtatatgacaagatctagatctagatctagaactaggtggtggatgtgatagcaaaaataaaaaaaatttgagaatttatgttaccacattaaaccactacaacaagaggcatcaagtattacacatacatctaacatcaacatatcaaaagaaataaaattaaaaacatggagctcttcctttacaattttgcatgcataaatccatcacaaattaaggtctaaaaagcttaaaaaattgcatacctagtgttgaaatgagtagatataagtaccgtagaaaaatcccccgaagatttgaagttcaaaacctccccctatatttaagtcactttaggagtgagaaacttcggggagaatgaacagggctcggggaggaagaagactatataggggcatcttttcaagcgggccatataagcgtcgcctgcaaagattgatcttcgcaagcggaccgccccctccaccccgggtactttttttgccagcggggttttggctccgaattacttgcccgcctgcgaaaatcgatcccctacgacgccgaaaatgagttttctagtagtgtcattcacatactatgctctgttatcatacacaaaagataaataggaatgtcaacacacgttacaaattgggtaatttactacagtatatactttacatataaaacggtactagtagtcggaaaggctaaggggcgatcgatcgcccctagcgatcacccctagagcggtccccctcccttcatgtggtttcctttttcggcgccatattacttttctattttagtaaatttatgcacctaaagtttgtacacctcaagtttatatatctaaagtttaaagtttagagaaccaaagtttataagtcaaaagtttatatattcgattcaaatttaaatttgaattcaaatatttattttagatatagtatttctattcatctaaagtttataggcccaaagtttataagtcaaaagtttatatacccgatttcaaatttgaatttgaattatatccgattcaaatttgaatttaaattcaaatatcttttattatagtatttctatgcatataaagtttatagacccaaacttgtcaaaagtttacacacctgatgaatttgaattcaaatattagtttatagacccaaagtttataagtcaaaagtttacatacccgttttaaatttgaatttgaattcaaatattttttatacatagtatttctatacataattttttttcaactttgtttttttttgttttttaaaaatgtatggtgtagtaggaagagaagaggggaggaggaagagagagagtagcttataggggcagaggggggggggggtgcaacgcgcccatcgttatcgttttgtataaatttttcacgtggccagcgacaaccatatatatccaacagtttcttcctgatccacctaggcggcgcgcatgactgcaaaacctcgtacgacggcggcgaggacaaccagctgtgggcgcgctccattgttcagcattttctatgattaaataaatgatagtgttggctacgcatataaatccacaatatctacacggcgtggttataccgatacctggacaaaagaaagtcgcacggataccaacagaaatcaacattttacacttatcatatactcactccgtttcaaaatatttgacaccgttgatttgtttgaccattcgtcttattcaaaaaatttaaataattatttattcttttcatatcatttgattcattggtaaatatagttttacatatttcacaatttttttaataaaacgaacggtcaaacatatgctaaaaagttattgatgttaaacattttgaattagagggagtactgagtatgccgcaagttggtccatagattaggattagaaccacgaattataagtcttcacacaacaatagcttcaaattctttatttagtgttgggatcaatcttcttccaaaataaatgaagcatctgacatgtcttttagaaagaaaggctcagctgacatccgaattccgaaagtgagtgatcacctttcaagtttttgaccaaatttcaccgaacgaaagtgacaccggctaagactgactcaacgatcctcatgcacggcgttcttccacttgccggccacctcctcgagcgcgcggcgcgacgccccgtccggcgaccacgccctcgccgccgccgccgcctgcagctccctcgcccggcgacgcgcggcgctccccttctcccctggatccatgagctccttcaccgccgccgccacctcctcccgcgacaccacgccgccgggcgccaccggacttagcggtagcgccaccccggctacctccgtcaggatggccgcgttcatcttctgctcggcgtgcagcggccacgcgatcatcggcacgccggaggacacgctctccagcgccgagttccacccgcagtgcgacacgaacgccgccgtcgccgggtgcgccagcacgcgcacctgcggcgcccacgacgccacggcgaggccccgcccgttcgtcctctccacgaagccctcggggaggaagtccatcgggttgccgtagctggcgcccatggaggaaaggagcccgccctttcttggcatgcgcaccacccagaggaacctgtggccgctcatctccagcccggcggcgagctcgcgcgtctgctccacggacagcgcgccgccggagccgaaggagacgtacaccaccgaccccgccggctggcggtccagccactccaagcacgccgactcgtcggcgtcctcgtcggaccttggccggacgaacggcccgacgaggtacaccggcgggaacgcgccgttctccccgtctcgcctgaacgcttccgcggcgcccggctccatctccgggaaactgttcaccaagaagccgtcggcgccgccgtatcgccgcccctcctcgagcacgtaggcgtagaccggatcggcagaatcccggaacccgtcggggatgtcgccgtggcggagcggcgcgcatccggggagcacgagcgggtccgggaggtcacggtactcgccggcggcggcgccgtcgtggagctccacgacgctgcgcacgacggagatgaagctgatgctggtcgggaagaacacgtacccgggcacgccgagctcagcggcgagcgccagggccggcgtgccgaagaagtcgcacacgatcgcggcggcgggggagccgacgacgagcgggcggaggtgcgggacggagcggcggacgagctcgaacatcacggagccgaagccgatgtccgccgggaggtcgtcgagggcgacgggcgggagcacggcggtggccacggaggccggcagcgaggagagcacggcggcgtcggtggccgggtcggagaggctggcgatcgtgacgacggtgaccgcgaagccgtggtcggacacgagccgcctcgccaactcggccagcgggatgaggtggccggcgccggggctggccatcaggacgacgtgcggcggcggcggcggcagtgacgtgtcagttgcaccggtggccgcctccgccatggttgagtgcagagtatggagtacgcttctacttatttttggtgtcgtgccgcgtcgcgtcgctttgcagtttgagaatggaaagcagatgccatgtgcaatgaaaattaaggcccagcttggaacttaggaagataaagaaactaattagtaaaaaaaaaaaagaagcatcaggcaaaatttgccacggacatctaaaagctaagctatgtaattagctagaagacactcaaaaaacgcgacactactaataggcaccacaaaatttgtgtaattagctatagtaaatctgagacaatattttatcattttcagtgaaaaagaggagatagaaatttcaaaaggacataaatgccctcggcctaagtaacatgtacccgaaatctccatccaacttaactctaggctaccgatggtgacggcggcggcggcggcaggcgaccgacttcttcttcgacaacggctggtggcggtggcgggcaagcggcttctgcttcaacggtggctggtgacggcggcggcggcttcggctggttgtggcgttgggaagcgacagcggtggtgatggctcggccggtcatggtgcaccaggagctcgccgcgctgcaggagcagcagcaccatgatttcatgccgtcgccacaccaacagcaacagcaacagcagctagtgtagcagcagcaacagtagctagtgcagaacgatgcccaacaacaacagctagcagcagcaacgccgtggccgacgatgccctacgaccaccaccacccgctgctgcagccgctctgcaacgccgccgccgccacggcgcagagctcggccacgtccgcgccaccgacgcgccgccgctgcgcacctgtccgccacggtgctgctgcagaaggcagtgcagatgggctgctcacgaggcagggaccggaggaggaagggaggtcgctctcagcctctcactcgccgagaaccgccagctcctcatcctgctcaacatctccctcgccgtcctcgtcggctgcagcgtcgtgttgctctcgagctcggtgccaccgcttgccgttgcgccttaggtatggtagccgccgcgccttgtcgtcgccggcggtgagaccctggaggagcgccgccgctttttccgccgcgtgcgtgaggaagaaggataggagagagatgtaggcccatgccgcgtgagaccaggtggttaaaacctattaaaaaggacactgtctataacgagaccattctctctatggtcataactagatacctcaatctcatatctagttgctactagtatactcaaaagtgaatgtatttttttttcttcttatggaattttctcttagattactcatccgatttacgatccgattacaccattgtgttcataacaattaaatctttataacaaaatctcacatgactatatttttatgaaaaaatagaaattacttttataatatatctaaattacttttagattttattaaattacttcttagtcataaaagtaattcaataaagcttgaaagtaatttagctatattatagaagtaacttgaaacaaaagtgaagtaacttgttacgacattaaaagaaatctatacattcatgttgtgagttgtttattttataatcatttttagtcaattatgtaatttatgctgattaaatttaatttctatatagactcatgtttttacctccataacggatttacttttaatgtcgtgataaagttactttcttctttttttaagttacttctataatatatgtaaattacttttaggctttattgaatttacttttatgggtctaagaagtaatttattgaaatctaaaagtaatttaaatatattttaaaagtaatttctattttttcatcaaaatataatcatgtgagatcttattataaagattcaattcttacgaacacaacggtgtaatcggatcgtagatcggatgattagtttaagagaaaattatttttgaagtcgacgtagcgtagagcatcacatggcttctaatttggattcctggatgatgccacgtccgtgaatcaccaagccatgtacggacacatcagcacttatgggatcggacaactgatgagcgtgtcgcgcgataaggcaaaacagagagcgcgcgcgaattagattttgcctattaaaaattagattaaacatacactgtccatgatacgtgggtcccaccggtgtttaaagaaagagaaggggcaatccatgcatttagataaatatctcatcccttttgtcccggaaatataataaaataatacgacttgtatcctacggccaattacacgtttttttgtagggtcaatcagccgtgtcatgttttcgcagtgtctctcagccaattaaacgttttttgcgtgtcatttggcaaatctggcctttagtttattttctgagcattagcatactaggtctggtatctctaatacgtactaatatcaaaatggtatctaaggtatcatgcttaccatggtatctaggtaccgaaaaacttggtatctacgagtatcaaatttggtacctaaaaatatcctgctgacattaatacctaaaagtgtttcgttggctaaacggtatatcgttccttagttacccttaaaaaccgtactagtatgaatacaaaagacatgaaatataaatagttagcaaaatctcttgctctcgaagcttgtctttagcctaatggttagttgtatggtgtgtttatatatgggactattcaatttcaactgtcaagtcaaatcatcgatcaaatttggtatatatatgtgtgtccgtgttttggcaatgcacttgatgtttgatgcctataataatattaatgtgtaaaggatacttctttcatattttaatgtatgacgctgttgactttttaaccagcgtttgaccattcattttattcaaattttttgtgcaaatatgaaaatatttatatcatgcttaaagaacatttgatgatgaatcaagtcacaataaaataaatgataattacataaattttttaaataatacgaatgatcaaacgttggataaaaaatcaacggcgtcatacattaaaatatggaggtagtactattttgccggatgatcgaagaacggtcatccaaatggtattaatattgaaagagaaaaggagttacagaagatttttcatggacggtcggttgtaaaggatattcacacgcgtatgtatgcttaggtgtatgggttcggcgaaaaaaataaatatcttatctctaattggtggttacaatcgaagacttcaacacgtatcagaaaattcagaaatggcaaacgtcacacatcatgtgtgttaagcggaatctactcttggttttaattaatttaggaccatgaggtggacgaaagaatgctattggcagatccacccaacaattcaacgaccatatataactaccctaccctagtggttctctaactgattttttttatgcaagctaacgaattccatattttgctgatattaagtcacaaccaagatttaacaactcgtttttcttttcgaaacgaattttttttctcaattttagtgacacagcaggacacatattcctgcaaggtttgaaatttcggttcgaaatttccgaaattcgctcccaccgaaatgctcatatctcgtccgaaactttcggttttttgcaaatttttgtgaatttggtcaaattttattcaaatccattaaaaatcagtcaaaatttcaaaaaatttcgttagaaaaaaaatcctaattttctgaaatttcagttctttcaccccccgtcggcagaaaccgtagtttcgaaatttgaaacactgcattcctgcgtatctaccagtatggacatattttctcaagaatatctcttttttttactcctaatattaggctagaaaaaaaatgctccattgcatcaacgggagtctgttgggccttaatccatgtaacagttagtattttttgaatctctgtaacacttagtattaataggactaattgtagcacaaagtgaagaaacaaaaagaactttatatttagcatatgctcatgaaaccaagacccaaaagtagctccggaaatctcatatgcatccactacaaaattttcaaatattacactctaaaatcaatgagcatgaaaatttcaataagcaaaatcgtttcaataatgctaagaccagctgatccaataatgcaggcctccccgttaatctgcaagtccatggactaagaccaggtggcccataaaagcacacaaacaccgtaggaaaaagtacaccgaaggtccctcaacttgttatcgggataaaaaatgtccttgcaaccagatatacggggtcccttaactatacaaaaccggtcactcgagatccttcggtggttttgaccccggttttagcctacgtggtgcgtgggccccacatgtcagcatgccacgtcaactcccctttcccctcttctctcccttcctcccccctctctctctcgcacttttctctcgcaggccggccgacgggtaggtagcagatgatcgggtggtgagcggggctgagcggcggccggcggaggcggcgtgctagcatgcggaggccggcgaagcggagcggcggtggcggcaagcgggcgagcgtgcggcgaccgacagatggggaacgcgccgggatgtcgtcgacagtggcaaccggcggggagaagaggcgccgggacgggtggtggccgatggggagaacgaccgacgagcgggcggggagacgaggcggcgtgcgtgccgacccgggctgccaaatcttgctatcaaatatttgaagcaacagtacctgtggcatatgagatcgacaatcaaccattcaatccacctataaatggccatatggcccaaggcccacggcctggcccaaagctcgcaaatttggcccggcccaagcacggcatgacccgactggggtcgtgcccatgccggcccggcccgacaaccgggccatgcctgggttgcacccttggcatggtgggccagcccagcactgctcgatcaaataaaaaaaatatagggatgcaaaatagacttaaataatcgtataaggcaaggcccaagacaagaggtacacaaaatagacttatgttccagccatttaaacatagccgacagagttgagggaccaaaaatagactttttctgtgaggaagcacgatgggccacgtaacttcggcacggcccgagtagtattgggccatgcctgggccttgtatgccacccatgggctggcacggcacggcccggtgtatcggtcgggccgtgccggctcgacaagcctcggcccaggcacggccaggcttgggccgtgccgtgccgggcggcccagatggccatctataaattcaccgcaccgaacactattgtttccaccgacaaaactcgcatggcctggagatcactgatgcactgaaccgtggcttccctagtgtgaatttccatgtaacttgggacaggatgattgttgttagcttgcttgacgctggagttggctgacggtgcctggtttcggtctggccatagctgttacgctatcgaaatctcatactccatgcagtggctggtgtggcacgtgtgagtgacttcaggagaggacatggacggaggcgttcttggtggcggcacagacggggcaagcgtcggcggtagcctcgcaggcgccacacaggcacaggtggcggcacgggagcagcagcacggacgcctccgcgacacggcaggccttccacgatgtcgccccggacatcgcgtcggcgtcggcggcagcggcggcggcggcgccgcctggggtctcgaagcatcacgactgcgcgtcctcggcgttgccctcccccgcggcggcggcgacggcacaaggggactggaggagctagttgagcgtggcgcggaggccggcggcgacacccatccacgcatgctcctccgcgctcatccggcggagcttctcctccagctccgcgttgtagcagcactcgcgatccagcttggcctccgccgcacgcaccctacccgtcgtggcgcaccggcgcgccatggccgccgccagcgcccggacgtgtcgctgttgcgctttctccagccctgcgcgcatctgctcgacctgcacgacatccaccaaacaccaacgccgatcaaacaccattcaccaaacacaaacagaggaggccggcagcgtgagcgggtgcgtggcctcgtcgtaggtgaagaagagcgaggcgttggctgtcgggatggggaggtcgccctgctggcctcctctttccctgctcctgcgtcgccgccgccgccgccgcgtcgcctatcgccagcccagagagaggaaaagtgagacagagagaaagaggacgaaaggaaagagagatggtgatgacgtggcatgctgacatgtggggcccacatgagtcccacactgactcagtcgtcacgtaggccaaaatcggggagagccccaagtgcggagagttattttaatcacgtggatgtccacccgttcaatacatataatttaaatagttattaaaaacagtacctttgtgttgaaatggggattcagaaaatgtttctaccatattcttccatctgtcatccttcgttagtcacatatgtgcgatgaacgcagagagaagaggagcccagtccgagtgtctgaccgagcctgtaacgggacattttccaaattcccaacgtgagaacgatggggatagaagaacttttgattgaaatcaacagaagaatctacgggattgcaacgtgtcaggaacctgacgttgctgggtgagctacaggaagctgacaacgcgagggaggaagaacagacttatgctggaagaggagcaagagttcgtaagtgtaacacgcgtgtgtgtgggccggattggaccaaatgagtaccaaccgagcccacgagtaagtctggagtaagagagggagagagagagagagagttgaattgtaataagaacagagcaccctgactttctttcgtatcgatgaagtaagaactggaggcgaaggcggcggcgataccaatcctgctggattcggtgaaactatctcgtttcttgcttgttcttactagttcttgagcagttgagttagggttctaacaatctggtatcagagccttgccgttctctcatttcctggattttgctgcaaaattttttcccggaagaggtgggaattgttgcttcggtgactaattccgcaaaagcttcggctccctcaactgggttagcgagatctagaacgagacgtcaaccacgggcacttacgagaaacctcgctatgtcaccaagcaagccgcgaagatcatggatcaggatgggaaactggatcttcttctcaagaagatggaggaggcggagaagaagcgcgaggaaagtgagaagaagagggagcattccgaggagaagagcagggctgagctcatggcgctcaaggcagtggtagaatctcgtttcccagctgtcgagaagagggtggatgatctacaaggttcggtgaaggatttgcaaggcaaggtggagcagctgcagttggatgtacaacaatttcctcaagagcaacctgctattgcttctatgctgaatcaaacaggtgctctaaaaacctctattcccttccctgatgtgactgatttggatcgatccccttctgatgtagcaaattctgttggtgtgatgggtttggggggtagtgttccaccgatgtcttatcctcagtttgatggtgttaatcctcaaatgtggaagtggaattgtgaagaatactttgacatctatggagtacatgctaagaattgggtcaggatagctggtttgtactttgtgggtaacgcagccttttggcttcactctatgcggtctaaactgtcgggagttagttggccagtttttgctgaacaagtttgtgtcaaattttctaaggatgactaggaaattcttatcaggcagtggattcatcttgtgcaagatactactgtgtctgaatatgtagaaaaatttgacagcattatgcaccaactgttggcttacaacaattcactgcctctcaattattttgtgaccaagtttgtggaggggctgaaacaggaaatcaggtctgcagttctgacgcagaaaccacaagatctggattcagcttgctcactggctttcttgcaggaagaaattttggaaggttccaagtctgtcagtcacaaaaagtctgatcagcctattcttgtcaggaactctttgaagtccttctctcctcaaggctattctaattctgttgttaagggcacttcatcagccccatccgatgacaggagagggtctgacagtaccagggctagagatgacaggctagccgctctgagatcttatagaaggtccaaggggctgtgttttacttgtggggagcgctggagtaaggaacacaaatgtgctacctctgttcaacttcatgtaattcaggaactattggaaaccttgagtcctaattctgttgattcagatgagcaggaaatggaagaaggtaacctgatggctatatccctgcaagctatcagtggtactgagtctgctacttctttcaagataaaagggtgtattcaaggaactgaagtgctaatgctgatcgattcaggcagttctcattctttcttggacacccaagtagctcacaagttccaaggtgttcagtcattatagaaggtgatgtcagttaaggtagcaaatggaggtatcatgttatgttctcaattgattcctcattgtgcttggtgggttcaaggagtaggtttccattcagactttaagctgttgagtcttggagtttatgatgttattttgggtatggactggctagtaaccttgggaacaatgaatattgattgggctactaaatggatggagtattagttggggaacaaaacaatcagaattcaaggaattcaggctcagactgaacactgtgctcccatttcagtggaaaaatttcaggaaatgctaaatctcggttcagtcatgcaggtctttcaactgcaacatctacctccagataaacttgttgaagttcccctgcaattcaggcctcttttatctgaatttcaggatatttttgctgaacctactggtttacctcctaagagagcgtgtgaccacagaattcctttgttgcctaactccaaacctgtgtacatcaggccgtataggcacaatccagcacagaaggacgaaattgagagacaggtgaaagagatgttggcctctggggtgatcagacctagcagcagtgcatattcttctcctgcacttttagtgaaaaagaaagatggtacatggagggtttgtattgactatagacaacctaatgccataactgtcaaaggtaaatttcccatgccagtcattgatgaacttttggatgagttatctagggctcaggtcttttccaaattagacttaagggcagggtttcaccaaattaggttgcaggaaggtgaaagcataaaactgccttccaaacccatactggccattgtaagtacatggtaatgtcatttgggttgactggtgctccacctacattccaagg

SEQ ID NO: 17750 - DNA, 11307 bp, Oryza sativa
  unsure (1)..(11307): unsure at all n locations
tttaaatgagcaaaggttacacaccccttggcagcataaagcatatactaagttgcggggtttacagtttaaaatctgttataggaagggatctagcaatgctgctgcagatgcactttcaaggaaatacaacctggaccctgttgacctcatggcagtttctagttgtgtccctgtttggctccaagaagtggctgctgggtacttgctagatgagcaaactaagcaacttttagcagaactgtccctatctgtcaattccaaacctcctttctctcttcataatagtattatcaaatacaaaggtaggatctggattggttacaatactgaattgcaacatagaattatctcaactctacatgacagcccaatggggggtcattctggtttccctgtcacatacaggaggattaaatccctttttgcctggcccaaaatgaagcaaactgttcaaagggcactcaagggctgtggagtttgtttgcaagtgaaacctaacagaagcaaatatcctggtcttttgcaacctttgccagttcctgatggagcttggcaggttattactatggattttattgaaggtntacctaagtcattcagatttaattgcattatggtagtggttgataaattttcagaagtattcccactttgttcccctggcgcacacattcactgcccttgaagttgctgatcttttatgcacaacatttacaaactccatggccttcctcattacattatctctgatagggacaaaatcttcacaagtcatttgtggcaacagctgtttgctaggtctggaactcagttgcacctaagcacagtctatcaccctcaaaccgatgggcaaactgagcgtgtgaatcagtgtttggaaatctttttgcgttgttttgtgcactctatgcctcataaatggagcagctggctttatttggctgaattttggtttaacacttcatattattcaacacttctgaaatctccttttgaagtcttgtatggctatcctccgggacattttggtatccgtgatgattcttgttctgttcctgatctggataattggttacaagaaagaaaacttatggttcagctcttgaaacagcatcccaacagagctcagcagcaaatgaaatgttatgctgataagaacagaagcgttcgtgcttttgaagtgggtgatttcgtctacctcaaattacaaccttatgtgcaatcatctgtttcacggagggcaaatcataagctatcttttcgctattttggaccctatcaagtgttggccaaggttggcaaggtagcttatcatcttcaacttcctagtgacagttctatacatcctgtctttcacgtttctcaactgaaatctgctgctgggttctccaaagtggtgcagcctcaacttcctgaaatgggtcaacttaaggtccctgaagttattctgaacactcgtcaggttcaacggggtaagtcattaatacctcaagttttagtttgttggtctggagatgttgcagggcaggagacttgggaagatcttgttgatttgcgtcagcgctttccagcagcgttggcttggggacaagcccaatctcaaggagaggggattgtcaggaacctgacgttgctgggtgagctacaggaagctgacaactcgagggaggaagaacagacttatgctggaagaggagcaagagtccgtaagtgtaacacgcgtgtgtgggccggattggaccaaatgagtaccggccgagcccacgagtaagtctggagtaagagagagagttgaattgtaataagaacatagcacgttgactttctttcgtatcgatgaagtaagaactggaggcgaaggcggcggcggcaccaattcttctggattcggtgaaactatctcgtttcttgcctgttcttactagttcttgagtagttgagttagggttctaacacaacgcaaagaaactagcacattaaatcccacattgatgggaccaaaactgatgttgttgggtggaggcgacgctatagctcatggtcttggatgcaggtcttctacagtactgcatatattgctcactgacatgtggatcccacagccacttgggcccacatatcagtgagcagtactgtacatgcagtactgcaggggatctcaattgcatggttttgggtagagtgtgagtgacaaagttgctcgacttcaataggaggcggtggcatcctcatcacggctactcttgtaggtggaggcgtcggaagacggagcagcggtggacaatggtgcctccagtgcaggggtggaaccagacaggactaacagaaaggactgaacaaagtatataaaactatagctccttcttctaataaatatatgatagaaaattttagtgaaaacttaatggggcttccatggttataacgctgatagcaaaggctcgcgtccccgtcgtccccatggcagatccgccactgcctccatgttaattagaccgcagcagagactcctgcattgttgagatggagcaacagggtggagggaagggcaaggacatggttggccttgatgatggagcttgatctattatccgccgcttggatcatgtaacttcaaatgaggtactactgatatatatatatatatatatatatatatatatatatatatatatatatatatatatatatataagcaatctcaggttgtcttgataaaaatgttctgccgggctgaataattggttatatttgagcttacccaaaaaaaattatcctttatacaaatgaaataaagtagctcagcttcatttagacgacgggattagtacgataccgtagggtagttcgactacgctttgcttttatttttttcccctcgtgaccttttgtgtgtgtgaagcggtataggagaggaagaggagcaataggggacatcggtgctccagtggatggaaggcctcgatggcagtagcagaggatgtttgcaggcatggatcacatgagtagggtggcagccggcaaagggagtaagggagacgcctcgaatggcgacggaaagagctcagctccagcagcaaatagtatagtggtggtagcctgtggcaatggctataagagaggggagatggggaaattggattcagtgggttgtggcggtgatgcgatgagaggagggaagaggggtactagcagaggagatcagccgatgagaaggattggttggacatggcagagagaggagagctcgaagagcttgatgcacagtggggagaggggatgtgatgatgacgaaccgcagcgacaatggtgccacagggaaggagcgagacgtttgctcggtcggctaggccaagcgctaacatgtggggcccacgtgggtcccacttgccacatcagtgaaaaatgatcattacactgtcgacagaccaaagttaacacggtattatgaattagtgtatgggctatacctagtatttcagtgcatggacgaatttcagactcagatgacaaattaagggacctaaagtgaacttattcctacaaaattataacttccaaatgaatacttaaaagcttattattattattatggcgtggatgcacatggatacttatcattatacacgtgacgacatatatataacatatgcacacatccataaatatactcccaacacacacgaataggcggagaacaacaatacgtctctaatcttactaaaatacgtgtgtactccctataaattttaatgtataacgccattgaccttttgaccaatgtttgaccattcgtcttattcaaattttttgtgtaaatataaaaatatttatgttatgcttaaagaacatttgatgataaatcaagtcacaataaaataaatgataattacataaattttttaaataagacgaaatgtcaaacgtttatcaaaaagttaacgacgtcaaacattaaaatatggaggggataatatttaacaccatgtgataaatagttgagacaaaatatactttatacgattattactcaagtaaatcagtgcagagaccgccagactggtaaaaagtggtgacagtaatagattaatagtacttctagaagaaaccgcgatacttaaatatgagatctgagcaattagggtgtgtttggttgcccatattcccctagcctggctcatttctcgcatccaggctgagtttgacctggctaagagtatacatatgcagttgtttggttggttgcattggtctagccaggctagcatgagattttgtttggttacttgtataagagatacggtttgaaagggattttgtttggttggttgcatggatgtgagtgttctttacctcttcatttagttgggtgaggttacctctacaatatatataacaaataataagagtattttgatttatccaattgaatattcacttacatatgcgaatgatactgcaaaatcactctattatctacataaaataagtcggccaacttttcacaccgaatcagtggtacgaaaaataagaaaaaggttatctattatattattaaaggaatagaaaaatgagcctccacgttcgctctcatggcctagaaattctcacattaatcggagaaaaagaaaaagcagagtccatgtagaaatacaatttagaaaatagctgaaatttggaattaaaaaaaataagaaatattagaagaggagactagagtccatatagaaatacaatttagaaatagttgaaattcggaattaaaaaataaggaatattagaagaggagactagagtccatatagaaatacaatttagaaatagttaaaattcggaattaaaaaataaggaatattagaagagaagactagagtccatatagaaaaacaattaggaaataactgaaattcggaattaaaaaaataagaaatattagaagtagagtatagagatacaatttacaaaaaattcggaattaaaaaaaagaattattaaaagacgagtctagagtaggaatatatataatttacaaataactaaaactcgatattaaaaataattaataactaacacgtatataaaataccatatgaatattacacatttgtagtttcgtaaagttattgtaaaatttaaaattatgatgttattttaatatatttgaataatataataagaaaacatatatgctattatatgagagaaaatataatgatgctagcgcgcaatctgtgcatgccactatgctaggttttctttaagctagatgaaccggtggaactaattaatctattagtagtaattctgcatacattgacttctctgttgctggagtacttgctagtgagaaacgaaagaaaaagaaaacagaaaacccggggagaaaaaagaaacgaaagagagaaaggaaggggatcggcgttgcagccgtcgcttcgtcgtcatcaactcccgtccgcccgcagccgcatgcatgcccacctgcccgccgctcgccgttcctccacccatcttcctgcgctcctctccatccgccgcttgccgctcctctgctccagatctgaccggcacagaagaaggtgggatacgacggtggccgacgattgaagatgggatacgatgggaagaggagggatgcggcagcaaggtggatccgccgtcctcgtcgccgcgacctccgctgagctcgtcaccgtcaagctttttgccgcctcaccactagttggatctggcagtgctcacaccatcagcggggacgtgtgggcaaggcggtggccggatattgaaggtgggagacggtgggaagaggagggggatgcagcagcaagttggattcgtcgggcgccactccctctagcagagctcgtcttcgccatgtcgattgctgggggaaaatgaggaggagcaaggggcggagtggtgaccccatcgcttgcccttgcacacgcgggtgcggggcgctgcatgcgcggatgcagcgcgttgcatcgtgcgggcctggccgagcagcgaagctcaacttgagcgtttctgctcagcctggctgtgggggattttttgcatccgctcgaccaggctgggagcgagctgcaggcaaccaaacagcgacctactgcatccacgcgtgcgagccaggtttcatgcatgcaaccaaacacacccttaatctctccctccatgcatcacagtcacacacaccgcgagctccgagctccgtgctccatggatccgtcacctcggccgtcgccgcacgtcgtcctcgtagccagcccatgcgccggccacgtcatgcccatggccgagctggcgcggcgcctcgtcgcgttccacggctgcgccgccacgctcgtcacgttctccggcctcgccgcgtccctggacgcgcactccgccgcggtgctcgcgtccctcccggcgtcctccgtcgccgccgtcaccctcccggaggtcacgctcgacgacgtccccgccgacgccaacttcggtaccctgatcttcgagctcgtccgccgctcgctgccgaacctccggcagtttctgcgctccatcggcggcggcgtcgcggcgctagtgtcggacttcttctgcggcgtggtgctcgacctcgccgtggagctcggcgtccccggctacgtcttcgtcccctctaatactgcgtcgttggcattcatgcgccgcttcgtcgaggtccacgacggcgcggcccccggcgagtaccgtgacctcccggaccccctccgtctcgctggggacgtgacgatccgcgtcgccgacatgccggacggatacctcgacaggtccaaccccgtgttttggcagctcctcgaagaggtgcggcgataccggcgagcagatggattcttggtgaacagcttcgccgagatggagtcaaccatcgtggaagaattcaagacggcggcggagcaaggcgcgttcccgccggtgtacccggtggggccgttcgtccggccatgctccgacgaggccggcgagttggcgtgcttggagtggctggatcgccagccggcagggtcggtagtgttcgtctccttcgggagcgccggcatgctgtccgttgagcagacgcgcgagctcgccgccgggctggagatgagcggccacggattcctctgggtcgtgcgcatgccgagccacgacggcgagtcctacgacttcgcaacggaccaccgcaacgacgacgaggaagaccgcgacggcggcggccatgacgatgacccgctggcgtggcttcccgacgggttcttggagaggacgagcggccggggcctcgccgtcgcgtcgtgggcgccgcaggtgcgcgtgctgtcgcacccggcgacggcggcgttcgtgtcgcactgcgggtggaactcggcgctggagagcgtgtccgccggcgtgccgatggtgccgtggccgctgtacgcggagcagaaggtgaacgcggtcatcctgacggaggtggccggggttgcgctacgcccggcggcggcgcgcggcggcgtcgacggggtggtgacacgagaggaggtcgcggcggcggtggaggagctcatggatccaggcgagaaggggagcgctgcgcgtcgccgggcgagggagatgcaggcggcggcggcgagggcgcggtcaccaggcggggcgtcgcaccgcgagctcgacgaggtggccggcaagtggaagcagacaaaccgtgctccatacgaataatgctgtttagtttggcaaatttcgttgttcgtaaacgaattcggctcaaatttggttggtgatcactactgacttttggtgatcactgcattgctatctcgaaaggaaacctcaaatgcttcatttctctcttcttttttttttttgaatggaaatgcttcatttcttttggaatctgatcccatcgtcctgaacacagattaaagaattgtaagcatatttcatgtaagctgattctcctgcccctatacctagtttatgtacgtacccaaacttgcacaacatacaaaactgtttgctggtgttatgcgtgcaactttctttcatcgcctagggtgtaaaaactttaaagtatacggacacacatttaaggtattaaacatatactaataacagaataaattacagattctgactataaattatgagatgaatttattaagcctaattaatctgtcattagcaaatatttactgtaagcatcatattgtcaaatcatggtgtaattaattaggctcaaaagattcatctcgcaatttacatgcaaactgtgtaattggttttttccccacatttaatgctctatacatgtgttcaaacaattgatgtgacgttttcggccaaaattttttgggatctaaacaaggccctaggccatgttttttttctcctagtagtacgtgcacatggatttatagattttgtacagtctagttcatattctatttttcttaggtttagattcaggccgtgtttagatccagcggtaaaaagttttgacgtgccacattagatatacggagacacaattaaagtattaaacgtagactaataacaaaataaattacagattccgtctataaaccacaagacgaatttattaaacctaattaatctgtcactagcaaatgtttactatcactactacacaaaacattttcatggacgccggacctgtttgtttccaggcaggccataattggcactgcacgagataatcaggggaccggcgccagaccgtcgcccgcacggaaaaacgcattatcccgtgcgggccactttactcaaccgcacacgaaaatgtcgtgctggcctctttactcaccccgcacgcgaaaacaatcctcatgccaacttgctacacgactgccactttaactctcccactcattctctcctcccactccactccttctctcctcccggcctctcatcctctcctcacagcagcgacagcggcggcgtgcggtccctccctccctctcccttcggctcccttcccctctcctccctccgcttgcagatccggcgaagggaaggcatggggacggcggatccggcggcaggcgcaggtggaggcggcaggtgacgacggcgcctcgcggtccctccctccctctcccttcggctcccctccctccccttgcaaatccggctgaggggaggcatgggggcggcagatctggcggcgggtgacaacagtggcgcgcggcccctccctccctctcccttcggctcccctccctccccttgcagatccggtggaggggaggcatgggggcggcggatccggcggtcggcgtaggtggaggtgacagcggcggcggcaggcgacgacggcggtgcagaaagagagggagacgccgatgagggagggggtggggaggccggcgagctttctcgaccttctcggtggatagagtaggccggcggagctcacccgccgctgcttcactcctcctgcagccacctccgctgttgctgccccctccaccgctcaccgccagctccgctctactggctttctccgccctatgccgctgcgccctatgccgctagtagcctcccaagtttactaaagaagagaagagaagaaaggataagagaagaaagaaaagagaaaagaagatttgctgaccccacatttttccttctcacttatatgtgggctccataacttttttttctgactaggatgccacatcagcgtagccagatatccatactgctataggacccaaattgcatggttttgtatagtttagggggtgaagatttctagtattggggattagggatgtcatgcgaacttgatgtaaagttgagggacggctggtgaacttattccaaagaaggcctaggagggagggaagagaagaggacttcgatggcgggccaaaagtgaaagagagagctttgggcaggattcgccccaaaaagatggagatgattaattttagttttatcattttaattaaccctgaaattggttgttgttgatttaaaattataggttgctctgaaaatttcagtaaaaattgagggaccaatttagagcatggagaatttaagaaaaatacaccaagccactttgaatttttggatgtattttagtatttgaaatttatttgagacttttattaatttctattattccttttagaaagtgacttttaatttgggatggatctatcaggtgtgacataacgataagagagctccaaattaatttcaagacccaaattaatctcgcgttagatgttttctttcaccttcgagtagacaaagagctctctctgtgtgttccatcttcctttggttttggttctccctgagcagacttgtgtccgttcttctgtttttgcgctgattcagttgttcctcgatcctgaatacttgcacgcatgagtatttgggataagcatgcctccggaacgccatccaccaccagagtacctgcactggtagacatgcggttaagtttgtatcatttgtttcaacatataataagtaaagctaaacatatgtacttctagcttgttgatgtgtaacataagcatggttatatacaagctagtgatgttctcatcagtttggatatttataaaaaacagcaataatgcacacgctcacatatacacatacacttacgtaataatataaatacacacacatacactcattaatacgaatgcacatgcgtatatactctaacccatacggtccaatatatgccttattacacatcactctctagtctctacttgcatggaagcacgctttatctaccaaccagcttgttcagtatgccaccatatatagattatggcacacatatcctccataaatcatcattttagtatatatttgctttctattcttgtatgtcataatgtcattcatcaaacttgtagcttgacaatgtacgtatatatagagggagagatatgagatatgatgaatcgaatttgaagatgctcggcatacccggagcatgtctaggcaagctgttgtccggcctggacatttctataattactaaaacttgaaaaaaaaatccaggaagatattaggcatttgtcattttgccccctatgttcaatttttgtgggttgttagtttataaaaatatgcatagtttatcaagatgggactgtaatctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17751 - DNA, 621 bp, Oryza sativa
acccccatcggcgccacggcgactcccgcggcgctgcacgtcgccgcacatgagcaccgaccccaagaaacacaaggggttcgacgcgtgtcgcgcgcgcatactgtggacgaagatcttgaggagtcggcgaaatgtaagccgtctgggaggtctccttgattggggagtcgggcccgaggaaggcggcggccgccagtggtggcggtggcttcttcgtacgcgctccgctctgctttgcttctgctgctccgctcgcaggtggggaacccttgcccaccaccgccgcccgctccaactcccacccaccgtcgccgcccagaccgccgattgcgccatgagagataaaagagagaagggagagatggaggaggaaggagaagagagaggggatgatatgtgggctccacatgtcagtgggccataatattttttaatgtgtgcatcacagataggtcccacagatgaatttttaattctactgccacgtaagcgccacgtgggatgaagactaggtcagcatcgccacgtcagcgccacatcagcaaaaccgctctccaaaaccactaagggagtcaacttgcactggtttcaatagttcgaggagtcgtcctatccggt

SEQ ID NO: 17752 - DNA, 902 bp, Oryza sativa
aattgtcccatttggtcgaaaagaaactctccccttgatcctgtctacaagttgctttgcaacaactcaagtagatgagacaaattttagttgattaataactatcctcccgcgcgacctaccatgataccgacacacaaacttcttccaataggcagtttccaactatttctcgtttattagtttcttttcattttccatatccatcaaccatcagctcaactcatgtctcatatctttggttcccacagctgtccaaaatctctagcccacaccgtgttctgttgggaagcctcaactatgatgtcattcgacatcccagttcacataggactgtttcagaccatgtaatggtcatccagtagacatcatgaccgattttggtaacgatttccaatcccacaaaatgtttgtcacaacactttgcaagcaaacctatgctagaggaatcaccttccattcgcccataaccatatgcatggttgttcgaacagtttggtaacctttgcagagggtgtgcactttactcacaagatgtgatcttaccttatcactggccaagtagggggttcgcgacaaggcctttccaaagctaaccgaggatacatcatgccacacaaaagggttctctctgaatcgagtatcagacaaatctcgaccatcttctatctaggaatctaggatgtcaccaatcaaccgtgcccaacatgttaaaatttagggaaattttgctacaggacacttgttatgtgtggttttagccctagaacactgcccaaacccacttttgggggaaaacactccataaacgtggtaatttgccagtggacaccgcgctgattaaaataatactttccggttgggaaggagaaagaaatcgcgtgaaatgtcaaaaatgccct

SEQ ID NO: 17753 - DNA, 740 bp, Oryza sativa
cgccttaacatagcagttggcgccagttatattctcctactcctccagcctcccagatcatcccaccagtggcgaagagagaataaggagagaaacatctagagtgaataagaaagatggggttcgtccgtgccctgttcctgctggcgatggtgtgcgtggcggcgcacgcgaaggactaccccaaggaggagggcgcgaaggcggaggggccggccgccgcctcggggggcggcggcggtagcacccacgacgtggtgaagctgggcggcaagggcgacggcaagacggacagcaccaaggcggtcaacgaggcgtggacggcggcgtgcgctggcaccggcaagcagacgatcgtcgtccccaagggcgacttcttgacgggtcccctcaacttcaccgggccatgcaagggcgacatcgtcatccagctcgacggaaacctgctcggctccaccgacctcgccttattcaagtcgaactggatcgagatcatgcgcctcgaaagcctcgaaatcagcggcaagggcaagctcgacggccagggcgccgccgtctggagcaagaactcctgcgccaagaaatacgactgcaagatcctccccaacgtatgcatgcatgctttcctgtgatcgatccatcgagacatacacattaattatttatttgatcgaccatttggtatgatccatggatataaatatatgtgcagactttggtgctggacttcgtgaacaacg

SEQ ID NO: 17754 - DNA, 733 bp, Oryza sativa
catccccctgtggagattatgggtaccccatacccacacggcatggttatccgactagttataggggataacttatatatatggaatatgtaacagatcatgacttgggtattacgtttccttatatattacggaacagcctaaagtcctagtttgataatattgtaaagtagatttaggaaaccgataccgtattggttaaggtttctatcttgtaatcctgccccccaccctatataaggtgggcaggaggccctctagggggcatgagacaacctgatcgtcagatctatactacacccggcggattcaaatccccaaacaggagtagggtattacctctcattgagagggcctgaacctgtctaaatcctttgtccctgcatccatccactttaggtctcgtgcgctacccccttttattattgccgaattcatgttttgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatactgatttttaatctcagattaatttcttgctattttttgttgttgttcgcatataactacgcggcactattgaggcgattgatgct

SEQ ID NO: 17755 - DNA, 709 bp, Oryza sativa
ctgcaccccgtccgtggatatggccatgcccgacgtgaccttcacaaggagtatagttcattaattactaatcaacatatatatgtaacaaatttcgcatttcgcataccttgatagacaagttcctgaatggagtatgcatatcgcagggtgttcgctgcgtgatatcaccaacggggaagtgggttgcttcgtgagctgccactgcctcaatgccctctgatccaacttggcccgttgatgcgcagctgctgcggttgcccgaggggctcaccatgacgggcgcttgtgtttccattccgcgctgctcggccaggcgttggtccacctgtcttgtcacctcctcttgcatccttgcctcgtaggtggacaccctgtactcaagatcgacgatcttagcttctgtatccctcttgctcctcatccaactcctatacgtgtggatgtcctctttgaatccatatttccaaggaatgacgccttttcctcgcattcgtcctagatgctcaggattctgtagtgcgagggtgagctcgtccttctctgtcgggccggaaagtcccctgcgtagaggcttcaattgcatccgcaagtcggcgtgctgcatctcgaatctcatcgccgaatatgagggagccatcacctggattgagcgatccaccgtgtgcatagaaccagttcctcgatcgctcaggccaattagccgtgg

SEQ ID NO: 17756 - DNA, 437 bp, Oryza sativa
gtggagtcggcgaagaagatgacggcgaggtcgatccggtcggccggcgcgtgtcaagatcgatcgagagagagagaatgcgagatcggaggcgcaagatttgcgcccctcaccttgagggaggcaacgctgccggttgcgttcgcgagggcagatgagcgcggcgagcacgacgacgatgacggcggaggcggcgacgacgtctggggcggtaatggcgcgggaggaagaagatcgatcgtggagaagtctaagtgtggtgcagggaagccgatgcagtggatatttatacccggtaatcttttgtcccggttcgtggcttcaaccgggactaaagatatctttagtcccggttggtagttacaaccgggagtaaagaacaaatgtttactcccggttgttagtactaaccgggactaaagacatctttagtccca

SEQ ID NO: 17757 - DNA, 597 bp, Oryza sativa
ttgtctttcacaacccacccacaatgattcacaaactttcgtcctatacccgtcggggctactggttcgccgtctggggcaatctcagtaacgatgtgccttccctcaagcttcatcgcgggacctcttttcccacgtggcctcttctgtccggccgacggttgactatcaatcccctcctcggtcccctcctagttagcctcctggttaccctcatcgttgccctcctcgttcaggtattggttgggatcctcgttcccctcatcatccacccagtactgactgctgccatctgcgatcgtgtctaacaggatttgttcgtcatcgcggtctgccatctatgcgtgcaaagaaaaaaagacagtgaggtcatggacatcaacatgtacagctcagacgtctaaaccctacaagtatacatgtataattcgctaagtcgttgttctcgttaagtcgttaagtcgctaagtcgtcgttctcgctaagtcactaactcgctaagacgctaagtcgttgtccgtcaaagtcgctaagtcgtcgttcgtgaaagtcgctaagtcgctaagtcgtcgttcgtgaaagtcgctaagtcgtcat

SEQ ID NO: 17758 - DNA, 831 bp, Oryza sativa
actctcgtcgacaactcttggaacattgaacatcttcgtcgtttctatgcttaagcttatcattgtggttcccttatcttgactggcaacatcaaattttcttcttgccgttgtcaatccggggctatcatcataataatggagtgtgattttttatcaatttaatttgcttacttggtctatcattgccttgtttgattttttctacttagtctgcgaggactgaaagtttttaatagcttctttgggttttaggctcaacaaagcttgataaaagcttttaagaaatcaaagacttggctagaactatcaagcacagcataaatacaccagtattgtacaaattgagcctccatttgctacatttacactcagtcagaatcaatcctttcatcatcagagttattattgctcggctgaaggtcgttgttgcggaattgctctacaacatcacttgcaatcttgtcagccgcactttgagcattactgataagatcaagagcagcttcttcacttgtcccgtctgcaaagccatcaatggtatcaatttcgattctcgggtacaaggatttggtcattgccaatgccatgctagctcccatacttccagctttcttgatgttcttgaagtacacatccggtgcaactcttagcttgtcaaagatctcggttgcatcaagtgcactcggaccactgttattaagaaacatagcttggacaagtggtgtagcgacattggcgacttcgtctcttgctccttcaagcttcttgatcttaccaaccaggacatcaaactgagcttgagatttgattttacggtctacaaaacac

SEQ ID NO: 17759 - DNA, 703 bp, Oryza sativa
gtagctgacgacgatggcatttgagaagattttatacattctctccttcatgattttgaaatccagagagtctggttcttcgcgattaggatcatgcttgccgtcaaactcaaaagctgtatgggatctttctttaattggcgccagtcggcatttgatgaaatgccgagtgatctgctctccttgcaagccttgttctttgagttttaacatgcgatccaacaattccaaggcttgggcagcttcatctccgattggaagagagttccaagtgtcttggtacaccggaggaagacaagaatactcgggaagagcaggctcaggattctgaacataaaaccagttcgcatgccaccctttgtttgaggtcttgaagggcatagagaagtacttctgactcagagttcccctcaactgaaatcctgcccctccgactacacatggcttattcttgttcggttggggcttgagaaagaagatccggcgaaacagagcgaagtggggcctaattcccaaaaaggcttcacagacatggatgaaattggcaatgtggactatggaattcgggtttaggtgatgcaagctgattccatagaagcttaatatcccgcggaaaaatttcgaggtcggaagagcgaagccgccatagaagaaatgagagaagaccacaatctcgtgtgtatcgggggtcgacaaaatctca

SEQ ID NO: 17760 - DNA, 1125 bp, Oryza sativa
ttatgtcatgtatgctccatctagtttgagataatgtgattgaaagagtcttgaagattgtatatgtcacctagagggatgaataggtatttccaaaaatttcttaaacttacaaacagcttagaactaactggatagtccggtaccactgcagacaatctgactatagagcagtcggatagtccgactgcatcagaacaatccaatcagagcatcgccagagaaaaactataagtgacctggaaaatagaaatagaaatgaaaaaataatggtggtggtggcaggatgtagcgtgggttgatcgtttagaagcacgaaagctccttgaggcagccggtggcagtgcccttggcattcttgcagacggccatggtcttgttgtttgtgccagagtactcgaccttgatgtcattcaaagtgacgccggtgcacggcagcttgtctgagcagaagaggctaacggcctcgggcgtggaggaggtgccggtgatgttcttgaagtgatgtccttgatggtgaccttggagttgccgttggcagtgcagatcttgttggggcagtacttcatgtcgatgatgatggggttagcaacgtcctccatcttgatgttctcgtaggtaaacttggaggtggtgagcaccgaggcggcgtcctcataggacttgatccggacgccattggtagacttcttgagcacgcagtttttgacggtaacatcggtcacatccttctcgtccttgtacctgcccaggctaccgacgctgatgccgtggccaggaccgcaggtgacgccggagatgttgacgccctcggtgccggggccgatggagatgcaatcatcgccggtgccgatgaccgtgtcaatgatgctgatcttggaggagtcgcccatgtggatgccgtccgtgttcgggctgtcccccggcgcggtgatggtcacgtccttgatggtgatgttcttactcttgaacacgttcatgtggaagaacttggggttcaccagagagatgccgctgatgagaccgttgttcacgaagtccagcaccaaagtctgcacatatatttatatccatggatcataccaaatggtcgatcaaataaataattaatgtgtatgtctcgat

SEQ ID NO: 17761 - DNA, 465 bp, Oryza sativa
gcgccggcgcggcgcagccgttggaccagcagggagcccgcccgctggatctccgggacgaacttgagcgcgtggaagttgcacctgcatcgcagcctctgcaagaaccgacgccgacgccatgagcaaagcagaggatggatggcaatggtgcttctctcatctcgacaagtgcgacgatcgaggaagatgaactgtgtgcgtgacctgcagatgaacgggcaccgaatcgaagccgagccggttgccgaatccgaggaaatggacaacgccattctgctggagaattgggagcacagctttgatgaattcagatggcgcagcttctttcgagatgtccatgtctgtgatctgtcatgaaacagagagatttcgcatctgtttagactttagagggcatgaattctacagaaatttctcaagatttagtgaaaaaattatgatcttcaaactgatcatagattt

SEQ ID NO: 17762 - DNA, 727 bp, Oryza sativa
  unsure (1)..(727): unsure at all n locations
aagaacaaagcacgtcgaggaagaaggacgacgacgacaccccggcaggttttcaagatcaccgcaaggagctcaaccatatcttcggcggccccctggcttatgagtctaaacggaagcagaagttaactgaacgggagatcaatgctgttcagcccgacacgccccaatatcttcgatggtcagagatcgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccctggatgatatgcagatccctcgctccgagttaaaaccaagcaatgcgccttttcacggagtgattccaggattatccgcaactccactcggccagatcaccctcccagtcacttttggcactcgggaaaactttcgcacagagaacatcagctntgaagtcgctgatttcgagacagcataccatgccatactcggacgcccggcgttagccaagttcatggccgtcccgcactacacttatatgatgatgaagatgcctggtccccgaggagtcctatccctacggagtgacatcaagcaagccgtcacatgcgacaaggagagttgcgacatggcccaaactcgcgagatggcgtctgcccgagaggatatccgactggctgc

SEQ ID NO: 17763 - DNA, 671 bp, Oryza sativa
tccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgaggatgtagacatccaacaacggcggcataataggccagccgtgtaggcggaggcaccactcggcggcgacggaggcaagccggcggtgaagtcgtagacgcccaacagcggcggcataataggccagccgtgtagccggaggcaccactcggcggcgacggaggcagg

SEQ ID NO: 17764 - DNA, 267 bp, Oryza sativa
ttctcgcaacctgggtacaacgttgttctgtggtccgctaacatgcgctccagtttctgcacctccttttcactttcgcagtcctcctgtaagtcccgcaatatttgaccaagttcatcagcaccggcattcccttcaacatccagctccgcctcgcccattgtgttttcttcaaatccgccatactgagcccagtctggaatgttctcatcttctacttcatcttcttccattgcaaccccaacctctccgtgcgaggtccaacaa

SEQ ID NO: 17765 - DNA, 2708 bp, Oryza sativa
ctaagcagccgtccgtcgagaatgaagaaattcagactccggatcgtgccgcaattctgttcagggacgattttaacgaagactatggcaataccctgaactattttagcaagaagaaatcacttgttcctttgccacctcccgatcctatggaattgggcttcctaagggaaactgttcagagttaacatccataatgagtgacgaatggctaagggaggcagagcttttatccgaagtaattcggatatgccatctggaagggaacgacgtcagtattctctacagtccaactatcggggccaatctcgtctccgagtcttttgcattagcttatttatggcaattgtatttattaattaggattttaatgttggtttaaattaaagacatggtatgagtcctccatgtggtcttgtttgttgtttttatctttaggaaagtttgagtcatgtccataatagacaagttttgtactctaggtataaatataaacccaagatcattataaaacaggacgaacttccaataaatacaactttcggcgcatcgccacctttttctttaagtttttgacaagtttttgcttcgagtcggggcatcggttgtgatctctcgacaagaggtaacttgtctcgatggtttgcattaatggggctattgcgtcgctttagatgtaatggtctcatttttctagctatcgtttatcatatatcttacttaatctagtctagtatctcgatttagtatcggctgagactcgctttaggtttatactggtattggctaaattacctcgctagattagattagctaaggtatctaccatcctgaaaattagttaattacttgattgtttagactttaggtttctttacatactttgagatgcatcaaccctagtcttgtctagaaccctaaaaactaacctgtaattaatcataattagggatagtatcagagtttcagctgatcttatctaatatataatattgcatgctagagtaaattaactggtgctacatggagtatgggctccaacaatatccaccgtatatgtgctttgagatttgtgctgctcaaaccggagtattagacatattaacgggtaaacccgattagatctttccatttttagagtacccgcatgatttgcatgcgtgcatgtattgcaggacgtgattgcctttccatataaacgtactcacatcgtttccatataagcaaacatgtacgtaataatttccttccgattgcatgataatttatttccatatatgatgcatactttcctttttttttttgcacatgctcacatcgtttccctatgattgtgtgaatttatttccatatctgagatgacactgaatcaaatccacaaattttgagtaattccactaattaggttgtaattgatttatttccataaataccgattaatattttctactttttgtgtacatataaaatggtacgacatttcattttttacacactccactgtccagtccacgctattaccctgccggccggacgtcggcgagcttttcatcactgccggttgtctgcaaggtttcgttgccgttgtcagtcatccgttagcttcgtaaccacgccgttacgcgccgcgcgccggtcgttcgcaaggttcgttgtcgccgccgcaggtcgcccgtgaggaggttcatcgctactatcaccgacggtcgccacgcgtggttcgtgtgtaattcatttcaatttattcttgtattttgacaagtccctgttctaccgttttcgcagattgagtactgtaacaatttcatttcgttgtcaagaccttaagatgggaatgcatcctactaataagtttttggtttgtcttcctagtgagccaaagactgtacatacgtatgttgccctgggatcatgcggagaagatggtcgtgggcagaagaaacaccagttggatgcacgcgctaagagctagtgtattaacacaagtttttttaaactgatgttcttttcagtgtattaacatgaaatttgcacgttgtaatcatgcaaattaatacagaatattttggtactatgtatatacctaccatcctactatttcataaatatcagcaccaacttaatctacatcggtagaatatacatagcacacgaggcttatatacctacatctataaatagataggcatatacccaactagatttatatacttacatctacttacatctacatgtatctaattacatctggccaagctacctagctagagtataaaaaaacttaactaaaaggcctagctagcttcaaatttagttcaagaaaaaataagctacttgaaaattaaacttttttgacgcgcatttggataggtatataccaaactacaatctaaaaatgggtgtccaaaatatgcaatttttaatgggtatatacctagaatgtgtgtttagaccagtatatacccaaatagaatatggtatgtcacacatacccaatatacgtgtttaaatacctaaaaatgtgtatcctaaatagtattatacccaattaaatgtacatctcaaatgcattcatgtaaatacctagcttgtagtacgtttgaaacgtatgcacgtcacatacccaaaaagttagaaaacacaacacacgagacttatatacatacatctacatgtaccgaattacatctggtcagctacctagcgag

SEQ ID NO: 17766 - DNA, 114 bp, Oryza sativa
tagtgctagaaaaagtgggcggcctcacacgaagaaattctgctaacttgttctggggaggtgcatggttatttctctggttctgctggttctggagttgctgcatcatcatgt

SEQ ID NO: 17767 - DNA, 716 bp, Oryza sativa
attgctccaatataattcgcatccctcaatcgtgataacaaatatattaaccctcaccccctaactattgaaacggatgtaatttaattcccttagcggctttgagagttgttttcgctaacatggcatgttgacggctgactcaagatgtggaacccatatgtcagtgtcacatttccttttcccttcccttttcttctctcactcttcctttcctctctgctaccatgacgacggcagcctcgagaggccggtcagtctagatagtggcatgtgcggcaaagaagctagcgccctgacggcgggcatggtcaaccatcctcatgccccctacccacgtcgacgtcaaacagtattagccagcatccccacctcctccctctctgccctggtgtaggcatcgagctcactccctgccttcctctctagtggtatggcggggacgtactagtcaaggaagtcgaataggagacggttgatggtgtcggcgctgtaggtggcgtcaatgagccatccgatcccaggttaggggagagcggtgttccaattgagggcaacgctttgggctcgagcttcggcgccaaccggctctagtgaggcccacgtgcatggagacggagtggatatggcggcacagacgctggaggaacaagcatggttggagaaagcagatctagtggcaggcaagatgctgaatctcgagtaggggtgaaaac

SEQ ID NO: 17768 - DNA, 3281 bp, Oryza sativa
aagtactcaggcttgtagcgcggcatctaagacaagtgaaaggagggaattaagtcatttatcccgttaatagcacaagtttttgggttaatttgaataaagttagaaaatcaaagtaaaaggtaaataaataaagtaaaccaagcttgcaagataagttgaaacagttggaaacaggatcacaaattttgcacttttgaacaacaggtttcaaaaaaaaaaaaagagggttataaaatcaacatgctaaatttatttcattgcagcaagattaaataaaacaatgttgtaaaacgctttgctggtaaatgggccattagtacagtaatagatgtacggtactgataacacaggaataataaataaattttaaatgagaacaattaaaggaattataaactgcatgtgccattagtttggtttaattaaaagagaaagggaggagaacagttctacttttccaatatttttagagggcttgtatgggtaaccatttggcataacctagggtcaaggaggctctgataccaacttgtcacgcccggaatttctatccaaaattccaaacgcttacatgtgtgaaccctcgtccaggaatcagccgaggcacacaataacaaattgataatagagtacaattattactctaattaataagcgaataaaatgtcattacagatgtagatagttcctctcaatcaataaagatctaagcagcggaaaaataagataaacggcgcagacgactccactccacaggcagcttgaccagggctacacctaatcctccacaccatcagcatcactgtagaactcctcctctgatgaatgattgcaaggtgagtatatgacatactcagcaagccacgcagcaaatatgcaagtgcacgggataacaaaggatggcataatatagtctcatttgcataaatagcatttaataaacatttcagaatttcataaaacagtaaagtatttcattaaacagtattaatccaacgctatacaacaaaccctgttgcataggcccaaccattgtgaacaaccaatcccggctgcacagttctatctccaaaccaggaatatatcattccaaaccaggagctaaacaaattattaacatcatcatttattatggtgtgaaatatgagactaatcacgaaagacattgttagacccgcccattaccgcgggcacagctattcgaatagtttaaactctggccagaggtgtaccactgtacccacaagacacaacctcaacatcatgtcaaccatgcgtcgcgatacttaacaagtacccgaatagagattgtgacaataccctctatataacacaattcaaagcagtgcaccattcccggatcataatcacccccttgcaaacaaggcatggactccccagcgacccccgtgggcttatcttcgccacttcacagtctggtgctctacaatgaaccatactatacagaaagtaaagccgttgcccacgctggcttgtggttggcacggtaaatgtttcacaaccgaaaatcgtgaaccggtccttaattgtcatgagcacgaccatcaataccatgtgctcacatcccaccattatcaggttttagttggcaaattaattaattaaccaatcatgattaaccatcatgagctatcattaagccatcattcaataatagtgaatcataagttatcccatttatatgagctagtgtctctaagcatggctaagcatcctattcactttagctaaaaccatataatgttctagctaatcaaattattaacaaagtgacaaagaatagggaaccaatagcaaaagggctataacaaggcaataggttctttccacccaatgacatttaaaaataaatgcagtagttgaatagaaacaatagctttaaacgggatcaacatgctcaaaggattgttttgggatctgtgtgacttgccttgctggccttggaactcttcaaaatcttctcctgcaaacacagactctccgggaacgtcggaatctaaacagaaaagagcaaaatcaccaaaacagcacataaacaagcatgaacagtacatgtggatatttttaacatgtagatctcaattttagaaaaatttagagacttgaaccaactaaatccgaactaagatgacttagttatgaattttcaaagattaaatcggattaaatcctttatatagattttaattgaattatgacgcaataaagaattatttttgaaaaggaaaagaggattattgcatcagcgggctcggctcacggaacgaacggccgagatctatcctatccacaacggacggccgggatctatcggcccacgaccggtccacgggacacagcgacgatgacgtcggcgatgacgtcaccaccggcggcgactcgggctcacatgctcgccggcgaacgacggcgcggcggctcaaacggaggacaccaacgggttgtgggcattgcggtgaactcaccggtgacctaaacgacggcggacgatgaccggacggcgacggcgtcgaggaagaagcggcggcgaccttcggcttgacgacaacagcggtgttccggtggtcttcggcaaaacggaggatgggacgaggatggcgatgacttggcgaacccgacggtggccttcccgagtgacgacgacgaccggagcggcggcggatcacggctagacaagcggcggcaacggcggcgcacgggctcacgaggctagggcgctacaggcggcggcgagctaaggcgagggtggcgacggatagaggaggtcccgggggtctttttatagtggctaggggcagcgatggaggcccaaggcaaccggcgacggaaaggaaaggttagggttcgagagagagagaggaatccgattcgagatcgaatccaccgctttccaaacgattttagccgacgattccaaaagagaaaagatagaggggatcccggggatcatttcccctctattgatttcaccggagaaggaaaggcgcggccgaatttggaaggagacggcggcgcggctcggctagggttcggccaggcgacggcgcaaggaagacgacggccttgacaggtgggccccacctgtcagcgggcggacgcgcacgcgcgagcggcggctcggctgcgggccgacttgggccggggaggagagagagagggttttgggccgactttcggcccaaatccaaaagagaatttttaaaacctttttcaatttaaattattcatgaaatgcaattccatttattaaaaatact

SEQ ID NO: 17769 - DNA, 1479 bp, Oryza sativa
gcgccttagcaaccgatacaccgtctccaatggtcgacgcgaacttgtggtgcgcgtcaacccggccacgagggcactcctcctgcaagcaattgaagaacaagcaagaacaagtagaacaagcactgaaattgctatataaagatgaaagtttcactatcaaatacaatatggtggggttccgattacaggcagacgagcggtttagccaacacgcgcgctgtgagccggtagcaagtagctatctctatcatcaaaacccgaatgttcttggcggcgactagaggtataagaagaggggaagaacgaccatagggtcgtgctccaaccctaggacgtgcccctaatgggcccaacttggatacacagcccattgggccaaaagaggtgacgcaacaccatggacagaaaacagtcgggagtaaaatgacaattgcggccgctccagaatagatatggacatgtggctggatccatttgaaagtagacttgataagctttccatgaaatacttgcacgcccaaatcggagttcgcttgaagtcgtggcggccgtcagaagttggcgctgccctgcagtccgaatccaccccgcgcgaatcctcttccctttggatcctctccatcgttcctgagtaaaacacaagtgcacgcgtctccggggtataaagacgaggcatatgaactcaagaaagaactcacctgataatttagttgacgtgcacgagcgcgggtaatagaaccatcatgttgtacatggggggacgtggatgtatcgatggtgttgatgtcctcatcatcctccccttcttgcatttgagtcgtcctcgactcatgctcatcttcttctcccaaatacggcttcaaatctgcaacgttaaatgtgggactaaccccgaaatctgcaggcaaatcaagcttatacgcattctcattaatctttgctaacactttaaatggtccatcagctctaggcatcaatttagactttcttaaatcaggaaatcgttcttttcgcaaatgcaaccaaaccaaatctctaggttcaaaattcaattcccttctacctttgtcaccagcaaacttatacttagcattcatgcgctctatgttttctttagttgtctcatgcagttttaacatcaactcagcacattgcttagcatcaaaattcagtttttcagaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtg

SEQ ID NO: 17770 - DNA, 984 bp, Oryza sativa
catggctgacaacgaaacggaagaacagcgccgagcctaagaagcggaccaagatcgcgcacgacaagaagctgaacgtcgccgactggaggaagtgcgacagcgacagaagcgagaacgaatacagcgtgagcaacaagatcgcgaacgggttgcaaaggaggctgaagatcgacggcaacgcgctttggaatccgggtgacgagcgagagagttcattgggcaacaagacgtcgatggaacagcggtctttcgcaccccccagcagaacgcggttgcagcaatcactcttctcgacaccctcctcaaagaagacgcactcaaccaagctgatcatgtcgtcaacatcttgaaccagacgaagaccatgatcgctgcctcggttccagccaactccgcaagcacccgtaccccgactggtagccgagtccctcacctccgatctcatgatcatcatcagtcaaacctcagcatcaccggcacaggatctagtcgcaggagcaggggtcacgacgaacgatctattcactcgcctcccgaacgtcacagggagcgccgagtcgaacggcctcgctctccacctcaccagcgccccgtcgatcttcgcgacacaatcaactagcgccgtgcagcacgaggtcaccgccattcaccaaatcgctacgatgacgacgtggatggagtagctgccttcactaatgacctgcgtcgagtggattggccagtcggctttaagccgactggaatcgagaagtatgacggcaccactaatccagagtcttggctcaccgtctacggactcgcgatccacgcagcaggaggagacagcaaggccatggcaaactatctacttgtggccctagcggactccgcccgatcctgtctccacggactaccccgtggcacgatcggatcatgggtggaacttcgtgatcacttcatcgccaacttccagggcaccttcgaacgccccggaacacagtt

SEQ ID NO: 17771 - DNA, 1383 bp, Oryza sativa
ctaatttatttgtgtactatttatcttgtattggcgtttatgagtttgtgtctgcttcatgtttgaaagagttttttttaagttttctatcgaaacaagatttcggcaataataaaagggggtggctatcaagctaggaaagtggatgggtttggagacaaggaattttatacaggttcaggccttcttattcaagaagtaataccctactcctgtccggggatgattccgccgagtatgttattgattgtatgattgggaaaaaagaatcgtcccgagaggaacccggacccctccttatataggggaagggatccataatacaaagtacaatccatatcctaacggaatatgggattacagataaaatacaatcgtaaccgactaggatcccgtgtagtttcttgacatacaagtttagaatctaacccgagtcctcataaagatattctatctatatttggtaccgtatatccggctggaatataaccgccatgtagatatggggtaaccataatctccatagtagcccccgagaccttcgcagttgaccaaaatagtcttctcaaaacaaaaaacaataatccgagtgcttcaattcaacttgctccggcttgccgagtgctaaaagactgtgaagggcgaaaataaaacatggtgcatcgagtagatgcacctaattaggtgtagcccccgactatgtgattagttgaaaaactaaacatatagttgagaaacaaaataataacacaattgtgcatcatatgacaaaagcatacacggcgcctagataggcatgctagccgactgctttttagccataatgaaaagagtccgagtggtttacactctaaaaggttcacgaatgaacacactggacaggcatccgaatataaaactctaaagattacccaccaagtattataaaaattatggtaatgaataagtctaatagcctgggccatgactatttaccataatgaaaataggtatatagcataccaaggaagtgactatgataaaaacaagtcattccaaattaacccagacagcttttgtagcctaataaagctaacaaaaagcagtataacacctttctgtcgggcaccttttaatttgcattgcaataattccaaagaattatatgaccgcataaaaaggattttatcagcattgggcaacactattgtgcgcataatattgccaaagcaaaatatgcctaagtccctaaggaacacaatgggccacgctgttaaaagtattgggctgaggtactgttcaggcctaggcccatttgcacctccgatacccttaacaagaagtcccgagatccaagcgacgcttcgtcttccccgccggaactctcgccattttccccactcc

SEQ ID NO: 17772 - DNA, 645 bp, Oryza sativa
cgtcaggttttcgggactgatattctaagggaaaccagaaagagaaggtaaagatcattcaagaaagattgcgtgtggcttagtctcgtcaaaagagttatgccgacaatcgccgcagagatttgagttttgaagaaggagatcatgtgtaccttcgtgtcacgcctcttcgaggggttcatcgttttcataccaaaggaaaattggcaccgcgtttcgtgggaccttataagattgtcagtcgaagaggtgaggctgcttatcagttggagttacctcaatcgttggcaggagtccataatgtgttccatgtgtcacagttgaaaaagtgtttaagggtacccactgaggaagctaatcttgaacagatagaaatccaagaggatctgtcatatgttgagaaaccaatccgtattttggagacagatgagagaagaaccaggaatcgagttatccttttgtgtaaggtccaatggagtaatcactcggaagaagaagctacttggcaacgagaagatgaattaaagtcagcttatccgcatctgttcgccaattcttccgaatctcgagggcaagattctgtttaaggggggtaggtttgtcacaccctaaaaatcctaaatatataaattgttgtttaattgg

SEQ ID NO: 17773 - DNA, 1035 bp, Oryza sativa
atagacccatctgggaaagactctgacccgactaacatggacacgagttcttccaaagaaaccgggccaactgttggggatcacccgagtgacaatcagccggcaaccgataatgtagaatccagtgatcaacctccaactggaacccagtcggtcgaagctgaagccggagttaatcaggagcccccgactggaaaccagtcggacgcaaggtcaagccaagagactccagaagtcgaaacccaagcagatagccctcatggacaaaacgccagcaataaccagagatctggatctcctttaaaggcatccgaatccactcgtcctcgtccagaaatcattacgggtaaacacttttgtttgaaaccatgttgacccaaataaactctgatcaattgtctaacctttgttagcgaatacattaggaccaatgattagtgatgaagaagaaatcccccgtatacaagcagccgaagattcgtgccctcccattctggtcaagtggtgggatgataacttgcagcctcaaggaattgtaataaaccggcaaaaagaagacgaagaggtctgccaactgaaaaaggcactcaaccaagcgactcgcattgtaaatgtaagttctctggtacctgatctcaaccatcttgtttgccatttaattcatgcgctaattaaactgtcttgcagaggattcatctcaggaaggaagccaaaacggcaaccttagagaagttagtccctcatctcggaaccctcgaagccaccaggaatcaactgcacgaagcgaaagagcttgccaggaagaatgaacatgacctgagggatcggatcgctgagctccaggaatcaaattttgaactgagtggcacatcaaaaggtacgcacaaaccctgcttaactgactcatactgttatctttgcaatcttccgtaatcaatgtagtgcaagctgccaagatatctcagttggagaagcagattcaaattctggaaaatgacaaggcagagctggcaagacaaagagacctggctttaa

SEQ ID NO: 17774 - DNA, 705 bp, Oryza sativa
attatttcattgttgttgtccagatgaaacatttgaaaaagggggaaaatattctcagaagcacgcggctaagaccttctctcgagttggaacaactgtactgtcacttatccatgtttacccatgagtagtgtttgtaagatcagatgtcagctgatcatctcgcagagatggaggtgatgaggtgatcgtggaaaaattcctgcatgccatcggattgtaagccactgcatgcaatcactctccatttgcactaagtatcgcaaaattttccatgcagcaattttcactggctgataatacttcgatcactgggaggcaatcattgttgatcggctagcttaattgttggcagatggggcactaccaccatcgtccatcttctttcggcaaagcttctttaacgcacttatgaattgcgcatacagccttcccttctcaactttaatatcatcaatctccttcacgctcgccaacagcctactcgacagtgtactcggagcattcttctggagcctccatatcttcctgttgagtcgacgtacctacgatatgacaagttaagaaccaaatgtcacataaaataaaatggttcctttaacacgtacacacagctgatatatacctctgtcatcaggtagcttaatgttccgtcgtttcgggcaaattcatcgaaggaggacagagtattgatttccttctcag

SEQ ID NO: 17775 - DNA, 6107 bp, Oryza sativa
  unsure (1)..(6107): unsure at all n locations
agtggtttgttctttatatcagtccatccatcagacacaatagaaacaccttgtgtgcacctgcttgatgcaaaaataaagaagtgatagtcaataactcaatattcagttaaaaggttaataaatttgcacctatacaaggatgaaaaaggttagcaactgaaaattaccatgtacttttgactattgccaaatcatgttctacgcttcttttgcatgcatctagcagagttgtccttgccttctcagaggatggacctttgtatccactgggagctttgttaatggctgtgaccatttcagcaaattgtgggcttctcaatatattaaacggaatgccgttagcacataaaaatttaactattttcatatctgcatcatgtcttttcccttctccaaagcaatcagccaacggattgccctgcctagtaccaactgatttcgaaccatctccattttgttcagcttttttaacctactcaaatgacaaggatgccaaaataagacacatttctacttgctaagaaagttgaagagtaaagggttaaaggaatacttttgtaccttatcccgcagagctttgcacttgataggatcttttagtagcgcaacacagcgtgctacctctgcttttttgccaggtggaggcccaagcaaatgaatacgaattctcgttaagctacccttcaatttcttctggcaatgcttacactgccactgttttgttccactgtcgttctttccttttggtgccttaacgacagttacttcatcgtaaagagggtttacagtaccactctttttagatgatcctgcatcttcttcctcggagccatcagccccaagttcatcgttcgtgttactgtcatcttcgtggacgacaacgtctgcatcagctcctcctacatcttcatgtgctgcgatctcagatcgcctgcgtttcttggaaccagatccaaatgccattgtatctacagatggtttgtatgaagattggagaccttatatttttctaaactgaaacacggtacctgggttgagtttgccggcggccggcctgacgtcgtgagcgcggctgagcgcttgacagcttgaaccctggactggatcagcagcagcaaacaggaatgcagtaatgcttgatctcctttgaggtgactcttcctgtgaccaacaagctctcctattaatatagtgcttaaggtgacgcctcgtatttcaattatttcttggtttcagtccacagtccacactcatattaagagcaaggtcaatagtgtagccagctactagctccaataatatccatgtcattttatagccaatatcaaaactaactagtacaataggttggctattatatcaacatgatctcattattcaaacaataaactttacatgtgcatgatcagaaacgccctcaactctgtggcctatatggccatttgtattatgcaataaacatgggttatctactactctacctgaaaaaataacgacaacacacttgataattcacatagtatatcacaatccactgccgtccaactgcataatctataatctatacatgaaaaaaggagaagaacaaaagggaaaataaaaggagctataggaagagattagaacggactagatgcaacagatgagacgaagaatcggtagaacagacatagacgacaagcattcaacagaccgagggagaagaaaagaaaagaattagaccaagccaattcaaatcaagaagttgcttgttgctttgggtgccagctgcatgcccgcaccaagcgcttctcaatcctcctctcgctttctttgcagctgagaactgggattactaactttttgggtgcactggagctttcacggcagagtttcacgtcgcgggagaaaattccggcgagacaggggtgaggggaggcggcgtgaagcagagcaaaatgcgtcgggcggatcggaagaggcacatcagaaacaaaacgatacacgggatcggcggggtggctgcgggacccacaaatgcatgtgtatctgtgtatcgcccggcgctacatctagcgcccgctctgttccctctctctagttatctctcctccacgtaagaatagtctgagttggaatattttggagcctgctgattaggcttattgtacttgctctaatgaccaagtctaggaaactgaaaatacgaagagacaccatcttgtgatcctgtcacgttctcaacaacatagaacattagcacgtacagatattggattattgaaccatatttacatcattttatagtttgcattctttgagtcatactgtgcgtagtggtgcacaatgacggatccagaaaaatcgattcgttggtgtctatcagtgtcatagtgtgctaatctggggatgcgggtggcaatctgggccgtacgatccggtgatccgacggtttggtttcgctataggttttaccgaaagtcgttgatgtcactatatatagtttgcattctccgagtcctagtgtgcatagtggtgcgttcgaacgttgacgttaggaatttatcgatggttttcatctcttagagtgtgttatagatgccactaccgctgatgtatagatgtgttactcaggtatagtggagcatgatcggttaatgttcacatcgaacatagcctatcatgtactccctccgtccaataaaagggcaacttagaattggatgttgacacatcttaccattgtccaatattagatgtgtcaacatccaatactatgttggttttttataggacggatggagtacacagtgaggctagagatttgccattgattgttgccagctcgagcgtgttacaaaacacattcgctgatatatgcatgagttcgtgagatttgggtgatgggatatggtcgccacattttgtatggtgtttggttcatggtaaaggtggaatatggccgcccacataaaaatattctataaagatgttggataaggctatcccatgattcctatccaaccttatcctccaagtaaatgggtatattcacggatatatacacatgaccttttttttttattctaaagcacaatacaaatgtagttgaccacaacactcacaccttatttttatgagcatctccggaagattgggctagtatatatcttgatattgaagaagtaacaacgggcgttttgctgtcataccttgagaaaaatttgccataaatactatttttttatcattttctttattaacatagttctttgtttacttaaaaagtattattttacaacaatattaagtaaaacttgttataatatcataaaaaataaaaaaactaaaggtttaaccaaaaattgttaaaaaataatttacacgtttctatttaagttatttaagtaacatacacatttcactcaaggtgtagttgttagcacactggtcatggcgcctcataggcgaagacgacgtcgcgtggtcgaccctctggttcttttttttttgccattcatgtgacagcagaccatttttttttttttgccattcatgtgacagcagatttttttgccattcatgtgacagcagaccagcctagaaaatttttgggccatgcgtgcaaacaagcccatcaagagaacgtaaaagtgagccctagcacttcgttcgtcctcaactcctcgtcagtggtccctatcccccagccaccgccgccgtctcctgtagtccaagtctccaataccacaagctcgatgcaacgacgacggctgcgcgatggcttcatcagccgtggcgccatctgtggagaaaagcggttgtggcgcgccgcgccgccgctcgctggccggccggcgcccctctatttctccaacggtccactccaacctagctgcgtgatggagggagaaacgcggctgcggcagcggcgcgcggcgcgccgcttgccagcgcccttctatttctccaacggtccaacctcccatgttcgacggcggcggcgagcagcgaaggaacaactgcgctgctcgccctgtctccaccaatgtagatccgggtgagtctccactctccactagcttttgctcaacatacctcgttcctccatcgtaccacccttctcgttcctccattgacgtaccaagtgttgggtcgacgatccttccgtttttggaacgaagttccgcttcgttcccgttcctcgtttcgagacgaaattcccggaacgtagaacgcacccacgttccgcgtttcctgtgacttagaccggctccaccagtaagatgtccttaatttctcattagccgatcatagtcgatattatcttacacttatctttttgtagcctcttcctcctccctctcctgttcagcaaccaccaaacaatcaaactccatcggctgcagggagtcaccatgttgaggaagaagtacaaccagctgctcctgctatcccagtaagtctcttttaaacaccaagtcttggatcggctatatctgtttgacatctaactgtcttcaaatttctctattgtaggccttagccgatctgttctctttagatattaaagattactttgatgagacagaagaagaaaccacgagcaaggctctagcccccttggatgacactgtcaagaaaacacttgaagacatatccattcggctagaatcttcattggataatctggtggctgattgtggtttgatccgggcacgatttgctgaaatccaagcctcaattccggacgatctggcaaacaccattactccagccgtgtaccttgagcaacaccaattcaagctggagaaggccaagcaacggatagccgattggcgagaacagaaggacattgaagccactatccaagccaatcggcagcttgtgcatgaagagaaggctaagttagatcaactctctgttgggcctattcagtcgaatatagatcggcttgaagctcgcaagattgatttaatagctcaactcgaggaatgcaacgccgagctggatcttgaaaaacaaaagctagccgatcttccaaatgttgttgaagaacagaagtccagattgagatcggctatcaagaacgtggctgacatgactaagtctctcaaggtcatccccggaaccgacgcccaagacatccaggccatcgaagaaatagatcaaatcaggcaatgagctttgtcggctatccaacgctatctgtgtaatagatcttaggaattttttgtaatcggcgaagaaactctgactctttatgtaactcatcttaataacttttatgccgattcaatataactccatattttgctcaaaaatttttgcaacttttgcatatatgtgcccccctaattttacaatgtcgaaagcatttataaaattataatatgaactaagggcgatataacaatatcggctattgtacatcagcaaaccacaaccgattacaatagaaagacaactaagggcgatataacaatatcggccatctcaaagcgatgtaaacacatcagctatcatgtatcggcaacaccagccaatcatgcattaacccaaacacttgggtaatatttcttcaggtacttgccatttagcgctcgtccatagacttctccatcgagtccttgcaacatgtaagctcccttagacacaaccttatagatttggaacggtccttcctaattcggcgaccacttgccgaatttgttatcccgagtcccaatcggcaaaatcaacttccatacaagttcaccttccgaaaaagtcttggacaccaccttcttgttgtaatgccgagcaactcgttctttatccttggtaaccttcgcaagggctcttaatctagattgaaccaagtcttccctttcatcggccatgagatgataatattcatcggctgtcaaatcattttgtaactccgttctccttgagccaattctaacctcccatggtaaaacagcttcatgttcataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17776 - DNA, 761 bp, Oryza sativa
tcctgcagcccagaaatgacaggaaccagccaattgagtcaaagaagaataggtctctcctaagatgtttactgaaaacgttaccacttaattatttttctatcaatattattcggcctaaaaaaatgtttttggattcattgaaatcagggtttaaaaaatatatttctataattatatcacatccggtcctggtggtacccaaaccacctttaaagttaacccaaacctaattaaaccttattccctttggccaaaggactctagtgataatggctgagtgccaggtaaaataaaaaatagtggaagaaattagtgcaaactctcgttaaccatattgtgaaaataatgaatgttggaaatgcacttctaatagcatagactgaaacaaacattctgaggggagtgactgtcatagtacctgccatggctttccaaactcatttaacgcttctgtcagctgttgctctgctttgttccaggtttcaatatcacctaagtacttttctggtctctgcaaaaaaaaaaaaaagagaaagatatgcaacattacaaccatgctgaggatcaagccataaccatcagttattcacatattgttccgtaggatgctgagaatttcccaacattaccagttcacaatagtgataggaaaatgggaaaacaactacctctgtccacaaatataagcatttctaggttgttcagcagatattaaggttgaggagaaagactctggtgcccctcattaaaggaggaat

SEQ ID NO: 17777 - DNA, 81060 bp, Oryza sativa
  unsure (1)..(81060): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaactatctgaaggcccaatcaagtccaacattgatcggctcgaggctcgcaagattgaactcttagcacaacttgaagaatgcaacgctgagctggatatggagcacaaaaaactagccgatctcccaaatactattgaagaacagaaagcaagactcaaatcggctatcaagcatgttgctgatctgaccaagtctctgaaagttatccctggaaccgacgctcaagatgcccaagccatagaagaagtagaatagattaggcagaaggctatattggctatccagcgatacttgtctcaataacctttgtgtaataggacttagaattttttgtaatcggctaagacattctaatactgtactgtcttaacaatcctttgtgccgattaatatgactttgaaaacttgttcaaaaattttccattgcattttgacatatatgtgcccccctaattttacaatgtcaaaagcattgataaaattataaaacaactatgggcgatataacaatatcggccattgtacattggcaaaccacaaccgattacaccatgaaaaacaactaagggcgatataagaatatcggccattgtacatcggcaaaccacaaccgattacaccatgaaaaacaactaagggcgatataacaatatcagccatctcaaggcgatgtaagcacatcggctatcatgcatcggcaatacgagcctatcatgcattaacccaaacacttgggtaagatttcttcaaatacttgccattgagtgctcgcccatagacttcaccatcaagcccttgcaacatatatgctcccttagacacaaccttatgaatttggaacggtccttcccagttcggcgaccacttgccgaatttactatcacaagtaccaatccgcaaaatcagcttccatacaagttctccttccgaaaaatctttgggtaccactttcttattataatgccgagcaacacgttccttatccttggtaaccttcgcaagggctcgcaatcgtgactgaaccagatcctccctctcatcggccataaggttgtaatactcatcggctgttaaatcgttttgtaactcagttcggcgagagccgattctaacctcccatggcaaaacagcctcatgcccataaacaagtttgtaaggaggaacttgaattgatccatgacaagccatcctataagaccacaacgcttcggccaaccgagtatgccattgccgaggataatcagaaattttccgcttaatcaatttgatcaaacttttattagatgcctcggcttgcccattagcttgtgcataataaggtgaagaattcaacaatttgataccgacgctatcggcaagctaaacaaactcatcggacacgaagattgaaccctgatccgtagtaatagtttgaggaagaccaaattggtagattatatactcctgaacaaattgaatggcatccccagaatcaactttcttcaaaggaaccgcctctacccacttggtgaaataatcagttgccaccaatataaatttatgtcctttactcgatggtgggtttatcataccgatcatatcaattccccaacctctgaacggccatggcttaataataggattcatagccgacgctggcgctcgctgaattgctccaaacttctgacaatcctgacaccccttataatatctgaaacaaacttccagcattgttggccaaaaataccctgcgcgccgaagcaaccacttcatcttataagctgattgatgagtaccacagattccttcatgaactttgccgattgcaaccttagcctgatcggcacttaagcacttaagtaatactccatcaatcgtctgataataaagttcaccatccaacagtgtatactttaatgccttatatcttaatttcctagaagccgattgagatggattactcaaatattgatgcacatcttacctccaatcatcggctgtcatcgctgcaatttcaactttaacatctttgatcatcggcttataccccgatgccccttgggctaaatcattagcttcaatattttgttctcgagatacatgctttaaagtaaccagccgaaactctttcattagttcctggcacttctcattataaaccatcaatgtatcgttcttgcattcatattctcctgccaattggctgattactagcaaagaatcccccatgatttcaatggtatcggcttcaacttccttgagtaattgcaaacccctgagcactgcctcatactcagcttgattattggtcgcatatggtttaatagtataagcaaactcgaaacatgcccccctaggggaaattataactaagccgatgccacaactatgagtacataccgatccatcaaagaataaagtccatggcactatttcaaccgagccgattgaatcatcacgatgctctacaataaaatcggctatagcttgtcccttaatcgctttcggcgactcataccgaagatcaaactcagtcaaggagaatatccactttccaactcttccctttaatattggagccgatagcatatacctgactacgtcggctttgcatataacagtgcactcgttagataatagataatgcctcaaccttgtacacgaaaaatacagacacaagcataacttttccacaggggaataccgagtctcagcatccaagagccgtcgactgagataaaatacaactcgttccttcccttccaactcttgaatcaaaactgagccgattgacttctcaccagccgataaatataacctaaacggtacccccttctgtggagggatcaaaacaagaggagagttgagatactccttaatattatctaaagccttttgttgctctgccccccaagtaaactgctgatcggctttcaaccttaacaagggtgtaaaaggctctaaccttccagacaagttagaaatcttgccgatcatctcttgtagttctgtcttattttccaggggctgaatcttcttgatcgcattaacgctcctttgagttacctcggtccccctttcatgaacaagaaatcccaaaaattggccggccgacacaccaaaaacacattttgtcggattcatcttcaagccatattttttggttctctcgaaaaccttccttaaatcggctatgtggtcctctacttctttagacttaacaaccacatcgtcaatataaacttcaaccaaccagctgattagatcatgatatatataattcatggctctttgatatgttgctccagcactcttcaaaccgaaagtcatgacgacccactcaaataagccgattgcaccggggcatctaaaagctgtcttatggatatcttcttcagccataaagatctgattatatcctgcgttcccatccataaaactcaaaattttgttccttgatgcagcatcaactagctgatcagctactggcattggatattagtcctttggtgtggctttattcaaatctcgaaaatcaatgcacaccctgaccttgccattctttttaataactgaaactatactagaaacccattcagcatatcggcagggacggataaaaccagcatcatacaatcgtttgatctcagctttgacaggttcaagcatatcagctttacacctcctcagaggttgctggcgtggtctaacccctggcttgataggtagccgatgttcgacaatcgatcggctgagtctaggcatctcataatactcccaagcgaagcaatctctaaactcttttaagagctctatcagcttggttctaaactctggagacaaattcttgctaataaatgtcggccttggccgatcgcttggacctatgtttatttcttccaactcatcggccgacatgaaaccttgaccttgcttgtcatcgagatcatccactgtatccttggtgtagacattagaaccctccacgacgccctcaaagtaatagcttgggttctccatcttcaattggctgtatatcagaatcggacacttttagaaaatctccatcccagacttttccagataaacaatcaaggccatccatctcccaaagggctaaatcggcactggcaacattaactgacctgtcgactggcacgatctctatcttgtcgccttgccattgaatcaagcattgatgcatagttgaaggaatgcaacaattggcgtgaatccaatcccttccaagcaacaagctgcacgaacccttcccatcgatgacaaaaaacgtggtaggaatagtcttactgccgactgtcagctccacatttagaacacctttggtttccgatggattaccaccaaagtatttgagcaccatatttgtcttgatgagatcctcggcgttcctatccaacttcctgaacgtagcataaggcatcaaatttaccgcggccccaccatcgaccatcatcttagacatcgccttcccattgacgtagccgtttatgtacaatggtttaagatgccgattctatgttccctcgggtttctcgaatactgcctattctggtgacagaaccaacttagccgattcctcttccacttcatcgacatcggcttgatctatcccgaattcagctggcaatgtaaagaccatgttaattggtgccgctacaacactctttccttttgccaacctcttcgcctcatcggctgcagcatcatcggctacaggaacctgattcttaacacgccactcctgtcttggctttggtttcctcagccgatggttgatttcttgttcaacctcctgaaggcgctccctgttcctcaatctttgaacccttctcttctgattttttgtgaaaataccagaaggacaccattgattcttcctgattacctcatcctcttggccatgatcttgattcatcggacccaatctttgatgaataggaagtcttgcctgccttagccgattacccttattatatgaccggctcgagctctcgatgatatcactgcacccagggcagttttcgatagatggcaacctcatcccttcattccagaagaatctaaagaactcacaaccccaatgaggatcaaaaccatcgtcgtattcttcataatgcttctcctgctacttgtcatacttcctctgatacttgttgataatcttagccgaatttacttgaaaaccctttgcacggatcctatcggctgtttggccagctgtatgcaccatattaacaggaaaaggattaccatcgactttcattggctttttggaatcatcgaacctaatctttcccccttcagtggcaacctggatttgctgtctaaaaaccttgcaatcattagtagaatgagatccagaattatgccatttgcaatacctctttttgcccaattcctcagccgatgggattgtatgaccagcaggaagctgaatttgcttctctcggagtagtagatcaaagatcttgtcagctttggtaatatcaaagtcatacttctcttttttaggaatttttacccattggcatggtatgacctttttactcctcacccatttggctgcagctatttcagaatcgtcttccccatcatccgacccatacatatacggacaaacatgattaaccttcttagagcttttcctgacttccgccgacctatgctcatgcaaggttaccttctgtatgataagctatcaaagtcttcagacgagaatttctccctgattggagcaatcataccctggaaggctaaatcggctaactgagcatcatttaaactcaaactaaagcatttgttcctcatctccctgaacctctgaatatactcgtgcacgggttcatcatgccgctgcttaatcactgtcaagtgggacaacttcatctcatgaaccccactgtagaaatagctatggaattgcttctccaaatcggcccaactattgatcgacccatatggcaaagaggaaaaccaagtaaaagctgatccagacagagataaccggaataacctaactttcagagcgtctacagccgatgcttcaccacactgagcaaggaatcgactaatgtgctcataagtcgacacgccctcttgtcctgaaaacttggagaaatctggaactttaaaccggttgggaagaggaactctctcaaactactcagggtaaggctgccgatacaagcttccagtctcttttggtttaagcccaaactgttctctcattacatcaacaatcacatcggcccacggtcgttgctgagctgccccttgtggctgttgttgcatgggctcaaactgaccatactgagatgcgaactggggttgagccaatccccctggctgatattgggcttgcggggaaggaggctgagatgcgaactggggttgagccaatccccctagctgatattgggcttgcggggaaggaggctgatattgataactcaagttacccccttagtaattatgaaggttcggttggatgttgcgcaccaagtgctcaggaacaacctgaggcattactgtgccgtctggctgtacatggtgaaccaaatgttctgggacgacttggttcacaaattgttgtatgggctaactaccaggtgctgcgaacccagccgatgcgttcattgacccctggtgctaaatcggctgaacgatttgttgccttaatggagtctgttggatcggctgcagaggctgctgccttggtggtgtttgctgaattggttgcagaggctgctggcttggtggtgtttgctgagctggttgtacgacctgttgttggattggttgcacaaccggctggattggtggtgtctgctgaatcggctgctgctgcactggatcaacaataggtggaggtggcagaaacatggcagcaacttgatcttgggtcagccgattcgcagcttgcccgccatgctgtggctgttgcctcattaacaactgagggttcaccggctgtcctggcgtcatagctagtgtagcaggcagaggagttgacactggcgccgtcggctgagttgtgggtgcaacggagggaactgcttgaatagatggctgaacatcggtgatcaaagatcgataatttgggaagacacctccttgcaaataaactgggcatgcggcctgatgcttagctattgaactatcggctattgtcttcatcatgtttgacaaggtattgactaataccctggactgattgatcaaagcatgatgcacggcgtaatcaacccgatcttggaagttattgaaaaagtcctgcgctacttcgctattctgattaagatttcctccttgtggcccctgagcaccatcaccttgaacgccatgaactccttgagaattgtcaccttgatcgcctagagagccgttggtagcacctttggtactcggctgagccgagccgcctggagcttgtttcacttctccatctttagaagaaccggtcctaggactatcagcaaccacttttattttatacttctgaacaagtgtccctttgcgggtctgcatgaatgagttcagaaactgatcccgtgcttgctgcaacgttgcttcaaactcttccttctgctcaggcgtgaatttctctggatcgatcggcataacgttttcttcaatgatgtcagtcaatcccaacttcaatgccttgcctttaacagaacctgggctagatggtggtggtggttgtttctcggccatgaggaagaactgacgtctgacttcttacaggtcccactgggcgtgccaaaagcgtgttgacagaaaacacgtgggctgggagatctactgtcacaccctaaaaatcctaaatatataaattgttgtttaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggttttttaaaagtcttcttttggctttgggccgaaagtcggcccaaaaccctctctctctcctcctcggcccaagccggcccagtcaagccgagccgcccgcgcgcgctcgctgccgctgacaagtggggcccacctgtcaggcctgtcgtctacctccggccggccgccgcccgaaccctagcgccgcgccgccgtcgtctctttccaaattcggccgcctctttccttttccggtgaaatcaatagaggggaaatgatcttcgggatctcctctaccttttctcttttggaatcgtcggctaaaatcgtttggaaatccgtggattcgatctcgaatcggattcgtctatctccccgaaccctacaccttccttcgccgtcgccggttgctgtgggcctttgccgccgcctccttgcccctataaaaggacccccaagcccgccgttacctgccgccaccctcgccttcgtctctcgtcgccggtagaaccctagcaccgtgtagcctcgcgccgccgtcgtcgccgccgctccagccgtgcgccgccgtcgctccagtcgtcgccgtcgctcgggaaggccgccgtcgtggtcgccgtcgcgttgccgtcctcgtccgcccctccatcgttgctgtagaccgccggagcaccgccgtcgtcgtcaagccgaaggttgccgccgcttcttcctcgacgccgtcgccgtccgttgatcttccgccgccgttttggtcaccgatgagttcgccgcgtcgttctctacgtgctggtgccctccgttcgcgtcgtcgcgccatctttcgccggcgagcttgtgcgcccgagccgccgccggtggtgacgtcaccgctgacgtcatcgttgccatccgtcgtggtccggccgtggaccggtcgatctcggccgttcgttttggttaggatcgatctcggccgttcgtttccgtgagccgccgccgtgcacccggtccaccgcaaaccctagccgctgatgcaataaacccctttttccttttcaaaaataattcattattgcgtcataattcaattaaaacccatataagtgttttaatccgatttaatctctaaaaattcataactaattcatcttagctcggatttagttggttcaagtctctaattttttctaaaattgagatctacatgttaaaaatatccacatgtattgttcatgcttgtttatgtgctgttttggtgtttttgctcttttctgtttagattccgacgtttccggagagttcgttttcgcaggagaagaatttgaagagttccaagggcagcaaggcaagtcacacagatcccaaacaaccctttgaacatgttgatcccgtttaaagctattgtttctattcaactattgcatttattttcgaatgtcattgggtggaattaacctattgtttgttatagtccttttgttcttgattactttattccttgataccttgggttattataacttgactagttgagctttatatattggttcagctagatattagatatgattgcttagccatgcttagaaacattagcacacaattgggataactaatgtttcactattacttaatgatggatatttaatgatagctcatgatggttaattatgattggttaattaattgaattgccaactaaaacttgataatggtgggttgtgagcacatggttttgagagtcgtgctcatgacaattaaggaccggttcacgagtttcggttgtgaaacattaaccgtgccaaccacaagccagcgtgggcaacgactttaccttttgtatagcatggttcattgcggagcaccagactgagaagtggcagagataagcccacgggggtcgctggggagtccatgccttgtttataagggggtgattatgatccaagaaaggtgcgctgtggtggattgtgttgtgcgtggggtactgtcacagctcctttccgaggtaccgtggtggtattgaggcacatggtgacatgttgtggagctgtgtcttgtgggtacagtggtacacctctggccagagtaaaactattcgaatagccgtgcccacggttatggacgggtctaacaatgtctttcgtgattagtctcacacttctcaccataataaaagatgctataactggtaataatttgattagctcctggtttggaatggtatattcctggtttggagatagaactgtgcagccaggattggttgtacagaatggttgggcctatgcaacagggtatgttgtatagcgttggattaatattgtttaaattactacttaactattttattaaattctgaaatgtttattaaatgctgtttatgcaaatgaaaccctactatgccatcctttgttatcctgtgcacttgcatatttgctgcgtggcttgctgagtatgtcatatactcaccttgcaatcattcatcagaggaggagttctacagtgatgctgatggtgtggaggattaggtgtagccctggtcaagctgcttgtggagtggagtcgtctgcgccgtttatcttatttttccgctgcttagatctttattgattgagaggaactatctacctctgtaatgacattttattcgtttattaattagagtaataattgtactctattattaatttgttattgtgtgcctcggctgattcctggacgagggttcacacacatgtaagcatttggaattttggatagaaattccgggcgtgacacttgtgcaagcaagtttcactcagagtcttatctaggactagatcgtctgtagactatccctcaggtggagcatgtaagtcatactccttggtcttttagtaagcttcctagaagattcaccccaaatctccatagactgtgaccaacagtcaagctcacaaaggtgagttctttcaggaatgctctgcgggacaacatcttcgctaattaaagccaacataactcattaaggcatagccaacctgccttgcagctcacgagagtacatgcatcttcacttagagagggtatagattggtactctcctccagttaactaatggcttgttcttcctaggttctaattcacaggatcttcgatcacatagactggtttactaccatagtataactcacatgggtcttaaacccatctccttcgatgcattgtctatcacattacgtgatagccccttcgtgaagggatctgccaggtttctagctgtttggatataatccaatgttataaccccggagtttctcaatttcctaacagacttcaatcgtcttttcacatgtctagacgatttcatgttatccttagaactgtttactttggcaattaccgtttgattttcacagttcataagaatagctagcactggtttttctacaataggcagatccattaatagatcacgcagccattatgcctcaacagtagcagtatccagtaccgttagctctgcttccatggttgaactcgtcaaaatggtctgtttgcaagacctccacgaaacaacatcaccacctagtgtgaagacatatccactagtggctttgatctcatacacatcagagatccaattagaatcactatatctatccagtaccgcatgatacccagtatagtaaagccccaattccatagtacctttcagatagtgcattactcgctctagcgcatgccagtgatcatctcccgggttagaggtaaaccggctcaactttctgacagcaaaggagatgtcaagcctagttgcactagccaggtacataagcgagccaatgatttgggagtattccaattgattcctagcaattctcttattcttgcgaagcgacaagctaggatcataaggctttggagaaggcttgctatcaatgtagccaaagcgattcaagatcttgtccacataatgggactgcaagagtgtaatctcattctcacctctaattagcttaatatttagaataacatcaggtactcccagatccttcatatcgaaattttgagacaagaataatttaacctcattcatcacctcaaggtttgtcccaaatatcagtatgctatcaacaaacaagagcaaaataactcccttaccgccaccatggcgaccgtacataggggtgggcatttggtctagaccgaaatttcgatccggttagttcggtcttttaaaaattcggtctttggaaacaggaaaccgaagttgttaagcaaaaattactaaccgctacttcggttaaccgaaaattcggttcagtcttcggtctaaaccgaggtgtccgaaccagaacgtgcgtcctcttcaatcttcttgtcttcttgctcctgaaaacctccatggctccatctcagtcacatgggacggatatccactagcatggtgacaagtgttggcgggacggaaggcgacgacgcggcagaaatcagccacgtgacgcagacggcacgcgatggcgcagcggccggcatgcggctgtgctgcaggatcagcaagccaacagcctgtggcctccttatggcttccacgtgaccacacgattgtatgtgacactgcggcaatgccggcgagcagcagcatgcggcagcactgcagaagacagcggcgcggaaggaaggggacatgcgatgtgatgagataagtggcgcgccggcggcgcgtggcctaactatggctaggagtgcttcggtcaatggaatggtggggtcatggggattgggtcattgacgtggatttgggcctcaccttgttgttgggctgttttggtccatgggatggtcacgttgtctgcttagtgattggtattgatttggtttcttcggtcctcggtttcttcgagtagtattgcacgatgaccaaatctttcgaagtttgttcggtctttcagatgtcacacccgaacaaatgaccgatgcccgagagttcggtctttttgggtttgggttcggttttttcgggttcggtcttcgattatcggttttaatgcccacccctaacagtacacacatttatctgcctcattgactgcgaagcttgcagatgtcaatgttctatcaaatttctcatgctcttgcttaggagcttgttttagactatacaaagacttcaacaatttgcacaccttgccttcttaacctttaactacaaacccatcaggttgatccatatagatctcctcatccagctctccattaagaaaagctgtcttaatgtccatttgatgttgatccatatagatctcctcattcagctctctattaagaaaagctgtcttaatgtccatatagatctcctcatccagctctccattaagcatgagtgccaaacattagcctcatcatccacactgccacaaatatgattcacaaactgtcacgctcggaaattcactagtaatttccgaacttatttgtgcataaaatcctcgtccaggaatcagccgaggtacacaaactgacaatttaatatacaaatccatcataataataacgccttagatacttacaaaagaaaagaaaacagcagcggaataacggtctagcgatgacttcagctccactcccacaggcagctcaactggggtataagccaaacgtctgctctttccggatcctttctcttcaactgaggttgattgattattgccagaatgagcatatgacatactcaacaagccacacagcaaatatgcaagtgcacaaggatactaaaggatggcataatatagtctcatttgcaaaagcagcatttagtaaagatttaagagtagtgaaatagtagagtaattaatcagaaattttaatcaacactgaacagcacacccatgctgctcaggcccaaccaattctgaacaaccaaccccagtcgtacagatcaaacctccaaaccaggaatttaccattccaaaccaggagtcaaatttattatcacattattatcattaatgaatagtgtgggactaatcacgaaaaacattgctcaacccgcccatgaccgcgggcacggctattcgaatagttttactctggccagagatgtaccactgtacccacaagacacgattccacacatgttgccatgccccgaagtaccaccacggcactgcaaagggggaaatcgtgacaatacccttcgcacaacacaactcaccatagtgcaccattcctggattataatcgccccctctataaatataaccagaggcatggactccccagcgacccccacggacttctcgccgcttctcagtctggcaccccgcaatgaatcatgctatacaaaaggtaaagccattgcccacgctggcttgtggttggcacggttaatgtctcacaacagtagctcgcgaaccggtccttaattgccatgagcacgaccttcaaaaccaagtgctcacaacccaccattaatcatatttaattaccaattaattatcataacatgattaaccatcgtgagctaccattaaatataaccataaataataatgtagtatatatgattcatcccattagtgagctaatgtttctaagcatggccaagcaattatatatataacatttagctgaccaaaccaatacataaggttcaagctaatcaatttattacctaaggtatcaaggaatagggcattcaatgcaaattggccataacaaaggaataggttcacaccacccggtgacattcgaaaataaatgcacagttgaaataaatacagaatttaaatataggatcaacatgctcaaaggattgtgtttaggatctgtgtgacttgccttgcaataatcggtcttcaattaatcttcttgaccacttctaacgcacgcacgaaccttcgcaacgacggaaacgacaagctaacacgcaaaacaaagaaaaagactaataaaaaccaaataaacagtaccaaaacaagcataaacagtacatgttgatatttttaacatgtagatcttgattttagaaaaatttagcaacttgaaccactcaaatccgagttacgacgatttagttatgaatttccgaagtttaatcgattttcaactaatagagaaaactaagaaaaaaggattaatgacatcatcgccggccatggcacggcttccacgcgaccaccggcaaaagagagctcggttgggctatccgagaacacctacgcgtagaggacgacgacgcgaactcaccggtgcaaagaacaacgacggacgacgacgaacgacggccagcgatgaggttcgacggcggcttggctcgggtccccgacggcgacggcgctccgatggtgttcggcggctgcgaaggggtggacgggattcctctcctccgtgcgcacccgacggcggctaaaacaacgcggcggcaactctacgggcgacggctctgcttgggacttggggcaaacggaagaggatgtcgaggggatgcattatataggcttggactagagagatcggactccaaacgagaggatttgagccggaaaatccgagggttagtttggagagataaactcaaaaacgaattcgatttggtttatccaggcaaaattaatctccgacactttaggggaaagggagaggataaggtggagatgatttcccctcaactaattttaggaaaacacaagagaaaaggttggatttggaggagaaaaaccgagccaactcggtctcagttcggctgccagaggttgaagatgaacagtgcccagggaggcaaattaaactttgttgctgggcttctacttcttggcccgattgatagagggacacaaagcagacttcgacagagggagggagagggctgcaggctgagaggagattgggccaagaaagagagaggacttttcctgtttcggcccgaaaaggaaaagaggaattttaataacttttccaattaaattaatcactgaaatgatctttgaattgttaaaaatacttccaatgctcaagtaatttcaagtaaaatcctgaaaatacttggacactcaaagtacttaacaagattataatcagaccatttaatgattaatttaatatgtgggtaattactgaaatgttctttgtatgattaaaattaagagttgagctccgaaaaatctgagaaaattccagagagtataattaaccatggagaatttaataaaaattaaatccatccatgctttatatttaggaaattttatttcccacatttaacttcacttgtaaattaatgaacatttaatataaattctaataataatttattaaataatttataaatcctgaaacgaaaatcaggatgtgacacaaacttatggtagaaatcagaaagggaaatgtggaacaggcctccgcactcataacctttaccaataaaatatccatgtttagacacgactactttattagactcaaaaaccaacttaaatccgtctctagttagacgggagccactaacaagattcctgtcgatagtagggtcatgttgcacgttcttcagctgcacgatctttcccgaagtaaacttcagatctaccgtgccaacactatgaacagaagtatgtgacccattcccaattaagacggtggaatcttgtgcgacctgataagaagaaaacaatgagatgccagcacaaacatgtacaatggccccagtatcaacccactagttagtagactgattaactgaaaaaacagtaggtaaattaccatacccgcttacatctccattgttgctaatggtcacatttgcagactaagaagtctgccctgcaagtgccttcatccccttgtgttgtgggcacttcttggccaaatgaccaggtaggccacacacaaagcaagtcctctcatcctggttaggattgttattgttcttcttcttcttgaagttggtggtctgctgggctttgtatttccctttgctcttgttttcggccttgtgcacaacattggcactagactgcccaccattgcctttagacgcggcatctttttcccgagctttctcctcaacatcaagagactctatcaacctctcaacggagtattcctatctcttgtgtttgagtgcagtaccgaaacctctccaagatagaggtagtttcacaataatgcacccggccacaaatttttcgggtaagacacacttaaggagttcgagttccttagccatgtgttaacgacaaattttggtaggcccctaagagaattatcacatcgccaatagtcggattcctgctatattctgttaaggaaattaatctattaaaggaagcttatctagtagtgtccgagttaaaggaggatgtggcatggcaacttatctattaattaggaatagtttgttagtttccttttatctttaggaaagtgtgttcagtgtcctataaggactttatgttttctttttatctttaggaaagtttctttcttgtcctacaaggactaatatctccctatgggtataaatatatacacccggggtcattgtaaaatatctctcgatcaatacaactactctcggcgcatcaacaccctctttaccgaggttgttacttatcaaccggcggaatttggcacgtgacgcggggctgcatcgattcggttcgatctccagcgaaggagtaagtcctacgttctaccagcctaggcaattgtatcgtctatgtcagcgtcgttcagggctgcatcagtacattcgacctcttggattgctctggtttgcatgatatatttgcctacctatttatcatatgtatctgttaatctagtcttagcttatcaatttagctctatcggctgcttctcattttaggatttctaccggtatcggctaaatcatgttgctagattagattagcttagacatctaccaccctaaaaactcagtcaacgacttgattatctagatattatgattcttttcatacttagtgctgcatcagctaagtttgatctactaagtcgtgcttagaaccataatctctagcctgcttcttgattgccaataagggtttcatcggggtttcagctgatgagttatctggacgttgcatcggcttacaaggattgcatacctattggatttagccgatagcaacaaagattttactgtttatctaatcttctgaatttaatgacatcggacctccagccgatgtatgctttaaccttcggatcaatacttgttctatcatatcattattagccgattggtttctactcgattatattgttaatttattacatcatcatcagccgattttctatatgtcattatttacatcaagtgtgagactccacatcaacacatagccgatagctcgaaaccctatcgctatcggccggtatcggcatcggctggaattaatctatcggcttgtcagccgatcggctcattgatctgctatttgtatatcttgtcagttgcagggtcaaactgactggtatgcccgtatctcatcaacctttggacctacgctggagctaagcagatctcccaggccagtgtgtgtttttcgcgtcaacaccatggtctgtatttcatgggcctgctcaactacaaaagagttgtcaaccatcttgtagtcatgaaactgctccgtgacgtacatatcattgctagcatcagtagcaccaaatttggtattcagtgcatcccatagctccttaacgtcggtcatatgcatatacagctcgaccagacgatcgccaagaacgctaagaatgcatcccacaaagagagtagtggcctcattgaatgctttctactggtcagcagtaagaactcccataggttttgtcacaccctaaaaatccccaaatgtataaattgttgcttaattggaattattagaaatgattttaaaagtctagaagaaaagatctaattttaaataataaattccaatataaaagtgggctagataaaattttattaaatacttcatttgattctatagttcctagatttttctgagatttatttaaggcaaggaagtatttttaataaatggaattgcatttcatgaataatttaaattgaaaaaggttttaaaagtcctcttttggctttgggccgaaagtcggcccaaaaccccctctctttctctccccggcccaatcgcgcccggcccagtccgccaagccgagccaccgctcgctcctctctctctctcccgctgacaggtggggcccacctgtcagggcagtcgtattcctcccgccgcagccgcgccctaatgcgcgcaagccgccgctaccgcccttccaaattcgaccgctccttttccgatccgatcgaatcaatagaggggaaatgatccccgggataccctatatcttttctctttcggaatcgtcatctaaattcgtttggaaatcgtgggattcgagctcgattcagattcctttttcctcccgaaccctaaaccttccatcgccgtcgccggtcgccgtgggcctcaatcgccgtcctctagccctttataaggaccctcgagacttcctctctccgccgccaccctcgccgtagctcgccgccactcgtagtgctctagccgtgtcaagtcgtgcgccgccatcgccgccgcaagtccaaccgtgcgccgccgccgctccagtcatcgtcatcgctcgggaaggccaccgtcgggttcgccaggtcgtcgccgtcctcgtccacccctccgtttccgccaaagatcgccggagcaccgccatcgtcgtcgacccgatcgtcaccgccaattcaaactcgtcggtgtcgccgtccggttgccatccgccgccgtccgtgcctcggtaaggttcgtcgcgtcgcccgcttcacgtagatgccttccgtttgcgccatcgcgccgtcgttcgccggcgagcgtgcgtggccgagccgccaccggtggtgacgtcatcgccgacgtcagccatagaccgcggtagaccgattcgatctcggccgttcgtttccttagaccgtcccgtgcacctggtccaccgtaaacccgagcccgctgacgcaataaatctcttttccttttcaaaaataattctttatcgcgtcataattcaattaaaatatatataaatggtttaaaccaatttaatctttaaaaattcatcttagctcggatttagttggttcaagtctttaaatttttctaaaattgatatctacatgttaaaaatacccacatgtactgttcatgagtgtttatgtgctgttttggtgattttgttcttttctgcttagattccgacgttcccggagagtccgagtttgcaggagaagattttgaagagttccaaggccagcaaggcaagtcacacagatcccaaaagaccctttgagcatgttgatcccgtctaaagctattatttctattcaactattgtatttatttttgaatgtcattgggtggaaataacctattgccttgttatagccattttgttattgattacctattctttgtcacttggttaacaattggattagctaaaacattatatggttttagctaaagtgaatcggatgcttagccttgcttagagacactagctcatataaatgggatacttatgattccctattatttaatgatggcttaatgatagttcacgatggttaatcgtgattggttaattaattaatgtgccaactaaaatctgataatggtgggttgtgagcacatggttttgatggtcgtgctcatgacaattaaggaccagctcacgagtttcggttgtgaaacattaatcgtgccaaccacaagccagcgtgggcaacggctttactttttgtatagtatggttcattgcggagcaccagactgtgaagtggcggagataagcccacgggggtcgctggggagtccatgccttgtttacaagggggtgattatgatccgggaacggtgcactgctttgaattgtgttatgcagagggtattatcacaatctctattcgggtacttgttaagtatcgcgacgcatggttgacatgatgttgaggttgtgtcttgtgggtatagtggtacacctctggccagagtaaaactattcgaatagccgtgcccgcggttatgggcgggtctaacaatgtctttcgtgattagtttcacacctctcaccataaaaaatgatgctgtaataggtaataacttgtttagctcctggtttggaatggtatattcctggtttggagatagaactgtgcagccgcgattggttgttcagagtggttgggcctatgcaacagggtatgttgtatagcgttggattaatattgtttaattaaatactctattgttttattaaattctgaaatatttcttaaatgctatttatgcaaatgagactatattatgccatcctttgctatcccttgcacttgcatatttgctgcgtggcttgctgagtatgccatatactcaccttgcaatcattcatcagaggaggagttctacagtgatgttgatggtgtggaggattaggcgtagccctggttgagctgcttgtggaatggagtcgtctgcgccgtttatcttattttgagaggaactatctacctctgtaatgacattatattcgcttattaattagaataataattgtactctattatcagtttgttattatgtgcctcggctgatttctggacgaggatttacacacatgtaagcgtttggaattttggatagaaattccgggagtgacaagttggtatcagagcctccttgaccctaggttatgccaaatggttacctatagaagccctctaaaaatattaaaaaagtagaactgttctcctctctttctcttttaattaaatcaagctaatagcacatgcagtttatagtccctttaattgttctcattcaaaatttatttattattcctgtgttgttagtactgtacatctattactgtactaatggcccatttaccagtaaaagttttataacataattttatttaatcatgttgcaacataacttagcatgttgattttataactctcttttatttcattctatttgaaacctgttactcaaaagtgcaaaatttgttatcctgttttcaactgtttcaacttatcttgcaagattggtttactttattaatttacccttcactttgattttctaactttattcaattaatccaaaaacttgtgctattaattggataaatgtcttaactccctcctttcacttgtctttagatgccgcgcttcaagcctgagtacttgttcggtactgagggatttgtccaggagttgcgtacgttgtcctttgccataggattcgggactgcccctttgtatgcccagattcctcatgatcatgatgaagagaagtgccatgtcaaagtcaccttgaacagtaatcgtgaagatatcccatcggtgatgttcgaggctggagggggaagctacattcatgcttgtcaggaggtggcaaggatcaccataggagagctccgcgaaagctacaatgatcagttggccgacactgagtatcgctatcatcctcgccaaccccagggaagtgaccgtggcagctaccttgaacctgcagggattgagaatgatgctaccaccaggcatttggttgagatgctgtgggccatggatgagacctgcgctgagattatgttagcagctcaagatcgcgaaggccggaatcgtggtaagatttgcaagctggaagacaaggtggatcgtttggagaaggaactagccgcattgaagggagaagcaccaccacaaaaagctagggttcgtcttaccgcaaggaagagagctctatttgtccctcgctaccagttggcgccaaaggttcgtgtggtggaaaaagaagccgcctcagccccagcggatcctccgatcgtcaacgtaagtgatgatgatggagaagaatcgaagcgcacccattcaaaggtcgagtggggagctactcgagatgatggggacgagccaaacgagccttcaatcaactccgatgcccggaagacctagatgtcttgttaagtcattgccttagatcgttgtgttagtttgcttgtttaagtttggttgtgtgtgtgggtcttgcgtgtggtttacatcattggtgggatgtaagtgcatgcgtttgtttgctttcgagtgttaggaagttggtgagttttgtggtgtgagagtcttcagacatatgtaataatgaaactcagttaagatcaataaaagtcaagattgtaaaaaattaatttcctgtcctaagtagtttttcccctgtttctcttcttgtgctcctgtctatgccagatggtgtttactcgcagcaatgggaatggccccaacaacaacaacaccaccaacaacaataatggagagaatcccacgcttgcccaagtcctggctcaacaggcacaggttatgaatatgatgatgcagcaactccagaaccaacagaaccagggaaacaaccatgcacctccccagaacaagttagcagaatttcttcgtgtgaggccgcccactttttctagcactaccaatccagttgaggctggtgattggctgcatgccatagaaaagaagttggacctgcttcagtgcaccgatcaagaaaaagtctccttcgcgtcacatcagcttcatggccctacctctgagtggtgggatcatttccgtctaaataggactaccgtggaaccaatcacttggcttgagttcactgctgctttccggaagacgcacataccatcgggagtggtgtctctcaagaagaaggaattcagggcactcactcagggatctcgctctgtcaccgaatacttgcatgaattcaatcgtctggctcgctatgcttcggaagatgtgtgcaccgatgaagagcgtcaagagaagttcttggaaggactgaatgatgagctctcttacccattaatgactggggattatcatgattttccagaagttggtggataaggccattcgctaggaggataagtacaaccgtatggagcagaagaaacgcaggattgctcacttcaaagctcaacaggggaatagttagaggccgcgtcttgctatgggacctcaggcagtgtcgcagggaggatcttcgtctgttgttcgtccgcagcgtcagttcttcaacaacaatactagcaacaacaaccgcaaccaagctccacgccctgttgcaactccaacccagcaccagcctgccaagagggagcaaggtaacaagctaggagtgtgctttaactgtggggagccaggtcattattctgacaagtgtccgaagccccgccgcatgaaggttgtccctgcctagaacaactccaccgcaccagcgacaaaggctcgtgtcaatcatgttgctactgcagaagcccaaggtgctccagatgtgattttgggtacgttccctgttaactcagttcctgcaacagtgcttttcgattctggtgctacacattcctttttatctttgagttttgcgggaaatcatgggatggagatagaagatcttagacgtcctttgatggttagtaccccgagtaaccaggcactctcatcacaacgtcagtatagagattcaaggtgtaccatttctggccaaccttattctattagaatccaaagaccttgatgtcatcctagggatggactggttaaccagatataaaggtgtgatagactatgccaatagaaaagtaactctcaccaacaatgacgggcaagttgtaactgttcatgcattgccttccgagcctttaaggtcaagtctgaatcaaataactttggaagagattcccatagtacgggactacccggatgtgttcccggatgatttacctggcatgccacctaagagagatatagaattcagaatagatctggtaccaggaacaactccgatccataagagaccttatagaatggcagccaatgaattagcagaggtcaagaggcaagtagatgatttgcttcagaaaggatacattagaccaagttcgtctccatggggagctccagttatctttgtggaaaagaaagaccatacccagaggatgtgtgtagactatcgtgcactaaatgaggtgactatcaagaataaatacccgctgcctaggattgatgatttgtttgatcagcttaaaggtgccaccgttttctccaagattgatcttcgatcacggtatcaccagttgaggatcaaagaggaagatatacctaagacggcttttaccactcgatatgggttgtttgaatgcactgttatgtcttttggacttaccaatgcccccgctttcttcatgaacttgatgaataaggtgtttatggaatacctggacaagttcgtggtggtctttattgatgacattcttatctactcccgaaccaaagaggagcatgaagaacatcttcgccttgcactagagaagctacgagagcatcaattgtatgccaagtttagcaaatgtgaattttggttgtctgaagtaaagttccttggacacgtcatctcagccggaggagttgccgttgatcctagtaatgtggaatctgtaaccaactggaaacaatcgaagacagtttcagagattcgtagtttcctgggtcttgcaggctattaacggaggtttatagagaatttttccaagattgctaagcccatgacacgactgctttagaaagatgtgaagtacaagtggtcagaagaatgtgagcagagttttcaagagttgaaaaatcgcttaatatcagcacccattttgattttgcctgatccaaagaagggtttccaagtgtatggcgatgcatctaagtttgggtaggttgtgttctgatgcaagatgggaaagtggttgcctttgcatctcgtcagttacgtccgcatgagaagaactaccctactcatgatcttgagttagctgcagtggttcatgcattgaagatttggcgtcactatctctttggtactcgtacggaggtgtacacggatcacaagagtttgaagtatatctttacccagccggatctgaacatgagacagcggagatggttggaattgattaaggactatgacatgggaattcattatcaaccaggaaaggctaatgttgtagcagatgctctcagcaggaaaggctattgcagtgctacagaaggacgacagttgtcgtgggaattatgcaaggaatttgaaagattgaatttgggaattgtcagtaaaggtttcgtagcagcattagaagcaaagcccactctcattgatcaggttagagaatctcaagtcaatgatcctgatattcaagagatcaagaagaatatgagaagaggaaaggctatcgggtatttggaagatgagcaaggaaccgtatggatgggcgagagaatttgtgtcccaggaacaaggagttgaaagatgcaattctgaaggaagctcacgacactttatactctattcaccctggtaataccaagatgtaccaagatctcaaggagaaattttggtgggcaagtatgaagcgtgagatagcagagtatgtagttgtgtgtgatgtttgtcagcgagtcaaggcagaacatcagaaacccgcaggtttgctgcagcctttaaagataccaaaatggaagtgggaggaaattgggatggatttcatcatcggtctacctagaacatcatcgggccatgactctatttgggtgatagtcgacaggcttaccaaagtggctcatttcatccctgtgaggacaacatattccagaagtcatttggcggaattgtatatggcaaggattgtgtgtttgcacggtgtgcctaagaaaatagtatccggtcgaggttgccagtttacttcaaagttttggaagaaacttcatgaagaaatgggttccaagctgaacttcagtaccgcttatcacccgcagacagacggacaaaccgaaagggtaaatcagattttggaagacatgttgagagcttgtgctttagacttcggtagaagttgggataagaatctgccatacgcggaattctcgtacaacaacagttatcaagctagtctttaaatggctccttatgaagcactgtatggtcggaagtgccgcactctgcttttgtgggatcaaacgggagaacatcaggttttcgggactgatattctgacggaagcagaagagaaggtaaagatcattcaagaaaaattgcgtatagctcagtctcgtcacaagagttatgcggataatcgccgcagggatttaagtttttaggaaggagatcatgtgtaccttcgtgtcacgcctcttcgaggggttcatcgttttcacaccaaaggaaaattggcaccgcattttgtgggaccttataagattgttagttgaagtggcgaggttgcttatcagttggagttaccccaatccttggcaggtgttcataatgtgttccatgtgtcacagttgaaaaagtgtttaagggtacccactgaagaagctaatcttgaatagatagaaatccaagaggatctgacatatgttgagaaaccaatccatatcctggaaacagatgagagaagaaccaggaatcgagttatccgtttctataaggtccaatggagtaatcactcggaagaagaagctacctgggagcgagaagatgaattaaaatcagctcatccgcatctattcgccagctcttctgtatctcgaggacgagattctgtttaaggggggtaggtttgtcacacgctaaaaatccccaaatatataaattgttgcttaattggaattattagaaatgattttaaaagtctagaagaaaagatctaattttaaataataaattccaatataaaagtgggctagataaaattttattaaatacttcatttgattctacagttcctagaattttcggggatttatttgagccaaggaagtatttttaataaatggaattgcatttcatgaataatttaaattgaaaaaggttttaaaagtcctcttttggctttgggccgaaagtcggcccaaaaccccttctctttctctccccgcccaatcgcgcccggcccagtccgccgagccgagccgccgctcgctcccctctctctcccgctgaccggtggggcccacctgtcagggccgtcatcttcctcccaccgcagccgcgccctaacgcgcgcaagccgccgccgccgcccttccaaattcgaccgctccttttccgatccgatcgaatcaatagaggggaaatgatcctcgggatcccctctatcttttctcttttggaatcgtcatctaaattcgtttggaaatcgtgggattcgagctcgattcggattccttcttcctcccgaacactaaaccttccatcgccgtcaccggttgccgtgggtctccatcgccgccctctagccctttataaggaccctcgagacctcctctctccgccgccaccctcgccgtagctcgccgccgctcgtagtgctctagccgcgtcaagccgtgcgccgccgccgctccggtcgtcgtcgtcgctcgagaaggccaccgtcgggttcgccaggtcgtcgccgtcctcgtccacccctccgtttccgccgaagatcgccggagcaccgccgtcgtcgtcgacccgatcatcaccgccgctccaacctcgtcgccgtcgccgtccggttgccgtccgccgccgtccgtgcctcggtaaggttcgccgcatcgccctcttcgcgtagatgccttccgtttgtgccgtcgcaccgtctttcgcctgcgagcgtgcgtggctgagccgccgccggtggtgacgtcatcgccgacgtcatcatcgacatcagccgtagcccgcggtagaccgattcgatctcggccgttcgttttggataggatcgatctcggccattcgtttccttagaccgtcccgtgcacccggtccaccgtaaacccgagcccactgagcaataaatctcttttccttttcaaaaataattctttattgcgtcataattcaattaaaatctatataaatggtttaatccgatttaatctttaaaaattcataactaattcatcttagctcggatttagttggttcaagtctctaaatttttctaaaattgagatctacatgttaaaaatatccacatgtactgttcatgagtgtttatgtgctattttggtgattttgttcttttctgcttagattccgacgttcccggagagcctgagtttgcaggagaagattttgaagagttccaaggccagcaaggcaagtcacacagatcccaaacgaccctttgagcatgttgatcccgtttaaagctattgtttctattcaactattgcatttattttcgaatgtcattgggtggaaataacctattgccttgttatagcccttttgttattgattacctattctttgtcacttggttaacaattggattagctagaacattatatggttttagctaaagtgaataggatgcttagccttgcttagagacactagctcatataaatgggatacttatgattccctaatatttaatgatggcttaatgatagttcacgatggttaatcgtgattggttaattaattaatgtgccaactaaaatctgataatggtgggttgtgagcacatggttttgatggtcgtgctcatgacaattaaggaccggttcacgatcttcggttgtgaaacattaatcgtgccaaccacaagccagcgtgggcaacggctttactttttgtatagtatggttcattgcggagcaccagactgtgaagtggcggagataagcccacgggggtcgctggggagtccatgctgtcgcgaccgagaaaaatacattttcccgaacgctagtgtattaatccctgtcccaggaaaagccggggtacaccacacaaacatgatataaaagacacagctttattatatcgataatatttacattattacaaaggcacttaaggcctgacaatcaaaaataaacagcagcggactagcgggcctacggctccatcttcataggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatataggggttaagtttgcagaaaacagcatttaaaagtcacttagttgcccaaagccattttataaagacgatcctagagttacacagtgttattaatcaaggccgtgaaccctcacgaacctaccttaacccaaggcctacgatgattcagaccgaactggcaacccaaccctgggtcccagctcgtcccaagccaacccaggccaaccattccacattttagttgttaagcaaattttaagaattgaaacactaacttgggtacattgctaggcttgcccataaccgagggcgcggctattcgaataggttatactctgattagaggtgtacatctttacccacaagacacatcttcctcacgtgtaaccacgtgccacataccaccacggtatacggacggaagacgtgacatagttcccaacccatcctagccataaacaagagtaccgacccaacccacctacggccggaacctccgggacaggcaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacctgaggtatgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcataccagtggaaccatgaatagagtacccactagttggggttttgtttatcctagggtgaacaaggtaataataacaatagcaataataataaggtcataacaaaggtaaataggcatggctaaataaaacagtgataacgcaggaatttaaataaagcgataatgcattaatttaaatcaaaataattttataaactgggattcaatatgctcaaggatgatgtgacttgccttgctcagagataacggccttccgaaccttcggcgacgaccgcaaaccacgcttcgggaacctccggaacgacgaagactacgcgaagcacacaagcaaagctacaaacctataaagaagcaataacaatacataaaaagaaagcacagggttctttaggatataacaaacattaggagacttgaacggatcgattcggagctcgtatgaccaagatatgatcatccgaagtttaatgctgttacatggagatttgcggattattgtaattaggttttacaactataaaacatgtgtaagcgctagcctggaaaagacaggaaggctgcgctgttgacatgcggactccacatgccaacctaagggaccacgctggaccgggtacacagagacggtccacgggtcgacggaagcagatcctgtgtgtcaaccgaggcgagtggccgacaaacgaactccactagacaccacacgggctgcacacgtggaaaccacgcggctaccgagcgggcacactaacatggtcaccacacgcacaagcaaacgactaccgacaccggtacacgggtaccggggtcgacaaccgcacaacgggcacgggcggcaccgaaaggacgaggacggggcagcgagaggagagatccttaccaccacgcgacgtggcgagggaacgacaacgacgaatgggcccggcggagacggccaggaacgacggagacgaaaggtgaggggacgacttcggtggcgatccttggacgaaggcgagacgcggccggcacaaggcttgacgacgcggaggcgaggacgaagacgacgacggggctgcagcggcacacttgacggacgcggacgacggacgagaatggcttgacggagggacgaacgccacgacgaccgggaacgacgggaggacgacgacgacgacgaccggggccggcgaggaggcgacaagggacagctagcagcagctgcacggagatgaggacggcgtggaacacgccgctgcgaatccgacgacggaggcggcgccgcgagacgacgagccggcgaggaggaacgatgacgacgacgacgaacaccggcggggttcggtcgaaggggaggcgaggccgagggcgaccttaccgctgcgatgccggaggaggagatggcgacgtcggccggcacacgggcacggcggaaggggttgccgaaggaactccggcaaggcggagggcgagaccgacgcgggcgacggcgttccggcgaaaccgagggcaggccggggtggaggtcgacgcggtgacgccaagggaggagacggcgcagccggcccgcacctgagcggcacggcaggggcggctggaggcagtacagtggcggcaacgccactgttttgccggcgaggacgcgtctccggtgatttccccgcgaaacggagggctgaccgggggagaggaggcggctgcgaggccgagggcggcgacggtgcgaccggacggcgctcgggcgaggagggagaggcggctggaggccgatcggcgccggagagagagaaggagaaggcggggagaggtggtacggccacgggggagctcgggaagaggctaaaacaagagaacgcacggagggggttccattttataggtgaggggagggagctgggcataggagagggcggaacggcgacgggaaacatggccggcggccatggaaggcggccgggaatggcgcggccgttccgggcgattgggggcgccattcaagggggaaaacgggggaaatcaaagaggaatcaatggggattaattccccctatttaattttggaatcccatgattaaatcgcacggatttgagggaggaaaggagctagggttcacgggagagggaggaggccgtgcgggaggaggaagacgaccggcgcgtgggccccacacggtcagcgcgcatgcaacgcgcgtgcggcgcacgtgaggggggggggcggctcgggaggctggggcagctaggtggcgtggcttgggccgggcggccggcccaggaggagaagagggagtggcggcctggggaagagagggtggaggagggagctgggccgaggggaaggagaggaggcccaagagaaggagggagaggagtcgagggagagaaagagagggaggaagagaggactttggccgcgggccgagagagagagagaggactttgggccagaaagggaggaagaaggattatttttagcttttctttttagtaaactttgatcatagttgttgttgcttaataaatatttccggtgctctaaaaattcaagtaaaattggagggctctttttagaccaaggagaatttaacaaaaattctccggaccacattcgaatttttctggcacgtattttagtgtttgccaatttcttttcaaattttaattaattctattattctttttagaggatgatttttatttcgggatgaatttatcaggacgtgacacatgccttgtttacaagggggtgattatgatccgggaacggtgcattgctttgaattgtgttatgcagagggtattgtcacaatctctattcgggtacttgttaagtatcgcgacgcatggttgacatgatgttgaggttgtgtcttgtgggtacagtggtacacctctggccagagtaaaactattcgaatagccgtgcccgcggttatgggcgggtctaacaatatctttcgtgattagtttcacacctctcaccataaaaaatgatgctgtaatagataataacttgtttagctcctggtttggaatggtatattcctggtttggagatagaactgtgcagccgggattggttgttcagagtggttgggcctatgcaacagggtatgttgtatagcgttggattaatattgtttttaaatactctattgttttattaaattctgaaatatttattaaatgctatttatgcaaatgagactatattatgccatcctttgcaatcccttgcacttgcatatttgctgcgtggcttgctgagtatgccatatactcaccttgcaatcattcatcagaggaggagttctatagtgatgttgatggtgtggaggattaggcgtagccctggttgagctgcttgtgggatggagtcgtctgcgccgtttatcttattttccgctgcttagaactttattgtttgagaggaactatctacctctgtaatgatattatattcgcttattaattagaataataattgtactctattattaatttgttattgtgtgcctcggctgattcctggacgagggtttacacacatgtaagtgtttggaattttggatagaaattccaggcatgacaggtttgccaatactcacccagaagcatttcatagctgtcagccacagagtgaccctgatctgccatctcttaaaatgcacaccggtgaatttatccaacctcagtgcatcagcaaaactagccatagtaaaacaacagtgcctatagtaaggttttttggattgttgaaattttaagcacataatgatttaatttattccataaataaatcatgacattgcagatgtaaactagcatgaatgcatcataaaatctttacatgtaaactagacagcacaacatgaacagatcaaatatgtgcaacatgttgagcacgtaccgagagtaccggaagaccagttgctcagcaggaattacttgcgttgcgggtgttgaggacgacgcaagtcgtcgtggacaaacagggagcagtctcgcggagtgcttcccaaaaaccttattgttgtcttctcctggagtaggacgtcaaaggcagaggttccggagacttactctcccgatagctagtgcacgccggtgagcgggatggagtaatctacgagcgacggtgcaacacattggcggaccatttgatgcgtacgtcgtgcacgcgctgccaggccaggcctggcgagcatggttcaagtggctaggagggcatctttccttttaaggaggtccccctcttacaataagcaaggtggtactaaactccccatgcatgctatcccatgaggtgggcttttgtgattttccaaagaattaatcttcgggtgagctaagacccatctattaattccaatagtagtaaactagtaaggaacatagatcttgacaagaatacatgtataaacacaaaaaacactgctgatcagattgttggtctagttggcttgcccttcagtgaaaccttcttggagctccttacaggtacctttcctagcctgtgaattgttccttcccctgctccttgcaagctatgtgatgcctttaatgtacacaagtcatactgaatctcattttctctataatctcatttatttgaaacacacaggatcacattaaaattaaatttgcagttagctaataaagaatgcatgtcacaaacttgagtcaacggtcatgcatattttcgccaacttcgggtggagatttacaaataggatttaataattgtgttttctctatcttgcgttggtgcctattagtttgtgttatgagtattgttaaattcggagtgtgtcttgtgaactctgtggtttgtgttcgcttttgaacaagtttgtgtaataagtggttgtagctctttttgagcaaaggccggatttatttccattatctaaaaaagttaaagggagatgtgattgcctgttgttctgtatgagcagtcgatgattttgctccattaggttgatttctttttctattagctcctgtgacaagagcatttttcttcttgcccctctctttgggtgaacaacccctgctactatgcttagttttatggcaaagcccacacctcataattgtgccaactcttgacattttagtttctttaggtttctcaccaggcttcctcttcctagattttccttttggcctgccaggcatcttgacataactaggtggcgaaggcttggggtgatgatcagatgtaggccacctctcctctccttccaaaggctccatgcaatgatcatatgttttcttatactcttcaattgaatagccttgagcaataaaaccatttgtggcatgtcctgacttacaaatagcacttaaggcatgacaacaaggcagtccagatagctgccagtatctacaagaacatgtcatattttgcaagtttattgtgtacctccttctctccttttctttcacctcaaatccatcctttccattccaaaatacattgcactgacttgacctctcaatgttcatcttgagcttcttaaatatatttggacacactatgccctgccacttatttgccttgcctctgttctcttgaaatttgatcattaccttacgcctaactgcctctagcattgagatatataacaggataaaacctggcatcaacaatcgaattgttaaatgattcacacatgttattgtcaacctagtcacagcttgaccctaattcaaaccaagctctacaccaatgttttggttcagtattcatcatatccttggctccttggacagtcttttgtgcaagcttggtctgtagtagttgaaatcctctacgtttgatgccttagcacatcgccaaaatcgtttttggagatttaggtctttgtatttcttcgtccaattggcatatatatgcctagcacacatcatgtgctcatcccttggcaagaaggtattgaatgcatggagcaagccctacataagaaaatttattggccatattaattgaaagtacttacaagtcactaaaacatgaattgactagtgaattttatattaccttttgttgaccatagatgaaaactcatccttctccatcattgccaacgtttagatccttgatcagcaaatccaaaaaccattcccatgagcttgttgtctctttctcaacaatagcccatgctatgggatacatttgattatttgcatcccttcttaaggcacaaagcatctctccattacatgctcctttgaataagcacctattaagactaactattccttacttaagtaaagctttcttcatttcctctttccccgaaaaatggggaatagcataattagagtcatactttctccacctactctttctcctcactatatggtcgttgtcttcaccactatcatcgtcataagaattgtcggtgatatggacccgggggtacgcacggtagaggagaataaccttcccatctggccacgtggtcgtgcggcctgccttttcccccaccccctcggggggaggtcaggtagttatgaggtggccagggggcctcggggtgccacgtcacaccactcgggcccgtgaggcatactaccccgaggccctcatccggccaccacgtggcggggtgagtgggcggagcacgaggcgctgtccagcgtcttaaatgcgcggcgccgcaaccgtccctcaccgcatttaatgcggcatgggcgggcgtgcggcgccgcccgattgatgcatgtcaatcggtcttgaccggcctgcgaccggctgcaggcggatgggacgagtggcagtgcctccatgtcccgctttgtgtctggcagagtaggggcaggtatgccctgtcccatcggcacgctgccaagtgtgcccctatatatggtgaatccaccaaagtctccatgcatttaagagggaatgacggggatgtcctccgtgtcaggcggaggacggcgctgggccccacctaggggcgggcaaccactttgcttccggttgaaggcacggatagtgatctgactcaggctatgtgggcccccctcccatggaggggtagggatgaacggtgcatgtggtatccccttgaactacaagaggaggaccttacccaccgaaaagagggacgactcttaatagctcgaactctaaaggaagcacagctagggtttcccaggagctcaagatctcttgtaagatctccacgataatttcacacataggagtagggtgttacgcctcccggcggcccgaacctgtataatcccttgtctctctcacggattcgtaagcgatctagtagcccgaccttaagcggagatgcgctcttgatcatcgcgccttatcccccggccgaactcacaaaaggagggtctcacaacctcccactagagaggatcactcctcgacaagaataatcttcactagaatcatatatgtaggttcatcagttatctcattcaagctatcatctccatgacctattaactcaacgggcacactgtttgcatcaggatcttgtagaatcagcttcattgcttttaactttttgttatacatctcagcaaacttctgtaaggtttactacctactcatcatctgcagagctatttccactttctggttgatagtcactatcagtagtgtcactatcttctcccacgcttccttctttgtttgcatcgtattgtgtcccttccacgttttccatctcatcagatttcatattgtcagtttcccaatcactttcttcagaattataatatgacattgtttcctccacgaaaatttcagccactccaccttcagcaatgcaacttgacatatcaaggcatgccttgttatctatcactctgtcagtaaccgtaatcctgtgcttaattcttttccaggggaaacaaccagtggagctgcatggcatccttgacctcgatatggtctgcaaggtggcctctaatttcaggcatagaaatcttgtccttttctatatatgacatcccttcatctccaccaacgtattgcacaatccttctagaattgacaaactccccactataataaaatctgacaagaagtatctccaaattattcattctttctagcttgtgctgcattataaaagacgaaattaatttaatttatactagacttgacaagattagaaaagatcatcctacacacatcgatctgcactatgcaacagaaaaacatcaaagccctaaacctcaatgacagaactaaagaaatcaaaaccaaagaaaccaaagataattatatcttgactccatgcctccctcgtggaggctgtcaaccaatgtgagtaaaacaatcaccacaaaaccctagataaaaagggaagaaaccttcttgcatcaaacactgcaatggagtcagggatctcacctactccaagacgtactccgcgatcaccttgatcttcccgtccgtgcgtgatcacgattcacgcagccatggtcgccatgggcgcaacactcgagagaagaaacctagaagatgggatgagggagtacgatgaggcaagaatgatatatagactgatgtgcgttccctccctcatgttatttcgcgatcgctccacttttccctcttgttactttgcaattgcctggtcagcatgacaacgtggcaaatacggttcagtcagcccgccatatgtgcaaaaccgccttgtgaaacagtttagggagttaaatggactggattataaggtttgggttcccccggccccggctaaccaaccacatatacattcattccctatcaatcccgatcgtatattttttgggatgtgagagggcggtggctccggcggctcggtggagcagttgagcgacggcagtggcgacgaccctggctaggagcaacggcatccatgtagcagcaacgctagcgtcacggagcaattgcggcaacgtcaaggagcagcagcggcgacgaggatgaagcggcgtcctccatatccctctctcggcacctgtcaccagcctcaccgatccagccacctgcttctttgccccaggaagagagacggagaggaagaagaaaggagcgctagatccagcggcaccggctcgagagacgctggattcggcgaggacggcaggggaaccgcccatgctgcctctgccttgtcacgtgtcctcgacaccaaaatccgaaggcaagtaagaggatcagaacggttcatgcaggtgggcgcgcagccaccgatgcttccgactcacacaacacgggggatcgcccctgaggccctgagccccgacgacgacgataccgccgggagaaccaggtctcgttcctggtggcacttccctccacggtcagaggctgtcgatgaaggaggccaatgcacttgccccaatgcagcctgtggatgtagcaaaggaagatgatcatttttcttttgtttgttctgtcgtttttcctaatcactccgatctggtggcttccggttgtaagtgattgcaatgcatcttaggatctgtttggggagcttaaaattctgagaagcagctgctgagaagctagctggtaaaaatctggagaagcttccggcttctaattcatgttccagattataaaagactacaactatgtattctcagaatctggataaaagctgaactgtttgagggagcttctggcaactgaagattctaggagaagttgtaggttaatctttttttttactgggattttgttaatgtgatgtgattttctggttgaatagtagagaaattgaagtggattcctcataacataaaagttgaatggtacgaggaatatgattaatagcttgctcactgcatataacactgttgaatacgctaggttttctctgaatattttgacaataaatttcttcattctagaatgttctgaatttaatttatttgtgaccatggtggtagcagttgctgtgtgcactcttacaggcggaggcacatctcgatgcatgtgcctggaggttggcaatggtccgccgaagaaattcatgtctgaattattttttgggttgctcatttagaacctcgatacccaaccccatacggtcgatgctcattccaaacatccttcctcactcatatctgagttttcttttaaattatgaattagtttgtgttcaggaaactagaaaaagaacatgagaagattctgccagtggtggtgatgccaccggaatgctatcctggtagtcgtcctcgacccgggcatcatccacgcttgttgccagcggccaacacgaagggcaaaggttcgagccacgataagcacgcaacgactttgaggaccggctccgatggtaggcgatggaagaatcttaggcggctaatgccctctcattatgattttttgtatgatgagtgtatatgtgtgtttgaaacgatgatgctacgaccaattgtaaaataccggacattcctggtcactccccaatgacggttacggggcatttaggacaatttcaactgtcacaaccgtcattagcagcctataaaaggagctcaccttctcaagaaaattccctgtgtaccctgaaagttcgtccaaccccttctattctatacccctgagatttgctcattcccttttatacccctaaatttcagattggatcccttttatactcctaaatatatttatgagtttattttgtgagatattatttaacaaaaataatttttatctcgcataacaagatttatcttataaaaaatttcatactactctaacaaaatatgctatatatatagtttttaatggtaaaaaatattttttttgttttatctcaaataaattttgtcatagataaaaattattttttcccttcgtgaggcgaaaccaaaatattacatttgttaaataatatctcacaaaataaactcatacatataatagtcgcatataataaatttatacactttatcaatatacttcataaatttatattttcttgataccaaatagcaaaatggactttatgatagaaatttaacggtcaactaatggaaggggtatagaagggatccaaactgaaatttagaggtatggaagggaatgggcaaatctcaggggacatagaagggattggttgaagtttcaggggtacacagggaattttctcttctccattccaaagtgcaccaagaaggatcaaattcaagacactctctagtttatttacattgttctagtgctagtggagtaggaatagaatagtttccttagttcttcaagtcttcaaaagatttcggatatggctctagtagcttttctttctattataagactttactcattaatgaaatattattctttatatagtttcggtcttttacttcacttgtataattattcgaataccgactttagttcatatttgtctcgttataattatgtagctagcttattggatatatgcaatggtgtttgtttaatgttcatttatatgattgctctatgtcacctgcagaaatgtagagtagtatttagtaatgtaagtgcggtgcttagattattatataccattaaatggtgttatgtgctactggtctgtagacgtagaccgctgatggtgatagctcagtacgggtatcctccatgtgtgtatataatactaagagaatttccacaaatttcctagtgtggatactcctacgtattcattaccggttggatgtctatgacaggttgtcataaggaagtcggcaatcagggatggtttctcgatacaccaggaggatatagttaggtggtattggttgcatagttgtatactagcaaatgtagactaaattgactatatattagaagtacagaaatgacacttttcttattatttcttcacttagtttggactacatattaatgagagtattctggttactttcttcagtgtgtcaacacattctaccctcaaattttggttagttacttctgtgtgtcaacacattctataaaagtgtcccacgaattaattacctctgcattagactttgatatatacaagtgatataaattattagcataataatctcttatcatatcttcccttgggattaaataaatacgataccttggaatagtccgaggtgaaatgctacaacagtatatccgtacgtttgcggattgtatctgtagccataaagtataccgagaatatttcgtccccattgctgggaattatatttctaataatttcgttaagaaataccaacagacggttggcctagccaactgcggatccatcggtggcggatggacagtagcttctccccctccttcgtggatccaccggctggcctcaagggtggtgtatttgacagtggtggtgctaggagaggtggatctggcactgtggcgtctaagaggaggagcatcaacaaaggatctaaatgctactacacatgttgggaatcatgataatcctagacaattgttggccattgtaatcatgcagtattttaggttgggtctatccaacacattgttcacattattgattaggtatctttaccataatccatgaaaagtgatcatcaatcattacatgtgttgatcttgtaatcacttgttccacatatgacatacaatcagaaatcatttagaaatagcaacatacacaaagagcttcattaacaaatcacatgctcactgatggataatatataaggctgcgttcgcaacccctccttccggcacgcaaaacggagcacaccttattgcatgattaattaagtatattaactatttttttcgaaaatggattaatttgatttttttaagcaactttcatatagaaactttttgcaaaatacgcacgtttagcagtttgaaaatcgtgcgcgcgaaaaacgagggagaggggttgggaacttgaaggtaagaacacagcctaagttatctatttaagcaacactttattacaaataaataaatatagtgtgcaatacaataatctctatgattttgtcctcaggacatatcactaactgatgatcggatgatcaatcacagctttatggcattgaggaggtcgatggtgatggtcgtcgccgcgtcaatctccttaacggtgggaaccatgtcacagtacttgaacagataacctaacttgcacttgcttgtggccccgttgtattgggtctccaaattcttggtccacttgagcaccgtttccacgtcctccttcttgcgtctgccttttccggcggcggcgaggcggtcgagtgcggcaagcaccgagttggtggactctgaattgctggagccaatgccgaagaacgatgtgcagtcgtcgatgttcttgtccctgatgccccgcttcttaccgcgcccacctccctatcgagggcctggatcttggtgagcaggatgatggtggccacttgggtggccttcatttggttgtcctggaaggactcggcgtacgggaggagttcgccgaagcagcagatcttgtagataggatccttggggattctgcagatggtacgggagaactggtacgccgctggggagggctcctgcccaggcggcgtccgcggtggcagctcaaggctgagcttcacccagtcctttgctgcataagctgccggcgttgatcgctatcaacactacctgcaggaggacggcggtcatgctcgacctgctcattgtatttacacacactcacactctctctctctctctctctctctctctctctctctctctctctctctctctctctctctctctctctctctgagtttagttagtagccagctacaggatggattaatgcatatatatgttcaatcgatgaggtaccagttaatttatactagcttgctaggctggctcgattggtcattacaaattgtcaacctttccaatataatttcttcaatggctgtgatatcatcacggcatgcttagttatataccactatttcgatgcaactaataatagtcattatttagacttgatcgttgtttgtttcctgtccattcattaattgttggagtatatatttttggcaaatccaatcttactgctacaaaacattaaataggtgtcgccattataggtgccggaagtgctaaaacacgtacctataagctttttccctatctccgcgggtggaaatagtaaaaaaccggcacatttaaccaattataggtgccggttctaaataagaacctacacctattctataggtgccgattttttataaaaaccagcatcattaaaaactgacacgtataatatattataggtgccagttttttataaaaccgacacccacataagccgagctgaaccaacccccggccacatcgaccttatccattcatctcctctccttatccattccccctctctctctctctccccctccctccctcaaccgaattggtgtgcggcggtgggaggggatgttgcagcctggcggcggagccctcccctccgccagatctggcaggaggagaggtggcgtcagcggcgtgaggggaggcggcggtggtccgatggcccggcggtgaggccctccccctccgccagatctggcgggaggggagatggcggtgacggcctggcggcagaaggggatacggcagcggcgggaggggagacggcggtggtccaacggcccggcggcggcgacggtggtgccgcggcagcggcgccctcctcctctccatttgacgacggcggcggtaattgacccaggtgaacatcagagagggagaagaagttttcatcacaggccaaaatcaccctgcccttggaaccatctgctggcagatatgcatattgatgtacaaaacgttggccaagagtattaaggatgtgttggtcagacatatcgccgcaacttttgtttcctggagacaaacaattgaagccccatgttgttgaatgcagaatttgacagaatcttgtttagctttggcattcaaaccccttacattccagttgaacaggtacacattatcttgcgacataaattaaagtggcagctatcacacccaaacaggcagaaacacaactagaaagtctagaagaaacacagcctgaagagtaggtgatagaagagagcagagactttgagacaggggggtaacacatcatagaactgaccccagtcatacacgggaagcaaaagcctacaactgtcacgcccagaaattcacgaaccagaatttctaagctgaatgtgcattaaacccctgtccaggaccaaccagggtacacaaacgataattgttgacatacagatccatgtcttacaaaaatataaaagattacaaatgcagcggaaaaggtaaaacgagctaagcctaaagacttgactcctacagcgggcgactccactctataggcatccttgacggcagcgacgaaaccaacctttctgagacagctcaaactgggaagaacttccgctctggtgtgggggaaaagagagcaagactgagtactacccactgtactcagcaagtcataccggaagaggatgtatgatgcaggatatatccaaaggaggctaaaggtcattttgcataaagctagcatttaaaagcaatagttgaaagcagtaaaacagttgtagtaattaatcaatattaaccaatcattgtccaacgctacaccacgttgcaacaagcccaaccaaccacctgaattacaccagttcattagctaactaggggtgagactaatcacggtgaatctggtcgaccgcccataaccgcgggcacaactattcgaatagttttactctgatcagaggtgtacaactgtacccacaagacacagccccacgacacgtttccgtgcgccgacatgccaccacggcataccggaaagaggccgtgacaggaccgttcgcataaccccctctaaccaatcgcaccacacctcaggtttcacccccactcctcgcaaggcagcgggcagtcccctctcgtgccacggtgaattcggaagccgatcaaccggacaccccggccgacccaactccatcacgcccacccttgcttgggtacgtcagctagaggaaagctacactacaagcccagtcgttgcccacgctggcttatgataagtacgataagttcttccagggtatcccgtgaaccggtccttaatcgccatgggcacgactagcaaaaccatgcacccacaacgcaccatgtagtgtattttaattaactaacaccattgcggtggctctattccaaagctatgccaataatcaaagtctatgcattaatatgattccccctttgtgtactagttgaactaagcatggctaagcatttcctaaaccaacatctagtcattttaatacccaagttatcaatggcataaggtaaacaatatatggctgagtagtaggacccatcccacatgatgttgtaaaagaatgcaatatttaatagaaatgcgggacatttgtaaattgggtacaatatgatcaattgtaatgcatgacttgccttgctctcgcactgatgagaccacaacaacgtcttcgagaaaccgcggatcgacgaaacggccgaaatctacgcgacaaacaaagcacacaagtctactgaaacatgaaataaaaccattcttaatggattctatgcatttttatgaatttactgagacttgaatggacttaatcggagctcggatgaattagatatgaattttagaagattatctgtgtttattactataaaagaaaaagccttaattatttattgcgcaatatgtcccaaggctgacgtcacccaagggggggcaccgacatgcaggacccacgggtcagtggcacaaagagagggagagggggcggcatgtgggcgggccccaccagcagcggctccaagggaggggaggtggcgcctggcttatctcggctccaagccggccggccggccatgggggcggcggcgcgcgcggagctggcggcggcacgcggttgccagcgacagcaaacggcggcgggaggcgacagcggccggcgcgaaggcggctgcgcggcccggcgctaggagaggagagggaggaaggagggagatgggtcctcagtcctcaccgaggggctcggtcggcgcagggaaggagcgacggcgaacggcgatgacgagcgacgggaggacgatggcgacgggcggaagggctccgggaggacctaaagaacacaacggggaaaattagagagagggtgacgttctacggtgagcgaaacccatggccgaaggcggtggcaatggtggtgctcaccggtgcgcgtggacaagcaggccccgacggtggatttggacgggcggatggcggacacggtggctcacgggatggtgaacacggcggcgtcgacggtgaggattggcgcggcggctagcgacggctagcggcggccggagcgcggccggagggcggtggtgatgggtgaagcggcgtgggagcaaaggagggcacgggggagtacggcgaaagtgaaaaacgagagagggggacacggggagcgttttataagcggagggggaggcggacgtggctggggaggctcccgatttcgccggcgacgtgggggagtggggaggaagagagagggaaggggattcaaaagttgaatccgccccttgtgggcgcgcggcgcgggcgggaaggcgagagcgtgggcggcgtcgcggcgacgtgggcgcaggaaaggcaggcggcgtgggggcgtggggtggagcggcggttgaggagggaggccgtccctccggctggaggttaggggcgaacccgacaggtgggccccacctgtcggcgcccgggaggagagggggagctcggatggactttagggaggggaaggagaagaaatgggttggcggcccaaagaaagaaaagaggggcaaaaggaaggaaaaagggaaaaaggaaaataaaaggatttccagggactttttaatgcttgtgctcaattttaattgattaaaattatctctggagctctgaaaattccactaaaaatcctgttaacatattttgacatgtagaatccaagaaaaattccatatgcctattccaattattatttgcatttattaattagggattcatctctaggttaatttgaaccaatttcttcatgcgatttatttagcaaatttaaagcaagggaggggaacttcagggcgtgacaacaacacagacagcttgagcataggaactctgacaaaggtttgaaacttgacatggagtgtttcacagcaactgtcttcatgccgaagaccttcacagcggcgctatagccgcttttttcttcaaggtcttcagacggattgtcttgcatcctcccttttcaaccagatcagcaatggtcttcagagaagccggggagagcggcttcttgtagcgctataaatacaactttttaatattatcatcgaaggatgcataatcatcaatgagaccgaaattttttgaaagtatttcctgacctaaattctctagctttgcgcccgcatggcacttacagagcaaacgctcactatggtgttgggctgaggtaatggcacggatcttcacctttgcacgggaaggtttccacgctttaacatcaggagccggaaggaggggagattggattggtgttgcgatgttgttgatgaaattgtcgatctgtgacaccttgcctactgcaggagaggatgggttggaggtcgccacccaccctgtgtaagatggcacaaaaataggggaagaaacacgacgggagactgtatccggtgagtaaatagaatgctgaactaccgcttcatgcaacatgggatcgaggtggcttccaggattcccagaacatccccgtggacctgcgaggggagggaatcatcagattggaggattgcaagttcctcagaagcagagcagcgcacagtgagagccgcatctccatctggcttcgaactagggagaggggacggaaacttgcaaggtgtggccgcaacagagggggagacaagaggaggagctttagcatattgatccgaatgagagacaggttgggcagaaaaaggtggtctcaccttacttggatcgcgagaccggtggctgcgactcctatgatcagagcgttcctttccccgtgattggcctcgtttgtcctgatcacggcgctggctgtcccaccgatccgtatccctgctgtgactggaggagcgaccactaagccgatcccagagagagcgactacggtgctagcccctggagtggctgtctccgtcttcatcttcatcctcggggccacgggttgggtctggttcagctctacaaggaagtgcgtactccttgtagcgagtgccatcatcttgaacttcatagtcccatttgtaagcacgggctttgcgagagagaagatcttccagagtgtcgacgtggaccaggacattgtaggtctagcccttctttggctcggagggaggagggttgcggtgcggctctagttccggaagagggatatcagtggaaagcccctagcacctcctcattagcagcggtgatggagaaggagccaccccgagggatagccctcggctcatctgtccacatccacaagtcgtaggtgcgattgtagttgccacgacgggagtactcttccacatagtggatagcacacttgcgaccgatcacctttgtcatcgtctcgtcaatacgaccatgcatggggacgccctcgatacatagacgggcgcgatagcggtagcggacttggacaccgtggagactttcatcccaaggacgaaagagaaagacccgaccagaggctgtagcaagtcttggttggcggagaatggcatcccgatcactctgattggagcaagtcacaaagaagtcttcggggtggaatttggtaaattggatgtcagcacgtctaatgtggaaggcagaacggacgtcatcagcaaagacattgagttctaccttatcacccaaagccccgacttgccaagctactaaggagcaggcagagaaacgctccctgcgcctctctatctccccagtggtagagacgaccacagagtcaagcaaaggccgggcagtaaggtcgtccatggaggaagaagcagagacagagaaagatttgggagggaaatggaggggaccaagcgctgggaagttttctgtggacatagcaggtgggggagggttgctcttatagctcaagcgcttgtgacaactagccacaaggtgtcccgatttcagacagaaccaacaacggacatgttctctgcaatcaaaaatttgatgatgggtgctcaggcagcaaaagcatttgccatccatgtgtttaaggaatttttctcttctggattgaatgctcacttggttgttggattgaatgaatgaagaagactttcgccaccaatgcttctttctgacttcttcccaattgctttcggtgaagtgcaggtgaacgatgtcagaagacgagaccgaaggattttgcgctgatggaaggggattctgagaagacaggacgaggcgtcgaccgctcttgagataggatcatacggccggacgcaattccattcattcaccctttatttattttcattctcctctcctgtttcccccatcacttcactattactcactcccccttcattctccttttttctacccctatcatttcttccccattttgtcggtgactggagtggccagcaatgggtgtatcttgtaatggaagcatgggccaacaagagcggccgccacgcgcctcggctcctccaccaccggtggcctcacgatggctagatctagtgctggtggcttcgtgaaagccggagtggaggcagccccgggatgatgacctcgatggtgacggtgaccccgactgctagtggtggcagcgatgggagcggctgccgcgcaccttggctcctcctccaccaccaccatcgtcggcctcatgaggatccagcggaggcgaccccaggacgacgaccttgatagcgatgcgactcctactgctagcagcaggggtggcgcctaggttttgattggaggttgtggatcaacgactggatcccctagatccaacatgggaaggcttggagcagtggagagggctttaggtccagcggtggcggtggtggatcagtgcagtggtggagggtgttggtatttcttacgatcacagataaatccgtaagcgaacggaatataccgatgtagcacttcacccgggagtattctcaggtatcgatttccacagggaacgtgtatgctatctccaatttagattcatgcaaggacacgaagctatagataggcaaaggatagagaggtttcgtcggtgaataacagtgtgtacggaaagcttaactttaatcctaatgaggtacttcgggcactggccagctcgctgctcctagatatcgctctactgcgcacccagacagggatgactttagtgtcttgagggctgtcaccacctctaacccacctcacacctactgtgagatgcggagcaaacaccggcaattatctacctagacaccatgtctaagcagattaattacttactttaatgctagctacacactaaaccaaatcactatattttagttgattatagtgaacgatgatcatgtactctgaataggaactaaccaagaaataattcttaccgagcaaaactaaattactcaaaagataattctattataatcagagtaattaacagagcataaagaaatagggagaggattaccgacaactccaaaattcctccgacttcttctactctactctcttcctattctagtatacaatatagtacaatagagcctcttataattcaactcaagcttggagtgcgtgagtgaagtgaaatgagctcctctatttataggacaggtatgacggttatgcctatgcgaaatgacatttttgccctgcaaccgccatcaggagaggatctagaccgtgcacaccaaaccctaaatcggacggtgatcaccagggttcagtcgaattcctccttcttcctaatgagaaacggttctcttgcttacatacgcacttatacattttattccccgccacccccccctcccaggccagcaacaatccctctcgaaataaaacatgcaaaaaaccattaaaattttgaaaataaaatcatcaatttcctttcaaaatccgtcaaatttagaattcatgttctagaatcaaaatctcaatcaaaataatacttctgaaatcaaattccaagaaaatattacggaatttgtccacttacgatgacatttcccttattttcatctctctcatttccttctcacccggtacgctcactcccctctttttagccatatattattatagcatgaatgcgcagtatgccttcttaccagattgaaccctcctttcagtgcttttttttttgttaatatatattcatttgaattgaagtagctcattatttgggctttcttaaattcctttaattaaattcatccaaacacaacatctgtccctccaacttgtctgtgaaggaagtgaccatgttttgcaaaccgtccagattatttcgaaatgttttactccaaacgcttaaactcttctcagaaagcttttattttggcaaaataaaatgcaagactgtcattaaattagaaatttgtaaactagacatgaagaaccttttcaaagaaaccttcgtctttcctggacaaaaaattttcaaatctgaagatgtgagcttgagttacaaattcaaatttactattagtgaagtttgtagagaattaaactaataattaaacacatccaaaatttactatgggtgaacatgaaacacattcaataaataaaataaaatagcatagttgaattttttttttattgggcttcgcatagaccatgacttctattatttcattgttgttgtccagatgaaacatttgaaaaagggggaaaatattctcagaagcacgcggctaagaccttctctcgagttggaacaactgtactgtcacttatccatgtttacccatgagtagtgtttgtaagatcagatgtcagctgatcatctcgcagagatggaggtgatgaggtgatcgtggaaaaattcctgcatgccatcggattgtaagccactgcatgcaatcactctccatttgcactaagtatcgcaaaattttccatgcagcaattttcactggctgataatacttcgatcactgggaggcaatcattgttgatcggctagcttaattgttggcagatggggcactaccaccatcgtccatcttctttcggcaaagcttctttaacgcacttatgaattgcgcatacagccttcccttctcaactttaatatcatcaatctccttcacgctcgccaacagcctactcgacagtgtactcggagcattcttctggagcctccatatcttcctgttgagtcgacgtacctacgatatgacaagttaagaaccaaatgtcacataaaataaaatggttcctttaacacgtacacacagctgatatatacctctgtcatcaggtagcttaatgttccgtcgttccggtaaattccatcgaaggaggacagagtattgatttccttctcagtctccttcctcgccaagctcagatactctagaacatcttttgcattccttctcggtacctcctgcttcgtctttccccttctggcttgcaagcttgggtatatgatagctctacctccatcctgctgctgggagacatgagaagattccaatatctctacgtctgagtttggtacaggccgactggttgcggcgacatagaattcttcaactgcaaccagcatgctagcataatcccgatccttgcgcgcttttcgcggcgccgcctttggaggtaatgctactggaggagctgcagagaatggttgcgccgctggggctgctacctgatctgcagctgcagtgcatacaattaatatcaaattatatatcagtacaactaattgaaatggttcctgcaaacatttcatgcatacatttttacaaactcaccattctgatgatgatcagccgatggggcggacatgatcgtctggagcaagttcacttccaccgccgtgtgtgggacattcacattggtgcggacggattcaactaaattggagtagccgctgtccagaagctgcccgtttgtattatttctcatcgtgtcaatgtttctcgcaatgaactcgctagcccattcctgcgtccacttgctgaggctgtaaacattggaacgaaccgatatcacatacattctccgtattctgattcaatatcaggcagagatcggttaatttatcatggtcaaatatcaggcagggtgtatatgtaattatgtataaggccctctttgattattcaaaggaaattcataggagttttagaagattttatttctataggatttttttcctacatagccctatgaatcaaaggactgaactctatggagtccaataaaatacctatgaaatgcctcttcccatacaagttttagagaaaatttaacataaggtagaacttcatgaaaataatcttttaattattatctcttcttaaattcttgtgtttttcctacggcccaatcaaacggacattcatatgtttttcctgtgttttataattctctattcctgttagaatcctatgttttttcaatttctccgttttttcactcgtctgatctaaaggacccctaagaaagagtagtatagatgaaaaaaaaatcttaccagcgacgtgcatgacatgcctgacaaggtggcagcgggagcagtccagttggccatgccggagcggcagggaaggcaccaggttggcatcttgctcgacggggagcacttggacgcgagccacgccaccaccactgtcgccgtgcgcggcctcatcacggaagctgcttaggatagcatcaagctcgtcatcgtcaggccggtcagggtttgcggcgccgagcaaaccttcaggcggtgacgaggactgaggatttggcggcggacggcgtcgttgtttcagggcgtgaatctcatccgagcggagatccagtccccccggcgctggatgaggttgctgctgctggccgccgggaagcatcctcgccggaggcggaggagagcagggatcgaatcgcgagatctggacctgagcgggccactcccgctcgacgacgtgaatcgccggcgtgggatgggactcgatggcggcggcgacgggcacgaaccaccggcggctcggagaacatcgcgatatccgtggtcgggtcgagcaggtagcgcgtgacatcgccatcggcgtcgtaccagtcgtactgctcctcgttggccatggaataaatcggccgggggcgtacgtacgtacctcgccggagcaagaagacggtagtgaagctgaaactgcaaaggcggcgccgccgcggtggaccgggagagactggtgatttgtagtttcaagcggatcgcgagccaaacgcgtggcggcgacggtgaggagagagggagtgtttgtggagtaaacgagggcgcgaggggggggggcaagttcgaatggaggcggcgattggtgcccgcgagtttggaatttgggttttcgagatctactagatttttaagatgatgtcggaatttatttaaagagaaaaaaaaactgaattgaactcagtaattatccgaataaactccaaaaaaattccgttaaaaaaatcaggatattcacatccaacaaaaaaatatatttcctacagaaaataaaatatgttcaacttataatcatgattttatttaactggattgaatattttattttgttacaacaatattccaaatattatttttgttcataaataatttaactcaaaaactagtacgaacttccaaggagaaaacaatatattttttttcatatatacaacgatgtttaacacaaacgaatcttctgccatattttttaaaagaaaaaagatcattttactcccccaaactatttcactaaagcacttaaccccttaaactattttttgacttattttacaccctgaactatcgaactataattacattgtctcatctatacttatcacacgttatttctatatgtctaattaggtgcttcgagcaagagtattacgtcataaatcataggtaaataacaatcacagtataatccaaaatattttagcttcgtttatgcgtaatatataaattgtattttattgctggcgtacagcataccccttgcggccttacccacttctctacttggtacctttccccttcattacatcctcttcttccgataactcaagccagcttctcctctcaatctcctcctaaatgagcctccacttctcctcacaactgttgacggtccttaagttataatatctgaccgtcaatacctgcatataatgaaataaaatatggtattcaacttagtggtaggatttattactaatcatttcaactagtgttggtgaaatatatgtatgcaggtattttaaggaggaaacacacccgtcatgcgacacgatgaacctccgcacgatcaggacgcgtttacatggattggaggccccataagactatcaaaaccacttagaattgggctttggcatagtacatgatgttgggggcccattaagctacctactggccataggagaggccaggatgatatttttctagttagaccgaaccaccagttcggacaaaccagtgttgtggccgttgatcgccagcattccacatgtacgctgctaatgaagtcccaatgatggttggagggcacattgatcatttcccatacttgtaaccgtcatttggagcttataaaaggaggagctctcactcacttcaataaacacaactttgagctgaattacaagaggctctattgtatcttttgtacattagaattaggtggagagaggggagggaagctctgaaggagtgcccggaagtttggcgctcatccgacttctacctcgatgggtgtagctttctaggaagaattctggaggagtaccggagttgtcggtacactctgctccgggttcggagaaacttcttctataaaggaagcattcatgttcttttcttatgttatttaaatactttgtttaagtaagatagatttccatctttgtaggttcattatttagtatttgtactaagtgctttagtactaggactccggatagagaagaaagttcctacgcaagtattagagtagtaattaataacttaggcgtggtgtctaggttagagattacctttgtttgttgcgtatcccacggatttgtcagaggtagacagcaggtggtgacagccctgaatcccgtcctagtaatcctccacgttcggttacatcatagagctatagccgaaaccacgctggcaaactagcaggagtcggtgcccgaagcaacagatagaaaattaccttcaacttagcttagataattaaaacacatagaaagtcctctcaagcctagccagcctacctatagttgttgtccttggatagtcttatgcttacgtagattacacacgttccctgagttcgatatcctttaggggtcacccgaaggtgaagtgctatagcggtattccgtacgcttgcggatttatctgtggtcgtaacaaataccaacaacaacacggagggaaccctcctatggctgcacctgatataatggataggtttccttctggtttcactacactgtcgatagtcttgacaggttttgaaattgtgtgtattggattattaattagtttgtaacacatgtaatggcaatatatgactttgtacacatgacctaacagggtaaacaacatttaatgaaaagaaaattcacatgaaatattgctcttattcttctccaagtctttgacctgtcaccaccaaattagaaagagaaattggcagtttctgccataggttgttcttacttttgctagccgggaattgagggagaaaaagatccacttttgtgcggtcaagtagatgatcatctcttgtatgtggttttgcgaattcgttgtgaaaggtgcgttacataggcaacatgcatgtcgttcatctagttcgtcaagttgtatggcgtattctaatctaagaaagtcaggcaccccgtatcacaatgaatcaagggagatgatcatgaggcttcccaggtagtcaagggcagcaacttctgctcgttctaaacgtcactatcactaccacagatcccggtatctgtgatgggctaatgcaacccgttctgatgactcatgtctaacggatctaaactatcccacgtaagatatgactaagatatgactacctaggatgatatctattttgaaaaacgtaattttaaatttttcaaatgatctcggttggagacatatcctatatcagagtgcaagggttcgatgagatctacaactttccaattgacaatattttcatttgagattgtttacatcaccaaatatgtgttataagtaatgtgatctattttcacaatattttttgaatttttcaaacgagctcaatgagatctacaactttgtacttgaaaagttttctttttaagtcatctagagagtcaaattagtatttcatatttggaccagaatagccaaaataacaatatccaaagacctagcaacatgtggctgagaatatgctttatgtgctttggaaggtcttcggttgaaatcccaccatagtgtgcttgtaaatatctcttaaaaaatcatgaatttgtggctagtgatgtacgaccatggttgaaataatataataatattttgaatattttaagggtttttttgtttattataatttaaaaatcataaattctcatccatgaaggttcataattacgaaccatcatagataactctcatatgtgacgggagtcatctttggtgtgtgataagttaaaacctatcatcgatgggttattggtaacggttattcactcatcacggatgaggtttttattggtgatatgccctagaggaaatcataaagatgattgtatcacatactatgtttacatatttatccgacattgttccttgaaatagataactcattatttgttaatgaatatgtgattctttcttgagactctttatattatatgttgctatttctaaaggatccctgatcaaatatcatatgtggaacaaatatgtttagatgatcagcacatgtattaattgatgatcatgtctcatggatcatggtatagagataccaaattaataatgtggacacatgttggtgaacatgttgttagatagacccaacatgagacactgcaagagccgtatgtgttgtgtcatcagtgatcttatttagtgttggtattgaatccttagacctgagattatcatggttcccaacatgtgtagtagcttacttagggactgctaaacgctactccataattgggtagttataaaagtagttttcgggtatactataaaacatgtagtgggatatgaataatcaagatgggatttgctcctcctatggagagatatatctgggccactcgatgttatagattatggaagtgcatagtcatgccaaaggtgattgaggagttaatcacaagttatataatctatcacaagttcgagtgaatggttgagctattagatgatggcacatatctagccttgagcttaatctatatcgtgaggcaaaggggtccatacaagtttacactagaggttcaaccgatatgatctttatgtatgctcggtgggtcaatacgttctgctagggtccgctgttgacacgtggaccgaaaaggagttttcaggttgcaaccgagtgtatatgaacctacagggttgcacgcttaaagggccggaataaagggattggatggagatctaatatgcactcaatcggatagggatccgagtaggactcatatgggcctcgaaggcccagtcgtgtatcctttatattcgtgaggggatgtgaccggcggaattaacacaccacgtgaaaccctagttgtcactcccctccccgagcaaaccctaaccgcgcgtggatgctagcacatctacgcgtggtgttcctttgtggataccggtagaggccccgctgctttgcggtgctaatcggcgtgggagcacggcgaggacaacgcacgagggggagaaggtcgagccggtgtgatcgactacttcctctacatcgatgcgcactacatcacgcgggttcctcgccttcttagcgcttaattacttccgctgcgcagcgcgtcgagtggtaacgatctatgatctaatatttatatggttcctggtttacgcggtgaaaaatttttagtttatgctatcgtagcctacgtgtatcctaacagttttctcatattgtccaccaatcattgacgaggttaccacccattataaatgagtggttctgttgtagtggtgtgtggtggatctttcatgccgggcaccatgatggctggatggtctaccagcaccctataagaaattacagagctagtgttgttcgcttgtttgccttgcgcctatgcattcggtagagcttgttgatttagctaatcagtcgcacgtaaaacatacacaaataaaaatagctaggtaattactgcatatttaattaggtagtactccctcctttgatcattatataatcaaatctaaaatttcttaaattaattatcatataaccgtatgaacacgaattccattgaaataccattaatacagcatgggagaatgtgtgcatggtaggatgtaattagcatggtgatttaatcgatgcatacatagtaggagaatatgtgcatagtgtcttaattgatgcgatttaaattatccttaatcttgatgcataaacctatatgatgatcaacttcggatggaggaagtattaactattgtaaattttcaaaaaataatttatttgatttttgtacagaaaattttgcacaaaattgatacaccgtttaatggtttataaatcgtgccaacagaaaacaaggtaatagctcaactaagcgcatatggccaatgtttattgccaacctaactttaaggtgaaccctcaaccctatgccagttaacaatagacgtgaaccctttgacaaatgaaaaagatttcaaaccaaccttttattcggtggagcgagaagagagattctcctctcttttttttcgcttgtgactgatcacaaacatatgcttaatttttgttatggcccagcttatgattaaagccacaatggttatcgtccaacttatggcctttaattatggttattaatttacaatattatggatgccctaagccttcctggatgcaagaaagcacggaagaagaagatatgtggcttaatccaatccataggaaacaaattgaactgccaaggcctcctttgatttataggaatttcataggaatatgtaggtattcaggatttggcactatagcagccttcgattcattggatccaggcatagggaagttggaggaaattttcctttgcaactcatttcacaggaaaaacatgagagaaaacatctactataacctcttttttccatcatgtgcacgtaggattgaggtaaatgatagatgtatacatagtttctggtcttttatatagtagatactctgtataatctaactcaatgtcgatatctaaatctatcggccgttttcgatgatagaggctagctaatgaggttagatgacgagatcgatctagattatacagcgtatatgataactcggcgattcacatggacaggattagagtgtcatgaagatgtaagcactaattccgagaacgcaaaccgccataacaagctttacctcttcgtcggagatcgaactcgatgcaggccaactcgaaagcaaaaacatgtcgaaacaatgaaaatagaaaagggtagcgatgcgccgaagtattattgaattgtcgtcccttgtttacaaggtgtcgggccatatttatacccaagtacataacatgtccttgctagacacaactctttctctattacaatttaaaatacgaacaagtcccttaggcggactcttatcaaaaatatttctaaggaaactaacaaaatatcctaattaatagatacaattacattttctggactccaatccctgcgtggcaatgtctatgaagtgccttaattgatcccgacgatagttgcaggaccgtctgttcgagactggttgtatcggcttgtcttcgtcggatttggtgtcagccgatgcatatggcagtcgatacgcattctgcttcccctaaacagaattcctcctaatttgttttgaccctggctttgaacccgatccatggccttaccaaatttagtcgttaataattgtcagacaactatgatttaggggactgaaacaaatgtaaggagcgcacggtgatttggaaagatgcagtgagcaaagacacgggacgattcaagggaattattcctatgccccaacttaaaaatggtgttctcttatggaggatgggagcggtcctgacaagtcggttttgtgccctgataacgggaggacaggtaacaagaaaaaaaacgaagaatattagtagtacattcgcaaaaactaaatcaacagtatgtagccatataattccgaattttattccattattaaaaaatataaattccgaataaaaggaattcgaatattaagtacatgctccaaacacggacaaatataactcctaaagaaaaaaaaactcaaatcccagaaatacacaaactgaattcaaacgacaacaaaacagaatttatatagatagtcaaaacatagacatttttatttcaaaattttcattaatctaagctttgacaaataaactctgatctaaatttctgaattacggaaaaaattataactgaaaaaaaaaggaatgtttggccccattcaataggggtattagtgtatattactacatagctagggaatgggtgtaatatttttcctatggacaggcccgagaacgtagcgagcagcagttgggtaatatttttgcctataggtaacacatgtccatgtccaacccggtacctatgtattaactaaatttggctcatctcttaattatcatacccttttctcttgacaatacacacacttactcaactaatagaaaccctaacctaattcccccactcacctctcctactcctacccaaatccccacggcagtggcggctgcgtagggcgtgggcaagcaatgacgccagcgcaggcaaggcagtggcggcccaggcaaggagtggcagcatgggcatgtgacgacggtagtggcacaggcaacagacaatggggagcagagcgagcaggatggcgtcacaggccgatgacggcggcttagctcaacgcaagcggcgaggcggctcaaggtgacgacggcaggtggcacagctctggccaacaccggcgggcagcgacgcaagggaccatcgggtgcaaactgggtatccaccgggcatgcccatgtacattgggcatgggtatggacaccaagttttacacgcttaccctatcaggcatgattcaagcgggcattctctggtgctggatcaggcatggtttagctctgcccgtggccgacccggcctgttgccatccctatacggaacaaagggaactcaaatgtacaaatcatagagggtattattaagtggcaaaaattctccacatgctacagcaattactaccaaacgaagcttttggttaattgcaggcataatttaaccccaattgaatcgaatttctacagataggatagtaaaataacattacaaccgatccgcaggaaatgggcaaaaaaaaaaagatggtgccttgactaatgaaccggatgccaactatacactgccaaataataataatccactgccctcaactctgtcaagacattcatgacagtccatcctcgcagtgagaatcggcaaaattctcggcttatcttgcaaaacggtgaccccggaggacatgaagatctttatcactcacttgttctgaaaaaaaaatgttccaaggcatgtaaaacaattaattcacatatcattctattgataacaaaacagaaagcaaaagtacagatctgattccttgtcctcccctacacccctacttttctaccaaaaaagagatagtttggactaacataatgaaattaattggtagtatgttatcataagaaacatgtacatgcgtttgttgcatgttgaggttacctaaccgaataaatatgcttaaataaaatttgtgactaaatttgaacctcctacagtaccagacgtaatgcaagaaactagtatatttgtcagtcagattatacacacctttgccttttagaattaggtccatcaactggatcacggttatgttgatgtgaactcctggaatgacttggaccagctcttgcagtattcaagttcccatgtgcagcctgccagtactgattagtccatcatgagcttaactgtatttacagccataataagaagaaattgcagttacctgtgaaggggtgctgctactgactgctgaggcactttgatgatgtgactcaacttgggaaataaatggcataatttggcgaactaagctagcgaaccgtagaccctcatcactgactcctgacacttctggtgctccatgatttctaccatctacctgctcagcagaagccggtgcatgctgatttgtgccatttactcgagaattttccccagaaaagagtgatgcaatccaagggatactatccatcaactgagaaaaaggcccctggccattctgctccccaggggaagtctgagtgccgttttccgcattgatatcaacaggagatcctagagtacctattagacaaatacttcagtggtaagaaaaggaataatatgtcaaccatacatttgttatagaggaaacatgagtatttgccacagaaagatgaattttatgcacttggcaatatgccactgatttgtcattagtgaccacatgtccatgacagatcaagtggcaaatcctcagatgccaatatttgcagtggcaaataactggtaacccattcttttgatgcgcaaaaaacatgagcctgtcaacctggagtacccatacgtaaaaagaatgaagaatcattgaaacaaaggcatgcagaaatcattagacaaattctagaagatgaagtacgcaaaaggcattccagaatgagttaaatgtaaaaaattaaaaaaaaaaacagatacgaatccagacaggcatcaatgctaatacaattgcaaatatattgaagttcaataagtttgcatgtaaaatgctagcctaaatgcttaaataatacttataagaatttgagcaaataaaagtgatatttagtgcacctgaatgtggcaagttcctcatcacttggaggaacactacttagcacttcaaaaaggcaaattgaacatacaactcaaacaaggaaacagggaaagcagtctctagcctcatcctctccttcctctggcttaacactggcaggccaaccaaggcattgctaaccaacctacggtgaagaaacgtgccatagacttcctgcaacggtgataaatccatttcacttctctcccctcccatttcaatcttggacctcagattttattagaatctggacatctctcatccaaatctgcatttctagtttacaacacctatccaaaaaaaatctataaatgtgaccgtttgcctaatctggtcttattcagattcaacataagatcagtcaagagctatccaaccagattgcacccctagtagatagcagtttagtgagcaaacagaaaatactcgagcaagggggcaaacaatacagatagagtgaaaaaaaaaaaactcattcacctgcttcatgatactgagatgtctgtggattcggtatctgattagcactatgggcaacttgagcgttagtgtatgctctttgttgaattctggcaaacagtgggtagataataccaactccactagaagacattgaaggaggatgactgatgccagcaggcacagcaaccactgttctatgcggcaccagcctaactccagattcaacagaaaatggagcaccagctgtaacccctgcaaatgcttcactactgtttgcaggtgaagcatttgcacttctatctgtacgatcttgtgtttgatgttcctcaacccgctcaggtgggttagtaccagttaaagacacagacccacctaacaaccaaaaaggaccgcatttaaccatcatcaaccaaagtaacagtaggaaaaatgtacactcaaactaagtgtggtcatggatgccataataagtttaagacatgttctgtatggatgattggacagataatggacagttgcttacagggatgaggtaaatattataattgagtaattataattataaacctaataaatagcttagaacaagttatctaagtaatgctgatgtagaaaggtgcaaaatccataagtccagaagcttaaaaaagaacacgttctagcattcaatcggcattcattggttcaaatgtattattatctaaaccaaccttaccaactgggacttgcactcattctaaactatcaactctgaggtattagcaaactggtttcagttgacacaccagtttgttatgattaattttagtatgctggactatgcctccaatcaaacaaccttctaatctaaattagctcttatcaactcgtatttcaacaattaattgtcatgataagatcagagcattgatcattgatcagactaatcgtatatatcaaagctaacaatagacatggtaatcctagatggataaatgtgacatccaaactcccatgctggtcaatcctagatggataaatgtgacatccaactcccatgctggtcaaactacaatagtcagactgaagaaacaaaatatagcaacatttactcactcgtgcggacatggatgtcaatatctcttgggtgcagaacagagcgatgtgaagtaagactagaaaatattgggcccacttgaacagatcctgttcctggaacaaaaggagcaggctggactaaaatgagttagcaacgacggaaataggataaatgggttctctacctgttaatattaagagcaaaatttcataatacccccccccccagttatggtccaagcttcacaataccacagaaactttggcatgtggcacataaccacataaccctaggtgttatggtccaaacgtttcataaaactacgttacttctcattttgactttgttctaccatacttttttagttctacagtcacatcttaaatttttgagcattgtatccaccatataaatgttacatccgttttttttttatataggagtatgtcaaaatggttaacagtgtgattttgtgaaactttaggaccataatacccagggatatgtggcagtggcatgtgccaaaatacccgtggctttgtgcaacttggatcataataggtgaggtttagtgaaatttactcattaaaattataagatttataaattactcacttgaaccataagaggatttggtccagatggagagataaaaagagctggtccagaattgacaaccgcttctgactgaaagtaaaatgcttactggtcagtacagcagtacagaatcattccaatgtgaaacgaggtaaaaaaaaaagctgtcagaaaaacctacagttgcaggatttatacgcagcatcattgtcgtgcggccaagttctagaagtaatgaaccaaggtattggatgagaactccatatctgactacactgttttgaaggttcctccgtgttgtagcatcagttacattcacaatatctcctagctggtttggtagttgctgcattgaaataactcatcttaacttcagacacgctagtaacgtataaaaccgaagttaacaactcaacaaagcagataagcagcaaaccaaactaaagaaacaaatttcagcatctatgggagtcagttgactaccaagtaatcataatgaagtgatcacagcacaataatataattaacacaggaaatgaacttatcctgcaattagtttttaattgcatacatgaatggttacaaaaatttccatttcacttgttctccacttaaaacaaaataaagtataatggtatccgcgtattcctcaatattatgttatatactaacacaaaaaaaaagatagtttagaaatgaaaaactcaacagacatgatgtgtacacgttttgtacattttacaaggttatagtaccatgactcttggtggggagtatgaacattagctggataatttataagaaacagggtttaattgagtgcaactatgaatgtcggaatctatgagacaatggagggtgattggacctgccaaactcatatgttgtacccaatgaaacatttaccatattaccctcaatcaaatagctcaaattgatatatctaacttcactaatactttccctatcattgaagaataatagctacatgcatagtattctcaactcagcaagaacaaacagaaaagagatcaaactattcatgaagctaaaacataactgttatattagctaattcataacgagaaaaaataaaaaaatggcacggacagatagcaatgctccagcatgctcaacaagaagttgtctagtagagtgcatagtttcagcaagcaatgctgcagtaggaagcccatgcgccgaagctgaatcaggctggctttcatgattttgagtaccacctccatgggcacttcctgcagttccatggtcagcattattcagagtttgtcctgtaaagagtattggaagtaaataactaaattttcagactgattcagaatgtgggcaactcagataaaagtcaaggtaagaccattttcgaggaagccttcccttctaaaggagtctctcaaaaagttaatgtactgagaaattgtggtcaacgaatcaggaatgacctgcaaaagaacatgttattagccatatatcttattaatatttcaacatcagggcatgtgagttgtgaaggatacaagaccaagactaacgtttggttctgataacccaactgacgtttcagactggaaaagtggaggaaccagcatttgatcaagtacagccctgacaccattttgcgttgaagattgtgcaccttctgaaggtctggcatcagaaggtgctggtccactctaacacaagggaaattattttcaaataagatccttttagttccaatctgaaccaaagactttcagaatgctggattaccgaaacttgtgtgctactaggagctcgaagcaggctttggagcaactaccaaaagaacaaaataagtgaaaaataagttatatgtcaaccaaaggaacacagtaagagaagatatagaggtgcataggaacaaggaaaacctgtgcaacactgagttcactcccctgacccacattaatagcctcaagtacaatactgcgagtcatagtgggaccacgacgacgagcaggatttgatgtggtacctataaaattgacagtttttgcgtaatgaagaaatacggaaggagaaaatggaagaatgaattctatggtgcaatatagaaaacatgcagctgttgtcacaagtttttggtctaggcatgccacataataaagctcatagttcaaagtggccaaatggtaactgcagtgtgcttgacttgactttacagaaatatgaagctaatacaaattaaattttcaaatgcaaaacagatcaaaatacaaaattgacatggctataggtataagataacatcaaaaggcataaaggcctctatagcaacaaaacaagtcatatgggtgtcagaaagttttagccttttaggtatttaacaagaatagcatatagaatccttattaggaagatggtgggaacacagaaggtctgtggtacatttctctgctttatatgggtacataaaaaaggaatggaaaggatagaaagtaattgtaatgatgacaagtacaaagcaactagttgacataatagaccaagtgcagtatgctgctaacacatcagattcgatgttcatgacatgcaatcacaacatacgagcatctgttccattacagcagtctttcagaatgctaactaaagcaatatagagtcaaaactgacaacctaaataatactcacaaacctcataacagtattatctaccattagaactactgcaaatgcggaagatttttgcttcaataaaaattattcacgatcttgaaaccaagaagaaaaacagcccaagaaactaaataaattatatcacacaatgcaggtgtccaaagaatgctctcttaaacttcccaatcaatttttaactacacacaatgagtttacaaaccttcatttccagcatttcctgatgtagcggattgtcctggttgtctaaccacgagatgcaatgtatggccatcttccacgtctaataaaaacttcagttaaggattaccatttacaaggtaagccaagtacgtacttcaaatgtaaaacaggtgctgtccaataatatgatcaaaccagttaggttttagtgacttatcctgggaggaatcaaaaggcgacaaagacttcatagtaaacagggatatctgaaccctttcttcatagtatagaagaaaaggacaaaaatcaccaaagcaacatcagtgtacataccatacaaagagaagagaaagaaattgctaaaccataaacacaacaccttccaaatataataccattatttccaacatgtcatccgaaattccaaacaatgggaccatcatcatttgtaaatattaatattatgcttttaattgtgcataaaaattatgcattgttttcttgatctagaatattgtttgtcgaatgacatctaacatttgaaactgtaggatatggcattgtagatggagaaacaaattttggaagacaaaacaactaaaatgctacaagccaaaaatagatgaggatacgatacgcagagaggagttcatcatcctttagaactctcccacggcaaatcagacgttgttgctcagacaatattccagttacagtggcaattttttcctttagcagaggcactggcacctgtataaaagacaaagcattaacaataaatggcatgtccacccaaaaaatagaactggaacaaaatattgaacaaactaatgcagcattaattctgaaaattaaagggtacatagaattattctgagcaggttctaaaaatgatcaatggagttcaaagataatattccagttcgcagaccactaaaaagaatcgacctatgggggggtaagacagcccctgggagttttgcatagaaaaccttctcacgcaagttgagaaaacccccgaaccccagccccacccttacacagcagcaccgtagcccgtgtgagaacgaccaatgacctgggccaggccttagacctgtgctttggcgtgggacagacaaggggattttttttaaccccagcctgaaattctctcccacaaggagtcgaacccaggacctgaggagtgctactagagccacctaaccaacgttcacagatcataaaggccctatgaaaaacactgctagcaaacaacaatcttatataatcataaatttcatccagggctcctatggtaatgcaacactagaccagctgctactcaaaagaatctaaatgcacaccatatgtgtatcagaagttgtgcatcagaagtgagtgcatgcccaaaagaacatacatataacaacatgctctacattagatgctatttatacattcaaaactaccattaacagaaaaaattgagaaaaaggcaatttacatcattcgaacataaaatgaacttgcaactaggctgcacaataaactatcagaaaatggtaaaaatatgagatatagtagtgggttgtcaaaattacttggggaaatttaagcaagtttgacatacattcacttattattatttaattaaactatgcgaaagggattgagtggtattttgttcccgggaaagaaggcaattaaatatcattagaattgcaacatgttgtgcatgcaaatagccaatagtttctaaggaaccataagagcactgtaaaaagcaactgtatagtctctggcatgggcatttgttatccacttacgcgtttattgacacgcaaattgtatgtttgagaatccaatgtctttattttgatctcgattgtactctcactattcaagtcctcagcacaatgtgacatttgaacatctgaagaactactctccatgatctcctgaaatgggaaaataaaagaattaccagaactgcttatttgttgtattgagagcgaaacaaaatgtggaaaaaaaataaaagttcaaaagagaagtacataaagatatttgaataataaacatcatttaggcaagagaaccatcataatttccaaaattactcaaagttaaagagtcaaaagagtatatctcaaaatctacacctcggcgtgctcagcaaccaggaagcacctagttactgggagaaacaacaaattgagccccaatacaggaacgtcaccccgaacggccaatgcaaaatctatgccatcattacctctcttcgccacttcatcacaggcacggtaatcgcaatcacttcaggagaaaaaaagaaacctaaaaactaatctttgcgaccaccaaccgcttttcgtccacgaacgaccacagatccctaagggcaccattcaatctccccacaggggcggatccaacttgggacatgggggttcagtactgaacccccaaacttttaggggaacaaacaaactgttacttgtattaagattaaggctctggaattaagaaatgcttctcttaatcccttcttccagatctagaagagaagctagggttaacgcaagcaaattccagacaaaagtactaccggtgggggacagagatgaatcagaaagaggatgtggatgctcaccaggatccccctcccctcccctgctctgctcgtcggatggagatcggcgcccctccccctcccctgttcagccgcgagatggcgcaaggagcggaggagacgagacggggagatttttcttttacgccaacaagggaaggggggagaaactcggggggcgcctaatgcgcgcctggttcgctgcgggcgcgccccgcgcggtgggtttagccatggattgttcacctctaggtccttttaaaaaattattttacaaatagctccttaaaaagtggaggcgcctctaaatcgggcacccgatttatgaacatcaactagatcgaacatgtttcactaaacaaatcgaaaaaaattcagtatttttaaaaagctgaaacacaaccaaatcatctcatgaaacattttgctacaacgtatgaaacaacggtttccaaaaaaaattaagcgttgtttcaccctatataaaaacaatgttttagcaaatatcgaaagaatgtttcaatttactggaacatttgatctatacacagtgaaacattatgagtacactatgtgaaatattttttgtggaaaaaaatgaaacggattcccttaataaagggtttctataatatgtgggtgatttgttgtaaaagaataattcaattcactgcaacattttatctatacatagtgaaacattacgagtacactagctgaaacattgttagtggaaaaaaatgaaacgaaatcccttaatagagcgtttccgtaatatgtgagggatttgttgtaatggggccctagtggtggggaggcgtgggaggcaagcggaggcgcgcgtgaggggggcaatttttctggcaccgtcgggcgcctgatccccagcgttttcctaaaaaagttgggttaatttgattcgtgccattgcaaatgtgtctatttagataaatgccattataattcgtctattcgtagccgtgcaactcatttttttacaaaatcgaaaccatggcatcaccgtcacgtttcccatcttctttcccatctgtatgtggaacccacctgtcatattcatcttcttcctcatccccctttattttcttcattcgatcgggttgttggcacaagttgcgtcaacaactgacagaatgacgcttccttgggccacttgagcaacaattgtggaggcaagacacggacacgttgtgctgtaggttcattattgctcgcatcttctccttcatcatctcgaacttacagaacagcttcaacaactactgtagacatgaaatcaacaatgagccaatgacaagcagtgcatgtggagaaataacaatgcattgatctcaatcaccgctcctagaataagaggacccccccctccaacctatacacatcggaggcgaaggtagcgtcgcctctatcgtcgacctcctcggctcctcagtgggaatgtcttcccgctgcggtcctcccctcagttggtgccatcccatcgctgctatggaagcaaggagtccgggtctgagccgtcggagctgaagcctgaggcatccaagctggagatggactcgatgaacgcgacgcgggcgaagggcggcaacatgatgaagcaggaggggcacacggcctgcgcgtgtgcgatggccaccgactccgccacctggggaaacacgtgtaggcacttcggcgtctccactgcccagccagtccagccactcacctcacccccgaggcctagtgcttcctccgcatcgtcgacgaaagtaaagtgaactcaaaataaagtgaacggagtcctgctagttgcacaaaacatgtactccttaatcacagtaaaataaaaataataaaaagtagtacatttaatatgaaaatcatctctaaaccttaatgggtgaaataagtattaaatcacaaattataaatgatgcaatttatagaaaatacgctatagctccaattaagctaaaataagacttggttaggccagcaaggctataacattattcatgttacccaaaactcaaaacacttaggctgtgttcattgttttgagttgcgaactcattccctaagcacggaaaacggagcaacatattttctatgattaattaagtatttactaatttttaaataaatggattaatatgattttttttaagcaactttctagaaactttttgcaaaaaagtgacgtttagctgtttgaaaattgtgcgcgtggaaaacgagggaagtgggttgttatagttggggaaagaactcagctttagtacatttaatgcctctcaagttgttataacaaattatcaacataaagcacatcacaatttgtaaaatatgtagaaaattcatattagctccaaatcttgtgaactcagttttgttaggttaagaactattatctttctttaacaagaacataaagtaacacattctgtacaaataaacacctaaaaatatagggaaattactaacattggacacgctacaaattgtaaaatacatcagaaaatcatacaaactccaacaattatgaaaccaaatgggttagtcttagaaaacaattatcttgacctctgcaaagtcaactttaaccaaatcacctataaaaagtatttcacgacactacctagataaataatatattccctctgtcccaaaatataaacatttttaggccctctttgtttagacttataagccagcttataagccgaaatgtctaagcctaaacaaacaagcagcttattcatttggctttttttaagccataagccactctaacactattaaggccctctttgtttaggcttaggcttattggcctagacttttaagtcagcttattagcttatatgatttataagccggtggattaatgtcctaagtttagtagttgagtcatacatctacctcacataagccaaaaaagcttctccaacctagcttttggcttaatagtgttagagtggcttatggcttcaaaaaagccaaacggaaaagctgcttgtttgtttaggcttagacttttcgacttataanttggcttataagcctaaagcaaagaggggcctactccccacccccgtcttnagaggagcaaccgctgttttttggcttatgtgaggtagattatgactccaccattaaacttaggacattaaattcaccggcttataaatcatataagccaataagctgacttaaaagtctaagccaataagtctaagcctaaacaaagagggtcttagcatagtatcaagtaaaacatttttaacttagactattaatagcaaaagaataaaaaagaacaatcatgtaaatttatcattaaacaaactatcataatatgctactctttttatttaaaacatcttatttttatagatattgttggccaaagtagcatctcgaagactgtgtcaaagtccaaaaatgcttatattttgggacggaaggagtaccctatatcagcacaaactttagaaattcataagtcttaaataaaaagagataaaatagaaatttcttcatctaaattcatcacctacctactgtgcacaaatcatgcattttagagcattttgtttttttttttgtatattttggtatttaattgcataccgtgtaaattgtatagataattgcgataacggtgaaagagagacttacgtgcaggttctcccctcctccctttatcaccttgaaccctatgatttgggcgaatgaaattgtttgtttgcaaaatcgcacgtgtattttgttaataccgatatttaaaatttggtaaaatggtagatataacctatttgctgcatgatccaccttgaaatattgacaaccctctgtttgtaaccatagctttggtttgagttttttctaaatgctcgattgggtctataaatgctttatatgcttccatttgcttagccaagcctaaaactatacaaataatcattcttaacactttacaaatggagttttggtatttatttatttctggacagaagtgaaaaggttaagtatttgtgaactaaaatgtgtatagaatggttttagacttgggcggcaagtggtgtacaaatggtggtagttgtacactaatagggggaatgtccggactgaacttcgtgccactaactaatgttttatcgtacattgacatgtgctattttatggtgtggacttagctaaataagttatttaatatctagccttgcattttggtaggccgggaaagtatgggcagtgcctattgacccgttaatggtatagcagggctatctagaggagctacctatttgctcactgggagtagtttaggtgtctaagtttgtccaatatgacagtacaatgcctcatggaaacagatgcgtttaccgccacggccttaagtttaaggtggtggcccgtcacctaacgactctaggtcattcctagagtgggttcacacttatcgtgctagtgcaagactaggcattaggtaatgtaaaggcttcgttgcaacttctagatcacattcaatctctaaagtgcggtagtgcttcacgagtacgagacaaactagagtgttcatttcatgtgactaaagttgtgcaaactctgtagagtctaaaactaatcgattagtcgtactcgcggtcataagcgacttggtgaagtgtcatgagtatagttttatgcttttaaattatgtttgtggaatgtggatttggaattgcagatttgtgttgagtttgatgattttgtaatggaatttgcgccatgttgttgaggagggcagcaaggataataatatgatatgctatgattattcatgttatctacttatattcacgctttaaaaatgctttaaagacttccttgcaaacgtttgtgaactaaaacttgctttatgctaaaaatgaactatataaagctttcctttaagtattagggtgtgtttagttcgcgaaaagaaaatttttgggtgtctcatcggatgtttgaccggatgtcagaaggggttttcggacacgaatgaaaaaactaatttcataacttgcctggaaaccgcgagacgaatcttttgagcctaattaaaccatcattagcacatgtgggttactgtagcacttatggctaatcatgtactaattgagctcaaaagattcgtctcacgatttccatacaaactgtgcaattaatttttgttttatctatatttaatgctccatgcatgtgttcaaagattcgacatgacgtttttgggaaaaatattttaggaactaaaccaggccttagccttgcatttagtatgctaggtttgactgcttgccaatgtactaactcttgctatacatatttgctacctccgtcccaaattagtagtcgctttgacttttttcttgtaacgtttgaccattcatcttatttgagaaattagtgcaaatataaaaacggagaagtcatacttaaagtacttttgataataaagaaaatcacaaacaaaataaataataatttcatatttttttaatctcaactactttaaaaaaataagaggtgcttccatcgtccgtcaaaaaaaccggaccaaaaaaaccaaatttatccgataaaaaaaccgggcgaaaaaagtgctaaaaaaagaaaaaccaaaactgtccgatccagaaaaaagaggcgaaaaaaccggcgaaaaaaaccaaaattgtcccatctaaaaaaaccgggcgaaagaaaaacgtccagaaaaaagaggcgaaaaaaaaaccaaaatagtcctatccaaaaaaaaccggcgggcgaaagaaaaaaaagcaaaaaaataaaaaaaaaatgtccgactcctatccgattccctcttagaaacgaaaaaaaagtccgactatagatccgattcctccttaaaaacgaaaaatcaatctataccgtgatatctcacatatctcggtgaaacaaaatgatgtgccggattaaagatctgttacaaaaaggaacctacaggtggagggcattccattaacatatgattttaattttgggtatggactttcagcatttgagtccctataatttttatatttacatttaaatccctataatcttgcaatagggtacttgaagatgcttttgataaaagtaataataaaagagagagaacaaaagcataaaggtgcataaaaaaaggaaaggtgctcacaaaaaaaagaaaaacaaccacataagttctgtatcccctaagtggcggaaaaaaaccgtagatccgaacggaaaaaaatccgattcctataaaaggcaaaaaaaaaagtggtgaaaaaaaatactaaattcgattcctttaaaaacggggaaaaagtctgattcctataaaggcgaaaaaaccgacaaaacatctaaaaaagttcgtccgattccctaagaaattggcgaaccaatggtttctataaaataaataatgcacacgagaaaaaaatggcaaggacgaaacacagtctgatttctaagccatatatatctcttctctatctctaatataa

SEQ ID NO: 17778 - DNA, 1281 bp, Oryza sativa
atgaagaatagcacactttcgttattaagaaaagacaatcagatgtacttttgtcaagaaataaaatagcaagattacactgcccgctacaccatcaaaatcacaaatttggagtaaattcttagcaaaagggtgtgaaatcaaaatcatttgtaagctgctacttcctccttaaaacgtgtgatgatgtcatcaatgctcactgtggctagttcagctttgtcccttaccctgacgctgacctgcaatagcgtaagccataatgataaggcaaccgtataaataatataggactacacatttcatatgaaccagtgggctgttttttttagttatctgaggatgactacttcatctcttgaatttaattgtctagttcacctgtacatatggatggcagaaagaaataattattccacatctctagtgaaaacaggggtgcaaagggtaaaaacctgtccagtctctgcttcttgtgcaccaacgacaagaatgtagttgaattgggctaattgagcctcccgtacctgcaaagatgaaaaatggtcgtgaccaattcacagattacattgttgagaaccgtgtaaactaaattactaaaataatagaactttcttgcagcatgggcaaaaccaaaatggaacagtccctgcaacaaaaaatcagaacaatgcataccacatattgttgcatacctccgttttgctattcaaagagttgaaagcaaacaataataaaggacaaacataaattacactatgacatgatggaactaccttcttctgtattgtcctgtctgtctcatcgatggctacatgaaaaccagcttcatgtatcctagcacggacctgagtacagaagagaactgattagttaccaaaattcttactccactgtaagcaaggtttcatttgaccatgcgtggaattagtgggcgaacttcaaaatgtattatgtttataaaaagtacattactaatacacccaagtgtcatctggaatccatttaagataaattgagccaattaaaataataatggactagacagacttccaatgctgtgtgatgaaatccactcaatacaaaaacgaagcctaattaataaggaataaacatttccagcactgcatggatgtttatatccatcaagaaatcgaggaagtatatatgatcaaataagaaaccaaagacaatcttgtactgtcgttatcatttcatcatgagactttttaaaagccatcctcaccttgcaaaaagaaagctaatgttgtctgggactta

SEQ ID NO: 17779 - DNA, 15794 bp, Oryza sativa
tcaaatttaacaagtagtttttattgaactaaaagaaatatagtttggaccaccacggaaaactaagacaaagcaccacctatcgaatcagaaggtactagaagattttcacactttgatcaatggagaagagctactaattaatagtaattagtaaattctatgacacaaggaccttttacctgtttagcgtattccactgaattggaagatatggagcaaacaatggcttggcgaggactcaaccacaagggccatttaccattgtaatgctccaaaagaatagcaaacatcctttcaacagaacctaggattgccctgtgaatcatcacaggcctctcaagtttggcttcatcctctgcagagtaagtcagcttgaagcgtaggggcagctgaaaatcgagctgtaacaggaaatgaagtttagataaataaccttctattctgtctacaattaaaaacaaaatgacattcaatataacctgtagagttgcacactgaaatttcctcttgagggcatcaaacacaccaatatcaatttttggaccatagaaggcaccatcaccttcattgatctgcatgtagacatctaaataagtacaccaataagggataaaaaaactgctaggaaacaaccagtaatcacaacttgcgagccagacttcaagattgggtattccgccagtattacatccaaacttcagattgagaatatgaaattatttgaaatttaaaaatgacaggaaccagccaattgagtcaaagaagaataatctctcctaagatgtttactgaaaacattaccactaaattatatttctatcaatattatccggcataaagaaatatatttgtatcaatagaaatcagtattaaaaaaatatatttctatcaatagtaatcaacatacagtacatgttgttaccaaaacgacattagagttaagccaaaactaaataaagcataataccttttgacaaaggactctagtgataatgctgagtgcaggtaaaattaaaaatagtggaagaaattagtgcaaactctcgttaaccatattgtgaaaataatgaatgttggaaatgcacttctaatagcatagactgaaacaaacattctgaggggagtgactgtcatagtacctgccatggctttccaaactcatttaaggcttctgtcagctgttgctctgctttgttccaggtttcaatatcacctaagtacttttctggtctctgcaaaaaaaaaaaaaagagaaagatatgcaacattacaaccatgctgaggatcaagccataaccatcagttattcacatattgttccgtaggatgctgagaatttcccaaacattagcagttcacaatagtgataggaaaatgggaaaacaactacctctgtccacaaatataagcatttctaggttgttcagcagatattaaggttgaggagaaagactttggtgcccctcattaaaggaggaatggaacaattagtactgtggaatgccttatatttgtgaacaaatatcaaacacatggaatgcttatatttgtggacagagggagtacatagatgcaaaatacaagtaacatgttcaacatctggcatgcttattttctcagcacatgtccaaagcccacatacaatgataaattatgattcgcctacaacgattgaaattaaacaaaaagtatgaaatgatctacgatgccaaaacagagactagcaggttcataggcctttcataaacctcaccaacctcaggttcacaatacacagtgcaaaaatggattgtatcgtaccaacatagttatacttcatagccagttcgattttccttctacgttgttcaagaaatgtgcacaggaattccagtaggaccataggagatgaaatgacttgttaacctttaaaaatttgtatagagataacctttttttctcttaaatgcaatcatcacaaagttacctggtatgttgggatttaggcaggagtagacatgggaagcagaaatggtaaaaagatacttaaccaacttcatccagattataacagcaacctaacacttgctaagcatctatttatgtgacttctcgaatacatattgaagttccaagaatcctagttcctgtgaatttctagatgctattaatcatacagcaacaacgagatgattaccgttgatagctccaattcatatttaaatccaaatatctcgtaaacataattgatgaagtccaaaacagccttaacttcgtccttgatctgcaacaaagaaagaactcttaagaaaagtaggcccttatacaatcaggggacactatttaaaattatccgaagcacagtgcagctgttaaaaggaggttgtgattaacaccatctgaaacattgtgaaaacaaatgggaatacaaactagcatccatacagtatgcaagtcatgaacatctaaatattatgagcttctggtgcctaaactaatttatgtcacacagtgtaaatacactgttcagtagcatgtcattatgattgcaatggcaccccttccctactaaaaacagatatacagaatggtgcagaattcaaacttacttggctttctctgcaaaaaatatgggcatcatcctacagggaaaatgcatcagaagtggttaaaacaaggagattactaactggattgaattagtatagaaattaacaacccacaaaacaacattagcattacctgctggaatcttctaacacgtgtcaaacctgtaagtgcaccactaagctcattcctgtgaaggactccaaaatcagccatccggagaggcaattctgcagcattttaattaagttgttagtgttaagaaaaaggttgtcaaaacacaaaaacacaacacatcatatataaaattccccttgctataatattagaaaagggaagttcatcatttatatcaatagcaaaagccaatagttcaaaatgtacatgtggacaacaatttcagtactacatcattcaccaaaaaacaattcactaagtaattctagagccgttacttttgccgaattaggaatttaatttaggggtgggcattcggttcagttcgtcggtgttttgaaaagttcggtcatctgaaaatagagaccgaaacacattggaaaaaaaaatgaatactgacgaattcggtttcggctagttcagttcggtctccggttgtgaccaaactaaccaagatattacaactgctgttttacacatccaaaaagaaatcatagaatactcaaatcagccacagaatcaactcatataatcccaaaatcagccacagaatcaacagaaatcaacacaaattagatctatgcacaataccctacatagatgaagttcaaatcaacacaatttggagcaaagagcacgagatgtagccagcgggcatagacgtgtccaccaatccgctgccatcaggggaccatgggcagggaaccgcatgttcacaacggtggcgacaccagtgttccccagcaaccgccgccttgagctctccggcgtggcagagcaccgagagcctccttgagatctctggtgaaggtggtccccactgttgatggcgtggaattgcggcaacggaggcagagtgttgcagagacagcagcatgctgtgggggcacaggcgggagccagggcggggcggcaacagcagcgtttgccgtgtgtgggaggagtcggggtagtggtaggagaagtggggactggggagttaagagtggggaggtgaggggaagttagggttttctctcttgggctgaactggacaaggcttattgatatgtttcgatttctcaattacccgagcctaataaccaaaataacaggactaaattcagttattgagagctgaagcccgatatttttactggattccagtttgggtcatttcgggttcagttcttcgtcacggttaattatgcccacccctagtttaattgccagacaactaaggaactgtttttgctgcctacattttcagtttatgaaaattttaatgagaaagcacaagccactagataataaatgtgcatgcacaatatcaaagaaatagagggagaattaaatcatagaagaaaaacagttcatacaggcagaaggttgaagcgattactttgacagcaggaattttcacttgataaaagagatacattttgtgatacaactatgccattatgaaggagatttacctctgtatgaacgaaccctgtgctcaaacattaggcaatggccaggacaattcattggcttgagaccaaattcctgtttctcaatctgcaagaataagaccaacaagcacccagtaataaagatcgtaattcatccaaaatgtaatctataatatgtacagagcaaatcctctgcacactagacttacctcaaaaacaaacatattctccttgtagtttgcagcatgtccagaggtttcccagagttgcatattgtaaatatttgggctcaaaacctgaaaatacagacatcatgaacagagagaaacagtggaaatgcatgcccatgatctagtaatctaatcataatctgaacaaaagattgaccagccaatcaaattaatgcccacctcttgatatcctctatctctgtattgctgtcgcaaaaaatccatcaatttgttgtatattatagcaccatgtggaaggaagaagcagcttcctggactgcacagtcaaagtgaatcaaacatcctgaggcagaatagaagccaaggtaaattaagatatgaaaaagtcaaaccgaaaaccttgagttacctaagttgatggaaaaagaagagatcctgggtctgtcctaatagcctatgatcacgcttcttagcctcttctagcagatgtttatattcctatggattattgagcaggaaacatatatgaaaaccatagtgtaccagtgataaaacaaatggataaaaaagaacttaggaattagtaacttgtaaaatagctgacaagggttgcactgtctgaacctaaccatgtattaattgaagaaattcgtaataactgactaataaaaagaaaccatatacttctgtaatgacaattgttgttcagttgggcaaatcaaccccaacctccaccaaagcacagagcccatagatacacttttgagatatagttgtatattttgtgcaatttacatgccatgtagtgcacgctaaacttcctgccaaatcaactccaatcttatcacaatgaaatattaatactctagtgtctaaaatgcaaacatagagggtacattattgtgtccagtagcacagacatgatagcacaaaaacagactccacattaattaatgaacgcccatatctgaacaatagccaaaatcatatgctataccttgagacgtttagaatcaggaaaagaaattccatatactctctgcaggctctctcgatctgctttccctctccaatacgacgatgatgcctacatatttacatgcaagtacaaattggatagttccataaaaatattggcaagcaaaagcttaagacaaccaaagaattaccttaagacaagcaaaagctttaacaaaggaagtattggggatgtgtggcccacggcaaaggtcaactagaggaccacatctgtatactgtaatggtcttgtcttcaggcaactcattaatgatttcaacctagaaacacaattcaaacaaataaaaaatttaataaaatctcaaatgtgatataagcagaaatagatatttagggcctcattaattcgcttatgcttatgcttataagtcaagttttgaaatttagaacttaatttaatttaatttttttcttgtttctttcattatagtttattttacagcattttcttttgagtcgttttagtcacaaatgattttttttgtttgttaataagcaattcggataagcatatgaataagcgaaacaatgggactgttagagtacaagaaaagatcaagaacaagcataaatcaggaattttgccttaaatttattttctgcgaacatttcaagggcctctgccctggagacctcaattcgttcaaatggttgtttttcctgcaccatgttgggttaaaaaccaagagttagcagatagatgattccaattacgttacaaagaaaacatggcataatcatggaatccaataacgatatcacacttcatgacagattaatatcaaataagtcaaagagtaaaactgctaagtagcgtccacaaaaaagggtaaacacaaactttaaaatgagttcaaaataagagcataccgcaacagctttctgtgcttgggcatcaatgataccaaaatgtgtctcattcaatgtcagatcattgtagtaggcatcataatagaaacccttaacaggtaaaagtagaaacattatgttaatcactaagagggcttattatctttcttgcactgaacacgatttttgattaattcaatacctcccctcttgtagtacatggcccaatacacagcttgcagccatatgccctctcaagagactgcaaaagtgcatcttcaattagaaaatactgaattcaaaaggacttatagcagagagacatgcaaaatcactcgatgtgtaaacaaaaaagaaaaagagacaaccatacaacttgcttaaagaaaaaaacatgatacaaggaaattatgaagctttaactcacttctccaagaatatgagcacttgagtgccagaaggtgtcacgcccttcattgctatcaaacttgaacaacttcaattcacaatcaccttccagtggcctcgtcatatcccacagtgttccattcacttgagctatcaagcagctatttgctaatccacttgatatctccttagcaatatccataggggttgagatccatttctttccgtccttgactgcaccatctggcaaagttatcctgaagaaagttgcagggaaaaaaatcacatgagaagaattaattgccattgccattgtgctgcacattgcaggtcacagtgtgccacatttgtattgtaactagcaaaggtacattgagaaaaggaaacctaagcaccatataatcaagggttttctatattagaatatttaggcagaagaaatgcttgccgtctctattttcttattaaagacagatggatgttaaagttgaataacattatggcattattatgcagtttgcgcagcgcccattttgtcgtcgcatcgacattcaaatattcccaacactcaaaatccgactccaaattatgcagcacaaagcatggctatcgaggatattcccttggtgtgctatatgcctatatctacatctcaatgcctgagacatctgccatccatgtagtatctaactccattttcatctataacgcgccgcaagcattacggtttccgaatcaaagccctcccagtttcttaactacatcaaattcacaacgaatcgcagaacggggctcacctgatgggctcgcctccgatgttgaggcgctcgagggcctgcttggcctggatctcctcgaactgccggatccgcttctgcgtcaccgcctcaaggtaggccacgtcgggctcgacgttcggtgccgaggccgaggccgaggtcgtcgccttccccttcgcttccttccccttcccggcggcggcggcggagttctcccccatcgccgcggcggagagggggcggagggaggcgacgcggggtgggctgctgcgcgggcgcgggagaggggggaaggggcggggcgggcgctgccggaggagcgagaggcctcgtcgccggaggcagacgagcataaagtggcggcggcggcggcggcggcggcggatggattagggtagataggggtttgggccgagccgaagagggttttgatggttttgggcgtttgactcccctcggtgggatgacgacagcatgggcaggtacggtagaattaccgtgggtgccaaggctgcaattggctaatcgccgtgggtgccaaggttgtttgcagtctaatttgtttttttagaagcttgggcgcttggcactgccgctggtcaagtttgcgtttggcacctcactctgatttgaaaattgtatttgggatttttgttatgctttaatatttttcttacactcgcaaagagataggaatatctataagtgtaattcttaaaaaaaatgtttgaatacatgattatgtgtatgataatttttcaaaggcacaaatggataaattaactacttcctccgtttcatattataagattttttagcattacctacattcatataatgttaatgaatctatatatatgtgcgttaagattcaataaaatctatatgaatgtgagtaatgctagaaagtcttataatataaaatggatggagtattacagagtttaaaaatattgttttgaaaaagtattggaagaaatactaatgaagaaagattttttgcaaaaaaaaaaatcggagcactatgggcttttggaaagtgtgcttactagtccaaattcctaagaatggaaccttacgattctttctcataattttgtattaacgctatagctttttttcgctaagacctgtaaaagttgaattttaacttacgtgtttaaagagtgatatatcacatattaatatatctttctatttttttaaaaaaataatataactatttgggatatcttctcgagagtttagaatccacttctttatcttagataaatgcatccccttccttactcggcaatatagtgcgcgtgtatactatctctctctaaaaacataatctctaagaacttctaaaagaaggccttgtttagttcctttttaaaatttttttaagtatatgaacacacatttgaagtattaaacatagacaaataacaaaataaattacagattccgcctgtaaactgcgagacgaatctattaagcctaattaatttgtcattagtaaatatttaccgtagcaccatattgtcaaatcatggcgtaattaggctcaaaagattcgtctcgcaatttacatgtaaactgtgcaattagtttttttcgttcacatttaatgcttcatacatatgtacaaatatttgatgtgacggaatttttgaaagtttgaaggggactaaacacaaccaaagatatattttctctttgtaaataatatccctatgatatcagtacgttgtttaaagtataaacataatccccatcactatctaaataacaaaggagcagtagctgcatcaagtatctaaaatcaccactactatactgtttgactgggtatattttaatcttctttagtcgcttccaccgtcttgttcctccgcatcaacgccaaaaatccgcacaacgattgatggaggcgccaacactgtccctgctccatctccatgtttagccacctccgtttctgtctcagccagtggcaatgccaccgccgcggcgatggccgccgaagctggagcaagtgtaggcggcgccgcaagttgtccgcgtggcgcgaggagagggtaaggtcaaggtacttattgtagtgctccctcttgtggccgccaagtgccactcctgtcagttactatttcccgcacacattgcacgggtgcttgccctccgtcttgccggcaccggcgccgccactgccgccggcggcagccagcttgtccctgtttgatgtggccagccacgtggccacccatcccctggtgtgtcttatactccatgccgcaaccctcgtacttgcacctgtacggtccacctgatcgtgatactctaggtaaccgagccaggggatgaacccacgctgccgccgcaggcagcggcagcggtggctctcctttctcgttctcgttgatgtgaaaatacgaggcctgggagatctgcttaactccagtgcaggtcaaaaacttgtctttaggtatgctagcgtaccagttaatttgatcctgcaatcaacaagaaacaaagacaaaaaaaaaccgcggttaaatccataaacgatagccgatcggctaagtgccgatgacatatcatttatctttgagccgatgtcataaatgcatcgatcgacagtcattaataagaactagatctgctcaatcggctgtagatattaacggtatatagtccttatatcgatatatacttaaatcaagtgattgagatagatcggtcaccgtgccgagacagtataaatcacttagatcgaaatatatattaataacaagactatatgtgtttatagcaaagccgatcagatagatctagcgtatatcggctaatactccgataccactctatattaagatattaaagtaagtaagatataccaaacaaaaagcctaatatacttagatgtaacaagatcttaacataaagggcagatttaacatgtcaataaggcaaataagataaatgtagttaaatcaggtaagatcggctgaaacctcgatactaccctaatcggcaaccaaagacaggctagagattgagattctaatcacgactcataagatcaaactcaactgatgcagctataagtatgaaaagaaagaaaatatctagacaatcaagccgttggaaatttcatagagtggtggatatcatatataatctaagtcaacgtcggtatttaacctaatcggctaccctcttctgacagatgttagccgattgtaggttagataacgatatcgtcgaagattatgtaggatatatgataactcgacgagttacataaacaagattagagtatcataaagatggaagcactaatcccgagaacgcaagccgccatagcaagttttacctcttgttgaagatcgaaaccgatacagcttaacccgaaaacaagaactcgtagtaaaaagggtggcgatgcgccgagattgtattgaacgtgtgttagtttgattacatggggctcagggtctatttacacctgagaattacaaaatatgtccatatcggacatgactcttatctctaacaaactctaaaataccataagtctttgcggcagacttttgcccaaacatatctctaaggaaattacataaaatatcctaattaatagatacaattgccttcttaggactctatccatctgtggcaatcatcttgaagcacgtcaacctaaaccaacaacatatgttgcgtcatattgtcggatggctcaatcgactaacccagtccgactcgaactctgccgattttagttgtagccgattcggacttcagccgatcctcactctgtttccgggacgatttccatctcgaattccatctcggtttcttcttcatctccgatccttggattaccaaatttggtcgttaacacatgccccccaagttcggaatattagataatgtttcggatttgccatacgtcgactccgagagaaatcctctcgtgccgttttctgaccgttagtcagtgctttaaatactaaccgttgtccccgagaaatctcacaccgtttcctccgttttcaccaccgaagcaagctccgtcttctctctccccggcgatcccctcggtgcacgaagcgatttctaggcgatctcatctccggccagatctccgcctgcggcgatgtcatcctccgccagcccgcctgccgcgccatcagccgagtacgctgaggtaagttctcatcggctagatctccttttctcgcaacagattgattttcctactccttatcccgctttccccttctcggttcttttggatttgtagcatctctccaacctagttgcaattacaagcctatcgcacggaaattattacttcctcggcccagtcggcaaccctgatcctaccgagtttatcatcggcgaaaccaataggattcctttcagattggccaacccagatctaggtcactagaagaacacctttaaatcttggccatccctcgagaaaacttcacccgagaagagttggattacatggttcaagcgtatgtcggctagcaagagggttcattgggacgaaatcggaatcggccaagcgcttgaccttaccatagctaattctgacaaggatgaacctttaatggctgtcgcctcctatttttggtccaacaccatcaatgctttcttgttcaaccaagggccgatgaccccaactctaatagatatcaccatgattaccggtctagatgtcacctcatcggccaactctatgagtctgaacatgaagaatcagtatgattttaggaccaagagcatagacggctggtcaggttatgtggcagcatatgtgggccaaggttctgtcactcctcgagagcatgtagcctttctgttgatgtggctggaggaatttctcttctgtggattaagctgcggccctacaaccaactggcagtttgtagccgaggccttggaatcaaagagacaattccccttaggcaagatcctcttcggctatttgtaccaaatgctgaataatgcatcggctaagatagccatcggctcagtagttggggcaggtggaccatggtggttattacaatcctggttgaatctgatggtcatgaaattcgtcaatcggccatctgtgacagaagccgaattcccaagactggagccgattgtagaagatgatggagaggaacgcacccatcgtagatgcacatcttatggagaatatgccacaccagccgatgcaggagcaaagctatcagctgaactgcttaaggactggttctgcagtttttatgatggctttcagaaagacgctcggatttggttctcctatgaagactcgactctcctggaaaatccatcggactttagatttgaggacatcaaccatgaaagatatcaaaagtccagagaagttttctcgcctgcaatcagtccatgcatcctccttgttggcattcatcaaggaaggaatattcaaatttcttatgagttctatcatccgatgagtgctgtcagacaacttgggatgggacaactaccaatcggtttgttctttgccaataaaattcaatgccgaggggaaatttcatcaaccttgatgatggatcgactgcttaatctccaagggcctcctttgggtagtattgagaatatagagttggcaaggttcaggagcagatcatttgacatatggtggggtgaatggaagttgcatctgttccaccaaccggcctcaatgtatatgacagatctctttcctgatgttatacctcaggtaaaccttgatcttattaatttcatttgaacaattatcagccgattcataacttgactaatcttctcttctgttttgcagagaatggaatcttcccctccacatcaaagcaatagtggtagagatatcgaatatgccctaggtctaattccaaatggaggtgggccatctcctcctgtcatcggctataatgcccccaagacttcaactcttcttcaatggctcatcagagaaccagccgatgccggtaaaaacagaagaaccaggtcatcggctgtggatacatcggctccagccccaaagaagaaggccaaattaaagaagactaagccaaccgatgatctgcctgccctggatccatctattgaacaagctctggatgaagaagagatcggagagggtattgatcaagccgcagatgaagtaagtgatactgaaagaactccatcggcttcacctaaacaaactcctccgactccctctgctccagctcacttctctaggatccatcttttataactattttatcctcagccgattattcactaatcttgtctttgtagaaaaaaagaattgctgtgaagaagaaatcagaaacaacaactctcaaaccggctcctaagtcacaaaagttcccggatcgatggaacgaggaactagaacgtggagcgcgggacgccattttccaaaaacatggaacgaaggggtatacctcttccaaaagtacggaactataggtggaacgtgttcctagcttttttggaacgataatccggaactctacggaactatggatggaacgtgttccttggttgttcggaacgattatctggaacggtataccctactagaggaacatgttcctatatttgttggaatgatagcatggaacgtggaaccttagtcaagaatattgtttcaatgatttttttaacaagaaacttaactcaagtttatagcaaagtgtaacaaaagctcttagaataaattattacaaattgagcttcatatatagattatagatatgggtggctgctggcagcaagcatcatgaattcatgaatcacaacagcaccatgaaggtcttttctgtagtagcagtgtagcactcatatgatctttccatgttcctgtaaacacataacatatggggctgtttggttcccagccacactttaccattacttgccaacaaaagttgccacaccttgcctaaggtgaggtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgcaaccaaacacaccctatatatgcacattattgccaaggtatgaaaaataaataaataaataatcagttaacatatgcttattaccacttagatggtggagtcttcgggatgtgcatcccacatggcgttaggccctgatttatagctttcagtaaatcttgattgaagacacaagtttgagtggataaacacaagcttatccgcgtttgcagcgtttagtttgtttctctttgcattatggatgaactgataagtcccccaaatcctctcagcggatgaactgctgataggttgcgagagaacccttttggcaacctctgccaattctggtgtctcagatccatagctgcaccaccactcaattggttccatcgatgctgcatcggcctgcacatattctagtgcaaaaaatcccttcttcataataaagtcattgagttgctcgcgaaggactttttcctcttctttattatctgctattctctcaaatgcttttagcacacctgtcatgacctcaacatcttgattcggtgctctccttaatgtgccaccgggagcaggtttttgaagataattttgatcataaaaccttgggcaaacagcataagccaaacaatgaagtgggatactcatcttttcccaacgttcaatgactatgttctctatctctggaaaggaacttttgtatggattgtcatctttcatcatgatatcctttatctctccaaccatacaatccattctctcatagatctcacccatttttggaccctctccatcactgaaccttaatacttcatatataggacctgtgatagcaagaatattctcaacattattccaaaagtcctcacaattgatttcttgaacaatggctcttgcttgctgccgcagatcattggtgcaacctttcatccaatctttccattgattggtgactatggtggtggcaagtgcttcttgacatttagtgagcctcaaaagcaaaaggtagtgagaagcaaaacgagtttttttaattttctgtaggtccaactttgaattacttttaaacattgcaaggcaatgctgatgattctgaaaaaacttgacaataggctttccttgctgtatgtatcactcatccagtcaaatttttttgagaaatccttgaatataa

SEQ ID NO: 17780 - DNA, 2434 bp, Oryza sativa
  unsure (1)..(2434): unsure at all n locations
gtcacgtgttgatgacacaactgctaccagttgtaataaggggtatccttccaaacaatgtccgggcaacaataacaaagctatgtgcattcatgaacgcaatttcgcagaaggtcatcgatccggatagattagaagcccttcagaatgaagtggtgcaatgtctcgtcagtttggagttgatatttccaccttcatttttcaatataatgacgcatctactttgtcaccttgtgaaagagatccgtattctcgggcctatgtacctacacaacatgnttcctttcaagaggtacatgggcgttctgaagaagtatgttcgtaaccgtgctcgtccagaggcaagcatcgccaagggttatggaacaaagaggtcatcaaattttgcatagaatttatcgaagaccttcgcccaatcggggtacctgaatcacgccatgaagggagactacggggaaagggaactcccggaaggaaagcgataatgacggtagacaacaatttattccgtaaagcccatttcacttttctgcaacactcttcattggtagctccttacatcgaggagcacttggtctagttcgcgccaggaacatcggtaagtccgatgcatggattacacggcatcacattgatactttccccgcgtggctacgacaacatctcatgggtaacgagtcgatcaaccaacaacttgccttcctggcgagggaaccgtctgggtcgatcacgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgtcgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgcaaattataattgactggagaatttttaaaagtattaaatttaatatatttttaaaactatcattcatatattagagtttttcacaatttaatttactgtctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatattggaatttttattaattataagtcatatatttgcttattacaatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttggtaataccaaccgggactaaagatcatctttagtcccggttgttctcaacaaccgggagtaaatatcttttctttactcccggttgttctcaacaaccgggactaaagatttagtcccagttgttctcaacaaccgggagtaaagatcttttctttactcc

SEQ ID NO: 17781 - DNA, 665 bp, Oryza sativa
acgtgaatgagaacgagcgaatgaacgtgaacgagctagggaacgtgaacgagcgaacgaacgaggacgaacgttaacgtgaaatgcaatatatatatatatatatatatatatatatatatatatatatatatatatatatatatgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattggacttatcatataagattgtgtagtgttctaatattatttgagttttaatataagattactttatttgtaattagacttagtatgtaattattgactacggaattggtgcgacaagtagcaattgactattgtagtcttaattagacttagcatatacgcacgaaacacttagcatagatgactattttagtcttagcaagtaatattatttgagttttaatataagattactttatttgtaattagacttagtatgtaattattgactacggaattggtgcgacaagtagcaattgactattgtagacttaattagacttagcatatacgca

SEQ ID NO: 17782 - DNA, 1114 bp, Oryza sativa
  unsure (1)..(1114): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgctgcacctcgttgcccgcgtgccctcttctgtccaacggagggttgactaccactagcctcctcctcgtggttcccctccacatccctttccacgtgcccctgctggttcccctccgcatccctctccacgtttccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtcatataagctaagtctaggtgacgtatattatacaaccctagctagtaaataattatatactaagtctaattacaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatctatgctaagtgtttcgtgcgtatatgctaagtctaattaagtctacaatagtcaattgctacttgtcg

SEQ ID NO: 17783 - DNA, 495 bp, Oryza sativa
ggttacgaacagcagcgctcgtaggttaaactcctcctgtttgtcctcgtcccacacggggacaccttccttcttccacaactgtttaagatcttctaccagtggtcttaggtacacgtcgatgtcgttaccaggttgcttggggccttgaataataatcggcatcattatgtacttcctcttcatgcatagccagggggggaggttgtagatacacatcgtaacgagccaagtgctatggccgctgctcatctctccaaaaggattcatgccatccgtactcaaaccaaaccgtatgtttcgtgcgtcctttccaaattctttaaattttctgtcgatgtttcgccattgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaat

SEQ ID NO: 17784 - DNA, 315 bp, Oryza sativa
tcctgcagcccagtaaattaccagtgccatgcttgttaataattagtaccacaggttgaattgctaacccctccgtcgagtacgttgcttataggcagaaacacatccattaatccatcgaaattaaactataaatagccatgcatgcgaggttagattaccacactggtggagaaaccctttgtagtcccggttcgtaacccccctttagtcccggtttctaaaccgggagtaccaatccaggactaaagatcgctatctttagtcccgggtgaaataaccgggagtaaagatcgatctttagtcccggatggg

SEQ ID NO: 17785 - DNA, 1178 bp, Oryza sativa
tcaataaatcgccaatgccttgtcactaaccccattttttgccttccattgcaacaactccagagtggtatccaactttttgtgcccctgctcgcaacctgggtacagtgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaactattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaaagtcccacccctatatatatgtcggcttcctcctccagctgcccgagcacgcttcaaaatttcttcaaa

SEQ ID NO: 17786 - DNA, 17607 bp, Oryza sativa
cgttacccttttgaaccgggactaaagattatctttagccccggtttttattgcatccgggactattgtggaaatcggccgaccgacgaaagatggtttctccaccagtgagacattggcctgaaacatgaacctacctgcatttaaacgttggcacggagaacaatcatatagcatggacaacactgggtcgcgcgcagtgtgcctcccaaatataaaacggttttaattagaaatatagtaaaaaaaatgtcattcagagtaaggtaagcatgccaccgcccccgccgacggcgtcggcgctccagccaacgccgcccacgcgcatccttctccgccggcctgcccccgtctccgcagcatcgtggccctcgcccacggcgcgtcgcacccccagtgccccgtcgccgttcccagcaccggccccgccatcgcctccgacgtccctgcttccgtcgccgccgccgcggctgctggccgggggtggccgcaccagcgcaagatccatctcggtggtcctggagacgctagatccgtcgcacaccggcctgcgtcgctcgttcgcagaagttgtcagaggagcggcatcacatttttcaaattcaaaacaggttgtttgggcgcgttcctcagctagctccggcttaaactcgccatttacttctcccgtccggaacaaccaccgctccactcgccgggtcacttcaccacggagagccgccccctacgatgctagcctacctcaacgtcgcatcgccgagcaggatgatgggcatggactgcaagatcctggctggatccgggtgcagcggaggagctcgcggagacgcgaggcgcattcaagcggcgtctgcctaccacaacgctcacctcaatcaagcaatgcgcttcggccgtcttcaagttgacgggacgctgtacggccaagccgagactacctctccgcctcacatcgagagttcttggctcagaccagtggaaggtgtttcatttgcctctctcgtggacaccgagcagcccagtgcaggacccaatctgctgcttcctctgtcagcgctccggtcaccgcgtgcgcgactgtcgtcgccgcggctcggcgggtcgtgcgcgctcgtcggctcgtcttcgcgacgtgtcccgtacgctccactcatactacggggctcgcactcgcacgccgccaccaccgctgcttcgccaccaccttgccgacacgcgcccgccgcctctgcttcgtcgccgctccggcttacctcacacctccgctcgacgcgagcgttcgccagtcctctcaccctgcaagcgcgcctcccccacagctcagccagcgctcctgtcacgcccggaaattcactaataatttccgaactaatttgtgcataaaatcctcatccaggaatcagccgaggtacacaaactgacaatttaatatacaaatccatcataataataacgttacatacttacaaaagaaaagaaaaacagcaggcacggctattcgaatagttttactctggccagaggtgtaccactgtacccacaagacacagcctcaacatcatgtctaccatgcgtcgtgatactggaaagtacccgaatagaggctgtgacaatacactctgcacaacacaactcaccacagtgcaccattcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaacagtagctcgcgaaccggtccttaattgccatgagcacgaccttcaaaaccatgtgctcacaacccaccattaatcatattttaattaccaattaattatcataacacgattagccatcgtgagctaccattaaatataaccataaataataatgtagtatatatgattcatcccattagtgagctaatgtttctaagcattgcaaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaacacttccggcgctctcacaaaccttcgaaacgacggaaacgacaagctaacacgcaaaacaaggaaaacactaagaaactccaaataaacaataaatataaagtaaaaaaacatgtagatcataattttagatgtattatgagacttgaacggcctcattctgacttcatatgaatttattacgaattttacaagatttaatctaattaaagcctatttaaaaagaattaaataaatttaattctatttatggataattttaatatgtagatctttattttatacaactttagagacttgaaccaactaaacccgagctaagatgaattagttatgaatttttaaagattaaaccggattaaaacatttatatggattttaattgaattatgacgcaataaagaattatttttgaaaaggaaaagaggattattgcgtcagcgggctcggctcacggtggaccgggtgcacagcggcggtctacggaacggacggccgagatctaccctatccaaaacgaacggccaagatcaacttgatctaccgcggttcacgggacatggcgacgatgacgtcagcggtgacgtcatcaccggcggcgactcgggagcacgtgctcgacggcgaacggcggcgagacggcgcaaacggagggtaccaacgggtagagctcgactcggcgaactcaccagtggcttggacggtggcggacgacgacggatgacgacggcggcgaggctgaggcggcgacggccttcgggtcggcggtgacggcggtgcttcggtgggaaacgtcggcaacagagaggtggacaagatgctgctcctcctcgcgatcccgatggtggcgacggtgaccgaagacaacggctgcaacagcggcacggcacggctggaccgacggcggcggtggagagcttcggggcgacggagtcagcggcgctccgacggtcttcggcggcggcgaagcggtggacggaaacagcgacgacctcacgatgctgatgaaggagacagcgatcgacggcgatgaccgaagcgacgacggcgaccgactagacacccgccggcggcggcgacgcagagagcaacgcggaggcggcgctagagaaggcgacaagctagggcgaaggtggcggcggaaagaggaggtcccggggatgcttataaaggggctagcgagcggtgacggaggcccacggcgatcggcggcgagatggaaagcaagggttggagggagaaaagtcgatccgaatcgagctcaaatccgtcggtttccaaacgaaattagccgaagtttctaaaagagaaggaagaggagatcgaggagattatttcccctcaaatgatttggctggagaaggaatggggcggccggatttggaaggagacggtggcgcggctcggctagggttcggccgggcgacggcgcgaggttgacgacgggtccgacaggtgggctccacctgtcagcggaagggagcgcgcgcgcagacggctgctggctgactgggccgactgggccggggagagagagaggaaggttttgggccgactttcggcccaaagccaaaagaggggtttaaaaacatttttctatttaaattattcatgaaatggaattccatttattaaaaatactttcttggctcaaataaatcccagaaaaatctaggaactaaagattcaagagaagtatttaacaaaattttatctagccaaattttatattgagatttagcaaattaaaattagatcttctcttttaggcttttaagatcatttctaataattccttttaaacaacaatttataatttaaggatttttaaacaagaaaagctcttaacaattataattagatcattaatgatcaaataattactgaactgttctttgtatcatttaggaattgagctccgaaaaatccgagaaaatttcagagagtatagttaatcatggagaatttaataaaaattaaatccatccaagctttatatttaggaaattttatttcccacatttaacttcacttgtaaattaatgaacatttaatataaattctattaataatttattagataatttctaaatcctaaaacgaaaatcaggctgtgacagtttcccaagcaagaacgcacccggctgccgccgccaccgccccggtcgacccagagcaagatgtcgcagctcggtgacccggccacgcgccccgaggaggacacgtgcttcatccccacctcttacgccattgacgaggagctgcgcgagtggagcgagactgcggctgtctcctgggcggcccacgcgccgtcgaccactacaccgcgcgacgtcgagcaggccttcctagatgagttccagcttcgtcggggcgaggtggctgtctcgctctaccatccacaggccttcctcatcaagttccaacatcgtcgccattgtgaggaggccctggtcaaagggtacgtcaagcgtcgcggcatcgagattcatttcatcaagtggcgcagcctgcagagtgcgctcggcgtcgcgcttatgttccgcgttcggctgtgcctcgacggcgtccccatgcacgcctgggctgccgacatcgccgagcggatcatcggccgcacctgcgcactggagcagatcgagaccgacgttgtccatccggtggagtccggcaacacgcgctccatcgacctctgggcgtggacggcgaaccccagcaccatcccgaagaggatgtggctcagcttcaccaacagggcgaaagatcccaagctggcacccctgctcgcggtggaaagcccgccggagcactggcagagaggggtgcgccatccggtcctcttccatctggaagaaatccacgactacacagcggcaacaattgacctggaggagcaaggtagcttccagccgaccaagcgtcggctgccgccttggagcctgggagtgctcgacggcgagcaggtcccaggacgggtgttcgaggattttccgcatcacccaccgccgccccgctcggttcacgaccgtctcggcggcactgagcgggaagtcgatcgccacgaggacgatcgccgcgatcaccacgacgaccgccggtccggccgcggcaccagggacggccacactcgccgtgggcgcgcggcgcggggcgggcgccctcgcgacgacgacgaccgtgatgactttgatgacgaccaggacgaagatcgtgaggaacgtgaccgggacgatgaccgcggtcgaggcgacgatcgcaaggaccgtgaccggggcgggcgaggcaggcgacgggggtccagcaacgaccacccgcgaccctggcgccgcattgatcgggacgatgatcgcgacaaccgagactgcgatcttggccacgactgtggcgagcagcgggcaagcgacaatgactaccgccgcgagcgcacgcgctccctgcggcggcgggacaggggggctctagccgctacggcggcggtagacggagaccggctgacactatctacgactcgagcaagcagctctcctcgacggacgcctttgctctgcacggcagtgcgctccaagcagaggtaggtgagttccacttattgcacgccctgcacaattcccccttctcgctgcaggagccccaattgccatcgtcagtggaccagctacaacggctctccttcatcgcgaacaaggctctggcggggatgccgccactcccggagcacgctctcccggcggacccaaggaatgaagcctggttcagcatgcagcctggaagccgatcccggtggagagcgtcttcgcgcgcatcaagtcgaacctgccaccgccgactgcggcgaccacatgccaacaagttgaagaagcgctgttgcggctcgagctggcggcgacggcagcgatagactgcccagtgggggacgtgtcgcctttgcaggccgcctcaccgccacctcatgcttcgccgactctgcttcctctcgaaagccaagtcagcctcatgcacgatctgagggaggtggtggcggaagggggcaacaaggatggcaatggcagccatctggcgccgctcccacctactccgtcccccatccagtcttctcaggtggcggtcccggcatcgccgaactcaacgggcatcctcgatgcctgtttgcatcaccgccgcgagcaatcctcgcctcgccaccagcgtcgccgccaagatcaccgtgcgtgcatccgatccagctaacacggcggctcaagatccagccaaggaaatgcggtcaggccacccggcgcaacaaacgcattgccaagcagacttcaaggccgacgatggagcggtgccagcgagttctcttcaagaggctcgggatcctcaacgacgaaggcggcacatcgatcgagcaggtccttgcccaatacatcgccatgttcaatgggctgctgccaccccacatcatcgccgccctcactgcgatatttggcatcgacgacgacgagcaggacgccatggacgcggcactgatatctctggtaggtgaaggagttgcggaagtggccgatgaggtagagaagaacgccgcctaatgtgtcctggtattgaccggacctggaatgggagccttcctttctccatgtatcgtcgtcttttgttgggtggatggagtgctggtggcctgcgagctatcctctccgtgtcaatcccctctgtgtcaagctggatcgccggcggcctcgcaagaacctcttcatttatgttgtcaagaacctcgtttatttcccctgcagtgtggcgtcttctgtgaacatcttgtctacgcatcgtctttacctgcatcggcgctagcttcggcggacttcaccgccaaattttcggccgcacattacgtcgaacaccttcgggccactgtgaacctgtcgaaccagtccagccgcttcctgggcctctccagcgaaccaggccagacacgatgtgggccgcctaatgggcctctctccgatcgtcaagccacccccctccgcttgtttctccctgaaccggccgatgggcctcaggccgccccctccttagcatttcccgggcctctatgtgccctcctgcgcaggcccagcggctgggatggccatggccagcgcctgctgactgtttgggccgccgcccctacacaagaccaagcagcccacccccttcgtgggccacgaatacggagaacaattttactaaaatgatgcaaatcctagatattatttcctagaacgtgagggagctcaattcggctgcgcgctgtaacacgatccatgagcttatggcagacacgaagtgcagcttggcatgcttccaagagacaaagctacagaatatagacgatggtctcgcccgctttttaggaggctacaaactcgacaaatttgcctttaagccggcaagaggcacgagaggggggatcctcctcttatggaatagcgcagtctttgacgtccaagaggtccgagtcagtcgcttctcgatttctgcgcaagtgacggtcatactcacaggggccacatttctgctcaccggagtttatgggcccacaaggcaccacctcaaaagcgccttccttcggcacataagaagaataaggcccggccccgaggacggatggcttatccttggagattttaacatgatctatcgagcaagggacaaaaacaacagcaacatcaaccttgcacgcatgagacgctttcgctcaacaatcgatcgatgtgaactgcatgagattcccttgcaaaataggaagttcacctggagcaacgaacgacgaagggctacacttgtcaagttagatcgctacttttgcaacgagacttgggacttggccttccctaaccatgtccttcacgccctacccacagggccttctgaccactgccctctagtcctctccgacccccaatgtccacgtaggccgagagccttcaagtttgagaacttctggacaagaattccaggattcaaagacaaggtcaaggatgcctggtgtcagccttcgtcacacacagagcctatgcaccgcctaaatgaaaagcttcatcgcaccgcgacctgtcttagagaatgggcaaaaggaatctacaccgaggccaaactgcagtttcacatggcgctcgacgtcattaaaagactagatgtggcacaagaacatagagacctctctgcccaggaaacaagactaagagcagccctcaagcgtaagatccttggcctcgcttccattgagcgggcaaggaaaaagcaggcctccagagtaacacatatctgtgagggagatgcgaacacaaagttttttcatctcaaaatgaatgcgcgaagaagaaagaacaccattcatcggctgaaaaaagacaatggttgcgctgtgacacataaggagaaggaagcaacgatccatgaccattttgcgagcataatgggacggccggcgccaagaccaaataagctaaattgggatgcccttgacatctcaccgattgacctagccaccctaggggagcccttctctgaacaggaagtacatcaagcaatcaagaaaatgccaagtgacaaagctccagggccagacggcttcaccgggattttctttaaagtctgctgggaaatcataaaggaggacgtctttctggtcttcaactccatttacaatctcagatgtgcacacctgaatctgatcaactctgcgaacatcgtcctaattccaaaaaaagagggggccgagggcgtttcagacttcaggccaatcagcctaatccatagtatcgctaagatcttctccaagatgcttgcattgcgactaaggcctcatatgcacagcttgatttcgatcaaccaaagtgccttcataaaagggagaagcatacatgacaacttcctcttcgtgagaaacatgactagaagataccatcgattgaggcgggcgatgctgctattcaagttagacataactaaggcctttgattcagttcgctgggattacctgctagccttgctgcagcgaaggggtttcccaacaaagtggatagattggttgggggctctgctatcaacttccacctcccaagtacttctcaacggcttgccagggcagcggatcaagcacggaagaggccttaggcaggggaaccccctatcgccactccttttcatacttgcgattgacccccttcagcgaatccttttcaaggctacagagctcggcgcaatctcgaaaattcgggggagaacaactaggctaaggatctcaatgtacgcagacgacgccatcatcttcattaatcccacccgaggcgatgttacggccttcacggacatcctgcagcacttcggcactgcaactgggctcgtcaccaattttcagaaatcccaagtggcggccatcagatgcggcggcatcgagttgaatgaggttcttgacggcgtccctgtggtgagggcaagtttccccatcaagtacttgggcctccccctagctctgggaagactgcggaaggtggacttgcaacctgtctttaacaaaatttccggaagggtagcaagctggagaggaaaaaacatggcagcggctggaagaactacgctcgtcaaatctgtgctaacggcgcaaccaatctaccttctgaccgctctgaaaatcacaaaggaatccctcgagcagctagacaagcagcgacgccacttcctctgggcaggcacgggtgatattaccagagggaaatgcaaggtcaattggacaaagacgtgcatgccaaccagccaaggaggattgggggtcctaaatctggacaaattcacgagggccttgaggttgagatggctgtggcatgaatggaaggaccagaccaaaccttgggtggggctggagacgccatgtgatgaaatagataggaacctcttcgccgcctcaacaaacataacaataggggacagaaacacggtgcgattttgggagtccgcgtggattggtgggcgaagacccaaagacctcatgccgcttgtctatgcgatctcaaaaaacagaggaaaatcccttcggcaaggaaaggaggaggacgcctgagtgcaagatttgaagcttgattcacaatcatctatcacagtcgacctcgtcgaacagctagtcgcactgtgggaagcggtccgaaatgtgcacttagacgttggagaacaggatcagattaattggaagttcacaaacaatgggcattacacggcctccttggcttaccatgcgcagtgctgcggggcgccgagtacaatcttcaattccttgatttggaaagtgtcacaccccaatctgataccgccgtacaacggcacctgacaggagcgtgtcgtagggaaacggtgcgaaccgcttcctacgaaaccgcgatctcggtaccagtcccaggacatagtgctggtactcacggtgacaaatatgaatcatagcaatccttaaaataaatagaggacttatttaccttaacttaggttgcagctcagaacaacccgagaatacaaccgacgacgcggacgagaaaacaccaacagcagcagcagcagcggaaccaacggaccaacacccaacaccacaggcgacggctgggaaccaggacgaaaccctaatcttcacttcactttatcttctcttcagggcggaggaactatatataaatatttatatagagcaagggtgagtactttcgtactcagcaagtcacgggaacttaggtgtttaatgcaagcttgaaagagaggcaaggttgttttgcaaatcttttgtttgaaatcattttgaaatcactaagtgatttatttctttctaagtttgggccgaaaagagacttgcgtctcgattcgactttaagagatgtttttcaacagctcatttagtaatgtaccgacctcccgggtcagatcattacttctcggctcccagagccattccacttgattaatcggctcccagagcctttttcattttctcggactcccagagtccagctgcccagcagcaaagcaatccgcctccactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcatatccgcccatgaccgtgggcacggctgttcgaacagttagttaacctctgcagaggggtacactttacccacaagatacgaacttattccgaacacccgtcggtatcggaggttcgcaacaaagcttttcccaagccgacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaatggtgtttgtgggatatttggtatacgcgctcaaagagcacgaataccgaggtaccacaagggtggagcgacaaggaatcagggtattacgacctacgaaaattagtgcgactactgggtaggtccgtcggtttggcacgcaaaccgaggccaagcaagttaagtgtgtgattctactaatgcatgttgcaaacaaaataataatgactttgcaattataggggcaattggtcaaagggtgacttgccttgctcaaggtcttcacgaagcttcacgaatcttcgagaaaacccgcgatcgacgaaaatccggtaaccgcaactatacacaaacaatcgaaaacctaaacaaaagaccaagaaaaggatcctatttagactaaataatagtgccattaaatagatctcgattttacgggaatactggaagtggaacggggtcaatcggaattacggatcgggagatatgaattttggaagtttaattggagtttctagaataggagaaatggtttatggaatttatagaaataatattctcaagaatattattgacagtcacggacgtgcgggaccaagggaaatgattcatggaaattttggaataaggaattgatttatgggacaaaggaaaaaaggatttattaaatccctgaaaaaaagaaaggatggagggatgttaattggacttgggccgaacgaaggggcgcggcccgaagagatgcgcgggcgcggccgaggcgagcgggccggcgcacgggagggaggcggcccaaggccgaacgaggcgcggcccacgcgacgcaagccggtggacgcggtccaccgtgccgggcgcaaggtgggacccacaaggcggcgacacggctcacgcgagcggggtgcacgcaaggcggcgcgttggatcagtggaccgggagacctttgaccggtctccgcggggccgggcggctgaggtggcatccacgtggatgccacgtcggatggggaagggagaggaggccgggcacgctgatccgatggccggcgatgagcgacgtgaaccggcgaacggcggcgaggtggattggggggttagcaccagaagagagaggaggccaagggggatcgattcaacggagcggattagccgggggaaaaacgacagcggctggcggcggcgaccaatctcgccggcacgccgacgtggccgcgcgcgagaagagcgaagggcgcgcgggctcgggcttagccgaaccggtacgcgaccgcgatgcgcacgcggggacgcgggacccgatggtcaccggcggctcacgcacggcggcgttaggcggcggcggaagcggtgacacggcgcggagacaagggagaaggccgacggccttggggcagccagggggaggtcaaggggatccccgggagcatggcggcgagaggaatcgacgcgagaggagccgacgacggtggattgcggcggcggcaatcaccggagatcaaaaggggaaaacacgacgagacgatgagggttcgattcaaaggggtgggagcatctccggggttcaaggaatccgtttccggcgtcggattggacggaacggcaccgagattggctggcgatgagaggcggcctccgggacagagcaagagcttgtggcaagctatgccgaggggcggcgggcgcggcgcatcgtgcggcaggaggaggatcatggtagggagctcaccaacgaagaggaggcagcgttggcggcgcggtcggtgtcgcggcgaggtggtcgcgacgccgaggcggcacggcaccgagagggcgcggccggggaagaagggagggagaggtggtgcccggagctcctcgtcacgcgtccacgcacgcaccggctcctccggtgctcggcaacggacggcaacggcgagagcgggacaagcagcaacaaggcggcgacggtggttcggcggcaatggcgcggtgggtgtgaggactgaggcgagtgaaaacgagagaggaggggtttggggtggcttggttttatagtggaggaatgtcggtttgggagggggaaccgacatagagcggtcgagcgctcggctggcggtcacaggcgatgcaagagcggcggatgccgaggatgcaaggagcggcgaaggcgatggatcgggcggctgaaatcgaaccgctggagcgcaggctggcgcggtcaaggtgggggcggcgagctggcggtcgcgcccgtggcccaggcggtggcaggcggtgacaccgatggtggtcgggcaaaaggaaaaaggaagagggaaaggagggcttgacccttgccgaaacgggaaaaggaggagggagaggggtgtgagacagggggaggagagggagagcagctgcttctcctactcttggatgggtgcggcgtggagtggcggagcggcagcgcacgacgcaggcgacgccagggcttaacgcggcggcaaccgggcggctgcgcggcgcaggcgcggcagggctgacggcggcaacgaccggccggtcggccacgcgcgagcgcgggagagagtgaaggcggtggcgggttttgggcggcgacggcgggaagcggcgtcggcgcgagagagagaaagagaacgagagagcgagagaacgcccgagagagggaagggagagagagacagcgctctctctctctctctcggtggtcacgtgcggcgcacgtggagatggagagagctgagaagagatgggccagcggcaggtttcggcccaaatcatcacgagggaggtaaagtagacttttactgagaaagctgatttggatagaattggagagatttagggtttggattcgaattcaaatttgatattcgaactcgagggtttagggatgtatcaaggggaattcaaggagaagtcatgggaaagattcaaaaggaatacttgggtatttgttctcgggaacatagggtggagtcaaggaaggaaacaaaacgggggtttggacattttgggatttagaaatgtatttggcgaggattcaaaggaagggattgactttcggatttagatttcggagacttgaattggaagaggaaatttgaggcggaggattttgatttcgatgagagggaacaacgggatttgatatgagatctcggcacgacttagactcgcacacaaagaacgaaaattttcgcaattaggattttgccgaattagtttttaacgactcgcgaaaggcggagcgttacagaaagcctgggcgccagggaaatgcaaatttcatgcttggctcatcattcagaacagagtctggacttcagaccggcttgcgaccaggggatggcagaacaatggttgttgcgctctttgccgccgcgagactgagacggcattgcacctcgttgccacttgtagatacatcaagaggatctggcacctcgtctctgcatgggtgggctatcagcagatggacccaacggaatgggaggaagcccagtcagtcaaacagtggtgggagaacattgcaaacacgcctagtgtcccgaaaaaaggacttcgatcgctcattctgttagtcgtctgggaaatttggaaagagaggaatcggcggatttttgatcacaaagaggtggcaacgaacttcctactaatgaaaatcaaagaggaggcgagcctttgggctttagcaggagctaagcggctgcgtgagttaatcccgcactctgtatagtgtacagctatagtggctctcagttttccttttacccctaggggtttgtattttctcctgctctattcaatgaaaaggcactctagtgctgctttccgttaaaaaaaattagaaatatagtgtcgcgagcagtatatagttataccactgctatcttgtgttgttgtggcgtgtgtccctactggctccaaggctggcccgttgatgactgatgtcgtgcgtgccatgcaccagctcgatcgtgtcgtccgtgcatgcatgcgggctaaccacaaaggggaacagcaaacctgcggcacggacacgcacataaagcagatcacgaggagcaatacggataggccactcctgatcaccttgtctttgattgagagagaaagaaaagggcgcttagatcgatcgatcgatcagacggctggggtttggatttgtgggctgcaaattgcgatccgagagaggggccggccagccaggcttgcgctgctgctaataccagggaggcaaaacgggcagaggtcgacggtgacatctgcacgcaggcatgcatgcagatgtagtagtagaggcctctgcttcctctgctgcctgtggctcatgtggtgtttggttggagaaactaaagtggggctaaaatttagtctctctcacaaaaatatatagggacttatgttttttagaaagcccctctctcccaaacaccctctcaatgatctttgctttgccatttgctctgtgcctctgcaggcctctcttctctgtgagctgtgtgtagactacggtttatctgtgagctgtgtgtagactacggtctacggctcgaccgggtaaaaaatttacagtaagtttggttagctagttcacgggtccccggccggtgggccccataggtatatacctctctgcagccgtacgttggcagcagcatgcagcgcatatggaatagcagcagttaacatatccacaacgccacctgcagcgtagtgcatgacaggaccgatacatacatatgctgatagatcatatgcacgtactcagtctgtactgccatcgcgtacgtagcgttaaaacgtatggacaggcgagtagtacatgcggacgagggcccaagagatttcacgagtacatgcgcctctctggcccccaagtccccaattggtccaaatccaactaccagttttagatttcaggagccagctgcatacgcagctctcccggccagttggtccaattaacttgtgtgagcgtgcatgcatgcgggttgcagtcacttgcagagcctctgctcctgctcgcgtcgcatgcatggcaccgctgggcttgttcgctcgctcgctagctagctagctcattcgccagtgcgtgcgaagcagatgatgagatgatggagcagtagtggagtattaataagaccacaggttcagggctgagatgatgacgatgatctatctgcttcctctcttactagttttgaaccacctgaactggccggtcgcgagtgcgcatgcatgcatgcatgcaactggacggccggcggcggattggcggcggctcgccagtttgccggggtgggagagtcaaagagcgcatgattgttttgcatgcgccggcccgcggccggatcgtgcgtggattgcaggatgcggtacggtgcgtccgtgcgtgccatgcatggcccatcacctgttcatgtggaagaggagagcccactggccagtttgggagtaggaacgcgtcatttttccatccatctctctttttttttaatggaatttttccaaccatctcgtttggtaagagaaaaatttgaaggaatttttagtactcctttggaccgaaggatgcatg

SEQ ID NO: 17787 - DNA, 8737 bp, Oryza sativa
caacgatgtgctatcaacccatctgccgatcggctatcggctgactaactctgcttttgtctttcttgctgattgtaagatcaaatcagctggcacccccttgacacactcgaggctagccttggacctgcactggagttaagcaaatcttccaggccgtcatgtttcaacacgcttttagcacgcctagtgggacactcgaggctagccttagacctacactggagttaagaagatctctcaggccgccgtgtttttacatcaacaagatgatagctcgcttgttatttatttctacactttcgcactctctcttactttgtcctgtggtttgcggtgtgtttgttgtgttgcgttcacctttgcagagttggctgatggacgatgctccacttcatgcatccctaggaaatagtaggaggagcagacggatgttagggagaccacggcttcggcaatgacttttgtggaggtcgttcactatagtcgaggagtcctcgacggatgctacgcctctaggtcatgtgattcttgagttgggggggtgctctgtcgctggtgcagctgacacaatggaattaattggtcgggaggcaacgactggatctagaggtcgtgttgtggcatgctaggcctccaccgctgcacccatttttctctttcattttacaacaacaaaaaaaaattgcccaatcattttatgtaacctgacaacttgtaaaagttgatgatttatataggccttttgttagatgtaggcacttgaactgtaagtggaaatcaaggaatttatacaactagtgatttatttagaggtttgttaacagtattatgtaatttactctctatgaagacatgtgagggtgcctattagacgcagttacgctagggagacgaaacatgatattttataataaaaataaaataataggggttgaaagttttagatttggagatgtaagtttcaaaagtttaggtagagattttaaatgctgagttgaaagtgttagatttgaggtggaagttttaaattttgatttaaagttttgaaatttggttaatattttttaagaaaaattgagctcgttgttttattcagactcttattttttttcaaatttaattttcgttaaaaaaaatcacgtatgctatatagaggctggcgttttcagcgttcagtgcacatccctacatgactcggaatcacgtaccacacttatcgcgtccacttgcaaccccgccccctcccaaatgatattattcctagatgaaaacctatgtcatgttctttgttgattaaatcatggtaacttcaatacgtaagtgtatcattttctttatggccgttatttttggagaatctcaatacaaaatagtccatgtcattctaaaatataacaatgttttcatctacatttattttctcaaccaattatattttttcactatttaaattccctagctacctacattatcttctcaatcaattacaagattttcttatttaatttcctcaactttcttaattcatgtcgaaccttctaaactttttttatattttgggaaaggaggcaatacgatgggaatgggaaagaaaccttccgatcgaaaatcaacagctagctacctagcgctagctgtacgtgcaactgtagtaaaggaagaggaaacagcagctgcagaattgcagatgctaatggccgggcgtgcaggcaaaggacatcgcgagaataaacagcgagtactatactcctaccgagaagcaatagtaaagccagcaaaatatgcgcgccatcgctatcatccgtcgcctagcttttgcgggctcgcgcgccggtagctacgcagttgcccttcaatggttagccgccggcagaggccggatggacgaagggccggcggcgctcgcggccagtattgatcatcgtgatatcgaatccggtgatctctgcatgtatgcgtgtattgagggcttgttgtttcgttgccaccacgttaaccctgtcaaatattggtaatgtaacaaattaaatgtgtacttaggaatgctatttaacaaaactttgatattgtagaaattttcactcttgatttttttctaaattttagtaaaactgtaaactgaacacatctaataaaagttggtaatctaataatgtggtggttatgttgggaagtacctacttcatctatcctaatatatatagcaacctagaatgagatgagacacctagaatgagatgagactcattctagaactataaatttcgacatcgtttctgctaggctgctagctagttgtcgacaggtttttcaggactgaaaacattcaatttgtttggccgtcgatcccgcgctaagatttgtgctgagatattttgctattggatttgaactctcttttcataagctagtgacactagccagtcccaccatcgcatatttataacagatttgttcaagttacatcctagttgcatgtagttaaactatagttacactatagttacataactacattgttatctctatataaattagatataaagttgcatatattattttaatacatatatacaagttattattattgttatagtcaagttattattattgttatagtgtagttttagtgaaattatatactatagttaaatttgaaagttttttttttaaaaaaaacttgtgatagttttttttaaggtaatctctttggacacgcccaatatttagatttatagctttaggatgagtctcgttcgatctaagattactatatactggaaggaagggaagggagtacaaaataatgaacaagccctaaaggcacccgcggaaaggcgataatactagcatatgtacgtgctccggtcgatcttaaaaacgctcaattaatgcattaagatggtcaggtcgataattaaagactgagactctgagaatagcgcaggcacacgatcactcgtatgcagttgttcgcacttgcgaaatctctgacgtggttatcattatgcatcccaattattggcatatctctcgtgggagttgcggtattgcagatttgcactagttatgtactactactactacacttttagatactccagagtactagtcgtgtgtgtcagacatggagcggtagcgctgcaatggcaaacatgcgatgttgggcgagttaaatggaggcactgcacaggccatagatgggggtgatacgatcggcagagctagctgcatgcatgtctagctagctctagctggatagtatcatctcgtcagagcgctggctgacagtgcaaattaatatacagatcgatcgacttcatcgccgtaacggctgcagggcaggtacgtaccacgtacgtcgtcattaaggttgtattcaaattaatttgtagatatatccatgcatgcatgcgcaggcagaaagcgtactaactatagtaatcccggatcccgatctatacagtatatgctaatatgcagtgatcgatctatatatatactcctacatttgcacgcagctgtttaaattagccagaagatgtcgcagcatgcagtggcaataattcgtagtttcgtactagtgttgctagctctctgcatgcacatatgcaaacagcaagcggtggcgcgcggggtacgtacgctgctctttacaggccaaaaggggtaggccgccttttggagctaagcagcgagctagctaccgatccgcgtcggatgaacagtgaggcagtacgcgcccccgccaccgcggaccgcgcgcgcgcgtcgcgtctcgtctcgtctcgtctcatggatcgatctgtctgcgtgcgtgtgtgccccagatcgatggttcgatcgcatcatatcggtccagctaactgatcgatcgaggacttgtgcatgcgcgcgaaatttaattaagctatggaccgatgcatctatggcgctagctcgctcgctggctctgtggctaaggcgactgtggctccgtcacgtgaaggcttgtgccgatcgattcggtgcagtatggtatggtctcatttggccttgtgggtgtgtgaatgtgatcgaccagagcggcagaaagtaacagggtcttcttacaaccgttggcaaagcagtggatcgatcgatgatgttcaacgctggtaagaatgttgggccatacgagctgtggttggccttacgttttgggccgaaaacccaatcttgtagccggccggtcccttaaaattcgctcaagacagaaaaaaaaggaaaagtatcagagccaggtttcgatcctgggacctgtgggttatgggcccaccacgcttccgctgcgccactctgatttggtgattggattaagaataaatatataaataatacttggtctcttatgtctacaactccaaaggaggcctagagtctagagatgctgtgaactgatgagtaatcgtgcggacaaggcagcagattgggcagggaccatcgacttgtgagaaatcagcaatcactaagtcggaattttatacggttttacataaaaaacctttctacatgtgcaatcatgctactagccacacaataatcgagcttacctaatccttctttcttaccggtacttttagtacctaatccttatcatgggaaatgccgtgctgtacctctgcaagctgcaacagcgagacaagattctccggaaaagctcaaaaagaaaaatatgcaagaatcatgtcgagagaaacgattctacatccctttcctggtgtttggataaggtggatgtgataatgtgaggcttttgttttaaaagctacttcctccaccctaaagaaaatacaattatagcattcaaaagataataaatcagcagggtaaaaataatctatatgtccctcataaatgagggtgattgatagcgggactgcgggagggttgttaggtacgatgaacaaaaatgaatgaaaggtagttagagggaatttttttttagaattgcattttttttaaaaaaataaagtttcaatgctagaatcgcgttattatggcaaaagtgcagctttatacttatttttccaatttttagaattattttatgaagaaaaaaaattagaatccacaacctataactttatatttgttaattccgaatttctgaatataactaacaggataagaaagtaatgaaaaatgtaagtagattctatacatagttttatagttattaattaattacaagcactacacgaaggaagatatcataccaactacaaatatcagcgaaaatttggtactttcaatagtattatagtattatgcttatctgtagagtgttagcctcaaattcaacccgtatcaagaaaaaaaaaactttgatagttttatgagtataaacatgtcatattttttatatatagatataatattattgaaaatatatgggacaatttcatttttcccccactttgacctctaatattgattttgcctactctttagagttttcgtttttacctccacttttttaaccgaaagaggcgtttacccctggtttggatggaagttagtgggaccaggtttatggcaataaaaatgagaaataaaggaaataaagattttttgaattagttatttactcttttacccctgtgaaagagttaaaactaatctctcctctcctcacctctcgctgcacatggtcaaactgagacctagccggcggcggcgagcgggtggtggcggcggcggcgaagagcatgcgtcggctaggcgcagctcctcccggcgcgagcaggaggcgagcgtgccaggcggcggggagagggcgacgcggcggtgagcggccggcggccaagcagcagcggcgagcgggccaggcgcagcccctcccgccagtggcggcggctcgacgctgggaggatgcggtggtggcaactcggctggggaggaggcgacggtgatggctcggccagggggcgacggtggcggctcaacatggggaggaggtggcggtggcgactcagcttggaaaggaggcggcggcccggctaggggtgacagcggcggtggcccactggcccggccaggaggcggagaggaggaggcggcggcggtggcccgtcgacccggccaggaggcggcgacttgtagaatatgaccttttttttttccaaattttgtccttttttttcaatatttgtctatatttatcacatttgtatatcaaattttgaaacaaattggtttacgaaaattgcaagatgcaaacagaactaatgaacaaaataggggaaaatcagcacagtgagggtaggatgtcttttcgtcaaagatttaacgccgttaacatgtccatcaaaaataggggtaaagcttaatttcgttttaaaaaaataggggccaaaacaaaaaccctaaaaaatagaggcaaaaccaatattaaacatgaaagtaggggtaagaatgaaattgccccatatatagattcaaagaaatatatatagatataatattactgaaaatatatgtatagtttttttctaagaacttttagtgacatttatcaactagtgtgaatggtgtgtgcacgtgaaaacttgtatatataggatacattcatatcatacaaatattacataataaagtagaggacttccccatacaaaatagctagttaaatattggatttgtgataatactctttgcgcatatgtccatatatgcaattatattttgtatagaatagatcgatatttgaatctaggattagatttaatgtacaaacttatgtttatatttgtgtatacaattgcatctttatacaactatattgccatcgctctatatcattatggtttggtttcatcacgatctaacggcttaatattttttattctatgtggcgaacatgatatatcatttccgagatatattgtatatttaggttgtgttcttcaatgtgttggaaattaacccttcacacacgtaaaatgaagtaatggattaccgcatgattaattaaataatagtgaaatgagcgtggctcaactggttaggttccttgtggtggaaccaactcacccaggttcaaattcaagattgacacaggtgcttgcatttacggctaattattcttttagtgataggcgacgtacctgtcgatagtgaagtgacaacccaatcttccggaagtgtttatagggggtagggtagatatgcgacatacctctgttgacagcgaggtgctagcacaatcttttagaggtgctcatagggggtagggtagatatgtcccaatcttccggaagtgcttatagggggtagggtagatatgtgacgtaactgttgataacgaggtgctattttccgaaggagcttatagagggtagggaaaattaagtaatagcttaaaaatcctggaaaatggattaatatgatttttaaagcaacttcccaattttctgtatgtgctcatagggggtaaggtagatatgtcgttcagttttccagaggtgctcttagagggtagggtatttatttattacatatattatagtaaaaaaagtcaaagatatattttgttattcaaaacatcaagaaatatctactattatttattggttagtgttgttaaaggggtatttggtttgtggcaacacaattattagtttgctccctgagcgaaaagcaggcaaacgccttcgtaattagagagagagaaaaaaaaaaagcaggcgacgccagcactgcagggaagaagaggaactgaagcctttctcttctgtccgccgctgcgccctccccctctctgtccacgttcccccaccccacctcggcctaaaaccctagccgccggcggagcgggacctcaccggcggcggcgatgagcgggggcgggccgccgaagaaacgcaacttcaagatcgagctgttcaagcaccgcgtggagctcgaccccaagtacgcggagcggacatggaaggtcctggagcacgccatccacgagatctacaaccacaacgccagtggcctctccttcgaggagctctacaggttggtacaaccccccgaggccccgcactcccatgatcctcccgcctcctgccgtcgccgtcgcgtttcccgcttggcgacctagatcctaccgccccggccctaacatgtggttaattagaaaatttcagtgtgccaattctaataagtttgctcctcttgagatgattaatgattatgattactagccgaacattcctgtcgcatatgttgatggttgaaagtgatttctttcgagagaattctcttttagtatttgtgatcctacaaattttcgttaaaatacagaatttttatagtcaacgatcagtattagggagattgggcggatgttaggtgttggatattgatgggttactccatctagtcatctgtagtattgacttagttgttggaagccatgcttgtcggcctctttggtcgtcacagcaacttggtgataaataactattctgaacctcacttgattgtaatttgcaatatttcctttcatctgtgcaggagtgcctacaacatggtgctccacaagtatggtgagaagctatatgatggcctggagagaactatgacatggcgcttgaaggaaatatcaaaatcaatagaggctgcacagggtggtttgtttctggaggagctgaatgccaagtggatggatcacaataaggcattgcagatgatccgagatattctaatgtacatggatcgaaca

SEQ ID NO: 17788 - DNA, 17100 bp, Oryza sativa
atatcaagatgactttgagaagccgtttttggatgttacagctagcttctacagtggagagtctcaggagttcattgagtgctgtgactgtgggaactatcttaagaagtccgagagacgtctcaatgaggaaatggaacgtgtctcacactacttggattctggcactgaggcaaagataactagtgtggttgagaaagaaatgattgccaatcacatgcatagattggttcatatggaaaactcaggccttgtaaatatgcttgtagatgacaaatatgacgacttggctaggatgtacaacttattccgaagggtttttgatgggctatcgacaatcagagatgtgatgacttcatacctaagggaaacagggaagcagttagtgacagatcctgagaggttgaaagacccagtggaatttgttcagcgcttgttaaatgagaaggacaagcatgataagatcatcaacgttgcttttggcaatgacaaaactttccagaatgctctaaattcatcctttgagtacttcatcaactaaacaacaggtcacctgaattcatatcgttgtatgttgatgataaacttcggaaaggattgaaaggagccacagaagaggatgtggaggttattctggacaaagtcatgatgctgtttcggtacctccaggagaaggatgtatttgagaagtactacaagcagcatttggcgaaaagactattgtctggcaaaactgtttctgatgatgctgagaggagtatgatagttaaactcaagacagaatgtgggtaccagttcacttccaaattagagggcatgttcactgacatgaagacctctcaggacactatgatagacttttatgccaagaagtctgaggaacttggcgatggcccaacacttgatgtccacattcttacaactggttcttggccaacacagccctgccctccctgcaaccttccaactgaaatccttgcaatatgtgataagttccggacatactaccttggaactcacagtggccggagattgacatggcaaacaaacatgggaacagctgacataaaagccacatttgggaaaggtcagaagcatgaactaaatgtatccacttatcagatgtgtgttctcatgctgtttaattctaccgatgggttaacctacaaagacatcgaacaagatactgcgatacctgcctcggatctaaagagatgccttcaatctcttgcttgtgtcaaggggaagaatgttctccgcaaggaacccatgagcaaagatatatcggaggatgacacattctacttcaacgacaagttcacaagcaagcttgttaaggtcaagattgggacagtagtggcgcaaaaggaatctgagccagagaaacaagagactcgtcaacgggttgaggaggacaggaaacctcaaattgaggctgctatcgtcaggattatgaaatccaggagggtcttggatcataacagcattgtagctgaggttaccaagcaattgcaagcccgattcatgccgaatcctgttgtcataaagaaacgcatagaatctctaattgagcgtgaattcttagagagggacaaagcagataggaagttatatcgctatcttgcatagaaggtcattatgtgattattgatgagcaaatggcttgtattcatgtaaaacggtttccatgacgtttgagttcagttttattcgttccactttgtccactgaatcatagctacttctcgtttcccgtaggcaagctggtgttcagagttttccagctaatactgatgtcatgttacgagttgctgctatcttaatataatggagatggatcgtcaaattcacagccaacatgaagatgattcccggccggctgcttcctgatcttgcatgagacagtaatcgtcacattggcagacaattatctttgccgtcgatcccaaaatctagtattgataatttcacaatgtaagtcattctattatttcccacattcatattgatgttctagattcattaacatcaatagaaatgtggaaaatgctagaacgacttatattatgaaacgaaggtagtagtatatttttatacgaatatgttttctcttgcccctgtcatgcagctggctcgctacaataacagatggtctcactctcaccccctggagtttgcactttgcagcaagtctcgcagaaaatgttgtgtgccaacttgaactgctctatgttagtcactcaatccagactccatttagtactaattatgtgccattgttgtgaatatgtattaattaattataaattatgcagagagcgcggaatgagactcatccgccaccatatatgtccggttgtccccgtttaaatacgagcgttctgcggttctcaacttgtacgtgaccgaatcaaagttaacaacgtaatagtgttacctttgtctacgtatctgaatacaactttgtctcgttggttaattaattactcctagctagttataatctcgtttgcatcaggatcgtttcgagagcggcaatcgagacatggagccgccgacccaggcacaattagaagccgaggtcgagggcaactactgccgctcaggagtgcccgaagggagacgcgcgttcgcgatgaagcggcacttgtacacgtacgcccacgcgagcaacatgatcgtccagaaccgattcggcgtgtggtcgcatcgagaccaggggtacatggcgtacatcaggaggacccgctacttcaagttcgtcaagatcggctgggggctctcgaggctgaggcgggtgtgccagcagcacggcgtgttcgcgtggtaccagtgcacgccgcggcgggaggagttggaggccgcggaggccggcgtgcggaggcttttcagccgccacacgcctgcttggatgaagaagcagaagcggctgcagagacgcgagcgagagcgagatgagcggcgtctcaacaagcagaagcggcctctcgcattgaagcagcagcagcttaaggcgcaggcgcccatgacccgtgcagtactactgtttgcttatgtatatgcatgtgtagttaaactttgttgttatttaagaagaattattcgtgcgtagcgtgtagatgttgttctatctggataaaatgaagacaatgtgtgtttctttctttgaagacaaaatggaagtgatctacatcttcgttattcagccttgacaaaccatcatattcctcttacaaaagataaactactataactttcatcgctaggtcgtcacattatcaacgcgagaatatgctcaagttcttggtttcctttttccttttctttcttttttccttctttttctccccgatccctccctttcttctttgtttggccacccgtatagattttattcctcttaatataaaagtgtacaatctttttacgtattccaaaaaaaaaaatttctataactttctaaagtcacatagattctatcccgtaactctatatgtactactacgataacttacttggctttgtttctgagactcccatctgctaggtaggctgctctgatttgatcatttgagtctcctgattcatttgaaccgctgtatatgtacgtataaaagtacgtccgcagcacgtgtggggtaatcaactcctgtccgggctgaacaaattgcgctcaactcggcataactgcataaggctatgttcgattaatcctaaagaggaagggatttattttacattgtggtgtgaaattattccccctcaaacccctctaatctccttcaagccccttcaaaccgaacaaggaagaggggaggggtaatccctttcgggcggaacaaattgtgctcaactcggttgaacaactttaaattgtgctttaaactccgcataaggaaaaaggcatgcatggtgcccaggtttagaactagtactagaaaatggagtatatgtaagaactatgaagtcgtttcagcttagcaattacagaccagagatcgacagaagcaaaaacaaacgacacatggtctatgccttaacttcctccaaaaaaaaagagagagcattatcttctgagagctcgaggaagaggctgctggtaagagccatctgtctgctgctgttgatttgggagctccccaccaaattgctgcatcgtcggcaatgcccagacgtgcactatcaaatccataaagcccccacaaatatgactctaaagaagagagcccacgatgcccctgcaagctaaacgagaaagaagaagccgacatgctctgcgtgagctgaagtggtagattgggtaaaccagtctggccagcagtagggaaccctgatcaagaatactcccttcacctggcaatgaaggaccagcagcttgggataggacatactgaacaaatgaagaactcctgagcaatgccctactagtagagagcgatgcactactagtggtagtagcagcagcggcttgagtagcagaagtaacacccaaatgaaggcatttccctgatattggtaagtgaatcttaaatcaaggattagctggaggtggatctgcagtctcgttagctcggtgatggaacagtttagttatcgctcttcgttcacaatcctgcttattgatgtacatcttattaaacggtgattaaactattctttaaaattgttcataaaaaaataaagagatttttatggagtttcatgttgggacataaaagtgtaaatgcatggactcctatgttttgtcattacaaactaattcaaaccacagcagcagaaattcagcaaggaaaagaaatgctttaccagaaattttattaccttaaacatattgaggtgaaaaggttttccagtgttcattctccttagcttcaggtaagtatatgcaaaactcaactgatctcgtgaggtgaaccggttaacctcattaaaccaaaggcatgaaaacagattagacattggtgtatgggcacgtacaatgaaagatccttcaggcacatctgcacaattgtgatgtaaaagatcaatactgaagaaatattcatactgggtaatttatcagatcataaggtaatgatacgaacaacttggaagaacaggctctctgccagattcattgaacttcacaagaccatcagattggtaaaagtaaaattgctcatcaatagcagtgtggttgtacttgttcagtcgcttgttttgaagcacttcctccgagacacaagtacgatcatagtgcactgaaatggcatattctgctttatttctccataagaaatactcaacgataagcattggatcagcattaaggcgcagtttactatccaaccaaatagagtacctaatgaagtacaaatcttttgttaaccaagtagaggaaacacggatcatggatatataggagattgatatgtaggaaacagttgaaagaattcacaaaaatcctaaacagcatagggagtagttaggacttaggaacttaggatgctttttatcaacttgttacatggtaagtaaacagtaactattgttgatttagaatttataacatgtcttttattatagaaatgttcaactgcaaataggacaatttagctttagccaattaataaattcctcatgcacctaaacaaatcctacatcactaacaccaaacatattctccatgaaactaggcaagatacatattgcacaaacaaaaacttacattgcaaaggggaagagtctgtgagccagaaattttggcacctttcctgctctccgcatatctttgtacggtaatttttcaactacaacaattctccacaggccaatgaatccagtttcatcagggccagttccttcagaggacagagttcccagtgttagctcatccaggaacatgacgaagcatacattcttcttagagtatggaccaatctgtgggagttcaaaccggtaatgtttaagtacagtctaaccctgcctattgttgaacttataaaatatcagcaaaacatacaatagtcatggaagttaaaaaaaatacagagagatttaaaaggagccaaagatagtaattaatgtactagcatgagggagataaaactccaaaagaacccattactcgcaaattaggtactctcagataaggtacttgctataatacatgtatacaagtatgccatgcacctaaaaaaaaattaccttgctcttagttggtctccttaagtaatcagagcttccaaaaatgcatgatgaaacaacaacacggcaggaagccatataaatcttgtcattttcatccagatcaaatccagtattagggtaatcctctggtccttgcacaaaaccacagtggagggtttggtttcttgcgtagtatgtctcttctcgttcctgaaggctctggtgtccaccaaacaatggttcaaaaataccattactagatgatacattctccttcgagatatagttcaaagaaaaccctgtaaagttgttgtagataccaggctccactagatcatcaactgatggcaaaaactcaatttgacatggtacatctgcaaaaattcatttgataaattaaagcagtatgcacgatggaagaaagcaatagcaaatttaataaacaaaaaagaacagcattcatgtctgcatttagcatatgagtagaattgactagaaaatctcttatatgagtcgtaagaaccagaactgatgctaacttgtactatacatctgttcagaaatataaagaaaatgtgtggtcaaccttgtctaattttgactaccaatatataaaaaactatttgaattggtatgtgaaaaatgatactatcatattttcataaaatatattacagtaatacatatttttttacattttttatagaatatactcaacatgtcataacccaggagtaacaagaaacattaatcaaagtagtagatattctgatccattaggtagtactactacaaccaacttgccgctggctaggcatttggcagatacaagagaacaaaagatatgctatctagtctgtttagaacaaagtgcatctaggataaagttggataagatatgttttattgtatttgattaaaaagtaccatattttaggaaactcaatatgtagagaatatagtagagaagatctcttacaatgcttgcgagatttctttcgtcttttgaagggttccgactcaactttagtcctgacatgagaagttaatcctatgactgttgttccatggtagccaaaggaatgtaaatacacacagatagatattatttacatatgaaaaaaaatgacgaactcacatagacaaatttgccttaaccttagcatcgagagtttgtctttgatccattctctccttaacatcctttatactagccatatcatgatgttttgctgtagagcatagcatcaaacttcattccagagaagtatgagaacattatcgacgaaagaatctgtttgtcgtcatttaaagttggtgagtttcctaagggcctacataattgtcgtcacagtccattcccttttctagtactgttgcatacaaacattacaccgcttctccttcccctaacaaatcaaaagttcactcccaaacctatcttataatgcaaatgtgtcacatgcttaaatttgacatgatgacaacagaaaaacatatttttggatttttcatttctgccacgcttaacttcctacacacttcaggtgagaatgcttctcggcctattccacccaatcccacgaattattgaaaacgatgaggagaaaacattctagtgttacgacacaaacccactatcaccccgcttttcaattactacattgcaagcaaaacgatagttcttgccctaaaactacggatctctagcagggtgatttgcgcagcttaccatggaaggggagattggggtgggaagagaaggagaggtaggcgagggagacaagcgcgagggcgaaggccgggaggacgagtaggcggcagtgacgccgctgccgtcgggggtgacggcggggtccggccgccgccggagtggatattggtaggcggcgctccggcatgccaccggcgcgctctccggcgacgcgtagaggtggcggttttccccccttctggtggtgccctctcttctcttgctttgctctcttccggtaaaattcagatagccattggcctcgtcacgtgtagacgtgtagagtgtagtgcaaacctttacccaaaaaaaaaaagaagaaagaaacaaatattgtcatctggttaaggcctcctttgtgaaataaatttcgcgggaatttcgtagaattccaatttgtaagaaacttttctatttggcattttgaaacaaaggtttagagctttttaaatcatatagaattctctggtaatggctaaatacatgtaaattttagaggatagttagcaagtgctccaacttgtattttcctttttgagtttatatttcatcttattcatgcatttcttttgcattctatctgttgacattttttttttactccgacgtatcgaaatggtcattcctatgtgttttccatgtgttttaatcttttgtttttgttttgtatatgtattctatcaaaatcatgtgttttttttatttttaatgttttaccattcctgcctgcgtttcaaaagggcctcaaagtgttgtatagatcgttgcccttcgccaatggtcctgactcctaagggtgtgtttgagaagaaggggattgaggagattgagaagatacacaaaacgaggtgagccattagctcatgattaattgagtattaattattttaaattttaaaaatggattaatatgaatttttaaagcaacttttctatagaaaatttttacaaaaaacgcaccgtttagtagtttggaaagcgtgcgtgcggaaaacgaggtgctttctccctcaatgtcctccaaacgaacgctgcctaagtgttgcatgctgaacaattttggaaaagggatctacagggataaagcatgctgaagtatgtattcccttatgttcccaactcttctccctcatttttcgcgtgcacgtttttcaaactgctaaacggtacgtgttttgtaaaaaatttatatagtaaagttgctttaaaaaaatcatattaatttatttttcaagtttttttacagctaaatagctaatacctaattaatcatgtgataatctatcgctccgttttccatgtggaggggaggggttcccagcccttccaaaagaacacagccttagataccagtagtactaaaagttttggtattgactattgacaactgattactctttttttccctaatgtgtggatcaaattttgaacttgattgtgtcaacattgctacagttttcgcaactacttttcgtgatactacaagtggaattacaagtgtgtgagctgccttgcacgaaagatttcgtatataaaaacttgagttagggtgtgtttagttccacgccaaaattaaaagtttgactaaaattaaaagtttgaagaaaaaagttgaaagtttatgtgtaggaaagttttgatgtgatgtaaaagttggaaatatgaagaaaaaagttgaaaactaaacaagggcttagaagcagtactgtgaaaacaacgcggttcatctgggtagtttactaatctagcattctgattgtaagccagtgaataaactagtagtacaaaagaatactcaaggcaaaccagtgacacagataatactgcatctgtgcactacggcaaaggaacgatcgaatgcaccacaaaagttactggcttactgcatagctgcatacagtgtaaatatcatcttctcttgttaacattggcatgcatgtaagctcaatacatgcagccaatctccaggaaacagatccaagtggatcttagtgctttagtattctttgatatagtacactaatttactcactataccttggtacaaggagaacccctcccaaaaggtaacagaagaagaatatagagaacaagaaaaacatcactatacgaacaaggtgataatttcacaccaacagtgtagttagaagatcagggtaccacagagccgagagtagtggaccgagaatacactaatcagtcttggtctgctctgctatgttgagtttaactggccgtgactcaaaccctcctccttttctgtgctcgatagagtaaggcatgtaagttccaagtatcttgtcccaaatgacaaaaaatggttgtgaaaagttgtacttgtttccatagagctgatgatgaatgtcatgataagcgctgttgttgttgaacagcgcatggaggatgttaccaggaagccacagaccacaatgatcatccactgtcttgatggttgcgaacgagaaaaagaatatggatgtccgtggtgtcataccagagacgaggaatgagagagcaccaccaatggtgtccaaaataagaccctcaagaggatggttgtaaagagctccaaaggaataagggactacaagagtgtggtgcttggagtggatatgtttatataggaacttgttgatgtgcatgtatctgtgcatgaagtactgccatgtatccataacgaacattgcaatggcaaattgcagcaatatcacaagggcagaaggttgcttctgttcaatatcactttcatcaccaataacctgcagttcgatagaagttcaacagtttgagaaccatacaagtaaagctattaggtaaactccaaaagaaatgtcaagatacaatattggttcaagacacataagcattcgtacaactggacattcatgcatatcagtttattttccatggacaccattttgatatacttcaatcagcatagagcagctgccatctcataaatatatttttctacttagtcagaaagcaacaaagcacggattttcttgataagcaacgcagaagcaaaatcaacacaagtatcataactttgctccctactcattatattcaaatgacttcttcttttagttatgtgcagcttccttccatacgaagtgaatacaaaaaatgtattttaagtagcaccaaagctatcctaccaaacaacacacctacagaccaaaacttaatacatgatgcgattagctcctatcctccgcatgttagcacagatgctgaggtttaaagattgatttattgagtgctacacggtgatggtgggccaaaacaatctaatcgaaatgcgtgtgaagcaatttttacttcattgttctccaaaacaatctaatcaagacgcatgtacaacaatttgcctattttacttcaaaattcaccccaagtatttgcatctctgcttctgcacttctgaaggaaaataataataaaaaaaaagcgattctgcatgtttcgcatcagattaccacaaagctaaaaaatgaaacaattcatccaaccaataactcgggtgcccgcatgctggaagagataaccggcggcgaggaggattaccgcgaagagggtgagcgagacggcgacctggaaggcctgctggacgaggacgcccctgacgacggtgcccctggagacgacgttcttggcggcctcctcctccctggggtgcagccggtacacgtccagccgctccacgccgtccagcgcgaggtacagccccgagtagagccagtacacggcgatcggcacgaacgtgcccagcagctcgtccgacgccccaatccccatccccccgccaacccaccaatcctcgggcgcaaaacacgccccccacaacgaacgtcgagccgggaaggccgggagagagatgggcttaccacggcgcagcgcggatccccccggcggcggcggaggaggaggaggagatgttggaattggattcgtggaggtggctggtggccacggcggaggggaggtatggataatttaggcggccgtcgccgtcggtccgaacgaggagaggagacgagggaggagaaggtggggaggggagggggacgggcgttggttgcaaaggggagcgtgtggtccgggttcgtgcgacgaaccgggcacatgtgcctgtttctacttctcgtgcaaaaaatctaaggaaatttcgtacgagttgaaaagaacagctaaacataacttggctaatttttcttctctgatttggactgtgtgatctatggtttgattgcattttttaaaatagtttataataaatttactggtgccagtaagcgcatgaattactgtacattttttaaaatagtttataataaatttactggtgccagtaagcgcatgaattactgtacattttttaaaatagtttataataaatttactggtgccactaagcgcatgaattactgatgctaatcttgaagggacgtatacagagctcaatccacaccatctcgtattttccaagacctggcttggaacaccagtaaacacatgtcgattctaaagtttctctttgcctacgcaagacatgaaaagctagacaacgcttcaggaggcaaaatcaatcgaaacagaatgtttctaagcgaagtgagcgaatcctggattccttcgcataaccactttagcagaccaggttagagccaaacaactgaagaacgatctcaggatcatttagctaagacaagacgtaccacatataaaaaatgaaagggcaggacgataatgaattccctttcacgacacaaactaaatactaggcagacagctaaataccgcacattttattttgttcattaaatctgatgaaataaaacccatgatccagtataaaggaatctatgttacaattgggataaaaaggaatcgatactctgcagcaacaagtacgattaacttgtagcctgactttcaagagagcaggagtatagtaccaggatgccagtacctacaccatcaccaactgacaataaggttgtctggggccaatttcagtgcactgggccactggggtgatcatcgatatgctggtgcaccagcaaaggaatacagggaggagaccggcgcaccaggcacgttaggccttgtagaagaaacaggcatctgatggatgctttcactgtaggcaggtcctgggttctcataggcagctgtcacataggacggaccctgatggagatccattgcacgagtggcaagtctataagaacggtagagctcatccacatgatccgagcgtgcgacaatctcttctggcactctgtaatctcttgcgaggaaggcctccctgtcagtagcctcaactatagctctgggggcagaactgaaattcaaaaggttacaaattcattaaacttaaaacagatcaaaagacttacaaataagtaaataacttcaaagaaaactaactcaacgaacgctattagaagccaaaattagcagccaaaattagcacgacaaagttagctataacaggaaggcacaattttctagcacatcactaaaacaatcatcagcactctgacagataaagctatgctcccttatatgtcaatagtaagaccctactcattaggcaacaactttcctcagcctccttaagataatacaccacagtcaattcttccttccttttatagatattgtcttgtacagctaatgagctaattgctgaaaattctagaattaaacatggacaggttttgagacaatgaattccagcagtagaaaactgagatccataaacttgccatcctgtggtaccttggaattgaaacttgaaaaaaaaactacttagttgattgctaaacttgcaataatttgttttttcagttagctaaaagtattgatgtgccttcaaaacatgtggagagtgcaagtagaacaagggtagaaagttccgtgtgaattgcgaagtgaatctgagttgcagtattgaatctcctatctacacggttactattagttcaacgcctctatacttttttatcgagctggaaagtcccaaaattcaatgactgcatcaacaatctctctaaattatccaaattagttttacacctccattcactctcatgtcaacgaatttaggtaataaaaaagttgtttgactgacgcaattataatttgaatgtttggaaaaacctaaaatatttctcaattatgttgctaagcggaagctaaaaggagccaccacatttttcctgttggcatggaaattactatattaatcgaggaaaaagagaaatatctattttctcaaccatggttggtccaaattacaattgtgtagattaatcaatatagttgtatacaaaatacagtgtacattccaaataaattttaatctagtccatgtgtaattgtgcggaaattgagcttgtttttcaagttacaagacataactggcatcattatatagtttacagatctctagcatagaggccaacaaatcatgaagatggtgaggagcaaatttagatagtttgctaataaaccaactagaaagctagagtactaaaatagcaaatctgccatagtgtcatcttgtgtcaactaacacaaagcacaatcgcatagtgaacaaaatatattaagaaacttttagatttctactcacaattcaattaagaaatattaagaatcacccaaaactaggattggacccaagtataagttgcatgcactagcctacaaagcttaatttgatgaggaaaggtgagcaatccaatatactttcaacatacaccctcatatgtaggatccacgcatgcattgagtggagtagaagtaagttgcactttgtaacttactgtgcttacttggaataactttaagacgtgttggccctaatatcaaattaagttgcatatatagcctattcatccaaaaagctcaagctaacaagaaaggacgcggagtcaactcatcatatagattgttttcaataatgagtgagatttatttaaccaagtttgccaaaaaatcaattagcacttagcttagaaaattcaagagatgactaaggccctgcttgattcagcttaggattattataatctggattattaggagtaagctgaaacaaacaagtagattattatgctagattattataatatataagccagattactataatccaataatctcctctagagaagctttttccagattattgagtggctaaagacccactacccttagatgcctctaataatccagagaaacaaacaactcgtagcttattttatgttagcttattataatccagcttaaagtaatctgatttaataatctagattacaataatcttaagctgaaacaaacagggcctaaagcactcaccgttcatacacgatatcaacttgaggttgatggtaccgttcgtcaaaagtatgagcaacatgatgatagtatgtgggaggagcatgttgaagctctggtaaatgagtcacatgccgagatcgaaatggatcatgcagagagtcggttatagcatgtctttctttaagaaattgtggatgacgaatatcttcaacatatcgtggtcgtcttctttcttcatggtcatacggtaatcttctttcttcatggtcatatggcaatctcctttcttcaacatgtcgtaaatgatgcatttcctcgacatgtcgtggcagtctccttccttcaacatagtgtggtaggcgaccctcaaagacatccaatcgtcgatgcctttctttaacatattgaatagatgattgaggcaagctaataggcttgaatagttctaacaacctatgaacctacaagatagcaccatagcttatgacatcagcacacaacttgatgtttacaatttaattttcttttggcactcttttaaaactacatagaagaatctccacaactcacttgtttaaggctgagttcctgggtgaactttccctttgaattgtagttctccttaatggcatgcttgaaactactctccggaagaggaaggcaatctttgtcaaccttaaatttgacctatatcacgtacacaagttagttggactacaatagtgtcacccttaaacattatccgattttatctactccctccgtcccaaaatataagattttttttgactctgacacagtctccgagatgctactttgaccaacaatatctataaaagtaagatgttttaaataaaaaaaagttgcatattatgatagtttgtttaataataaatctagtaacatcatttttacatgtttgatcttttttttatttttttgctattaatagtaagttgaaaatgtttaacttatcactatactaaaaatgcttatattttgggacggagggagtagtgtctatcatcgatgaaaaatatattagtatgattgttaaagaaagactctatattacctaaaatatagtaattcccacaaatagttgaaaaagggagaatgacctaccactctggtaggccatattattatattgatgtagattgatataagaaatgaagaacttcatggtagaattacatagagaactctaatgtagattgtaaagcaaaaggtacataatatttagcaaccactttagaaaataataatatattcatggatgcgctctagtaaaacacaaaaaacaccactatattgaatcaggataacccgaagttcgtgtgcaacttaacttggttccccgattctcatatgtatcatccatacgtactccttacatggaatttcttgcaaagaatatcattacaaacatattaaaagagtttctttctaggactgtatggacatactaagatgtttattataaatcaaaaggcccaaatggttataatactacatatagtttatgctcctgaaggttggagaaaaattaccaaactaattgttggtaaaattaaggtttggaacttacaactaaggcaattaactagttagtttctatttaacccaaggagaaatttgatcaaattttgagaaaataaactcaattgagagattagtttggtaggaaatgaactcgattaagatagtcctttctagcattatgaagtagggaatgagttaactcaataaacaaacttcgtcgcttactcttcaactaacataattagaacttcaaacaatgcctataaggaataaaaata

SEQ ID NO: 17789 - DNA, 42522 bp, Oryza sativa
  unsure (1)..(42522): unsure at all n locations
aatagtacttactacatcttcctatattttctttaatttgatcagaccgtacaatttgtcgaaaataaaatgtatgtgtatatgaaattaaaagctagcacgccaaataataattttaagagagttttacatacgccattaaaactttgtaaatctttgcatatgccattatataatccaatttttttgtgccgtcgaaacaaaggagattggacctcctataccactagagaattagattgagaaggtgagcatgaaagagttaggggaaaaaacaaaatgccctacattccctacattcccatgtggtcctacatttagcacaaccaatctctcttcttcccaacctgagcctttgatgcatcagcatttacttacctaatgatgatgcaccaatttctcatctccgacaccagcacctgtccagattaactatttacaaatgcatataacaacctcaccactagggcaaggcatgcgcccattacgtgttcctagctagtttgagcgcaatcatcacgttcaactcgcatcagcatttacttacctaatgatgatgcaccaatttctcatctccgacaccaccgcctatacagattaactatttacaaatgcatataacaacctcaccactagggcgaggcgtgcgcccattacgtgttcctagctagtttgagcgcaatcatcaccttcaactcagcctaatagccatgttccattaaccactttatgggagaccaagatcactgaccgatcaccttgagccttaaagccagagcatcacaggcctctctaggcttaaccatgcactatcccctttagcctcctcatagcttgttagtcatcatcgaccttgtagagcattcctgttgccacctaactttgtttgtggacaatatgtcgattctttcctgtaagacctagctgtagatccccaccaaaaagaaaagaaaaactagtacaaataaccttgccattgcccattgcatgttccctaccaagtgaccctgcccatgtggtcatatggacatgaacaagggtagcaatggcaaaaacacgttgtcactaccgttgttaggaacattgtgggtcattgcagtttttatgtttcaagtgtgggatgatttccatgtagacaatgcctagttggtccagtagtgcttaagaattgaatagtcgaataagcatataacaaagataccaattttcagagttagttgttggctggatccaacaagtcaccagtgtcatggataagaacataagctattttgggtggaagcacaaaaatatagttttgaagatggcatgcaaaaaagaaaatgacacagccgctgccacatgcaaaattttctcaaattttagtgtcttacaaaaacataacaataggatgtggccacattctatattccaaactggtgttaaagcttaacttataggcataactgttgcactcccccataaaaatgagcaatcatgtttctcaagttgtcaacaagtattaagaataaatcaactcatgacaaaagttgactagtttatcctgagctgtttgtattttagtgccagttgcatgacacttgcttacaaaatgatagaccaatctgaacgaataacatatgggctaacgaattatgttaaaaaggttagaaaaacatgtgtacaaatggggatttaagttaatgatgaccgatgatcattgtccctttttatgaaaacatagaacttatttgaccatttaaatagccacaatgtcatgctagaaaaaataccttggcaatcatttaccgttccattagggttaaatttccaattattaacaccaatcagaacaacaaaacaagagtcaaacatcaataatcagttctgacctgaaattattattcgttattagacattgcacaccctaagcctgaggaaatgttctagttctgatttgttgttttaaattttaattatattgcctggataatcaagacagttgtattgctctaatagcagaccaggtcctcccaataccctaaagcataggaaaggaacacacagacaataagtctaaagagttacctgtgcagggaacctaaagcataggaaaggaacgcactgacaataagtctaaagagttacctgtgcagggaacctaaagcataggaaaggaacataaaacataggaaaggaacacacagactaaagagttacctgtgcagggaattttccatggaacgcgcctcgcacaagatctaaccctccctttgtcttggccttgtatatcccatagagcagcttcaggtcgaagtcatagaggaacagttttgcccctggctggatcttctccaccacatcgatcttccccttaggcaagccaaacacaccattctggaagcactccggctttgtcttagcactgcacatgaatataaacccagcttcacccttcctctccctcgctttatcgtccttcttttccttcccctttattctccccttcttatcctccttcatctggtccccctctttcatctttgtcttttcctttctgctcatcctctgtcctccattctccttggccaccgctgccgctgggctgacctcagccggcttcagagggggtgccgatgcagtctcagcagtggcggcggcttccgcagctgccaccttctgcatctctggatcggccttggccttcttcttaaacgccttaggcctcacccctctgggcgtggtcttgggtgacggaagaccagaggacgaagctgcggccttgcccttggcattcgggttggccgacgtcttcaccatggctgatcgaaacagccaaatcaaaaaaaaagtatatagaataccaatataccaccacagatgattctactcaaaccaaaccctgtacgggcataaatcgtttaattcgatccaattgaacaacggaaaaaacttgagggaaacccaaatccggacctggataaggggaggggtgcctgcgctttttattacctgaaaaagtaagagacgaccactcgtacgaccgcgcgtcgcgatgatattagcgttgggacttacgagagatgtccccaatctattatactcttattataaatcggattcagcggcgacggggacgactaataagatcggattcagcggcaacggggacgactaataagatcggattcagtggcaacagggacgaccccgagactgtgacagaccagtcaccgaagttttccacgtcgtcggtgcctgatttccgccgtcccgggccccgatgcggcggtcctagcagcgaggcgactacgctacacgagtggagcagttgcgcggcgcctaccagaggagaaggggagggacggagggagcacctggattcctggagttgtgcgcctccccgtccggactccggactcgcgaggggggagatcgagaggcgcccgcctgccgctcctccgagcgctcgaggagaccggttcaactgaccgacggagcggtggctacaaggaggcggatttcttctaggaataaattcatcaaaggtcccttaacttatcaacgaatccgattttcgtccttcaaccgcaaaaccagatacaacgggtcccttaactatcaaaaccggtgcatattaggtccctcggcggtttcgatggcggttttggctgacgtggcgcctgcgtggctaattttgactcggtcttgatctgacgtggtatgacgtggcgcttacgtggcaatttgacccgggaaaataataaaccccgtgggacccacatatcagtttcacataaaaaaattaataataatggtggaacccacgctgccccacatgtcagtctaactcacccctccttttctgcttcctctctctcctctcttcatctctctcttgcgctaggggatgcggccggcgacgacggcggcggaaatggataagagtgaccgctaggggcataggtgtgacatcgccgggggcgcttcgaggtggaagtagactcttacgacgtggccgtcggaggtgagcgaagtcatcatggactcacgggattggcggtgtcgtcggcagcggcggagcaggagttgtagttggagtcctcgtcgtcgacctcgagttcgtcaatgtgctcgagcatcacccaccattagtagtcgccggcagcggaaggtagcgccgccatctcctgttgggtttccatgggccacggcgagcggatcgatatgggttcctcgtcaatccggccggaacggtgttttcttgcccaaaacaatgatcattcattcattcatcaacctcgtcataacacaagcaaatgatgatgacgaagcaaaatatactccagtcaggtagtactagtcgctattgcttctacctttgtatgattaggcacataaacgcggagcggaggtcgtcggctctggtgccccagccaaggccgtggacgaagagcttcctgctcacgggatcggcctccgccgcgcgccgcacggtcgtcatcatcactggggtcgtctttgcagccggccgcctctcccctctcccgccggcgaggtggccccctcacccgcccacgtggacggccgcctccgaggatgcgcgcgtgtgtcggccggtcggcgggacacgttcatcccgccgccgagatgccgaggtcgacgtcgacgtcgtccgcagccacggccgcggcggcactgcctccgccgccgggctggttcccttctctccactagtttccctcccaccagccgccgcgccgcgccccttctcttagccggacaccgtcctctccccaccgcccgtgaaccgaagagaagagagagaggagaggggagagagatgaagacagagaagatggggaagaggagaatcagaatgacccagcgcaagagagagacgaagagggggaggaggagagagaggaagcagaagaggaggggttaattagactgacatgtggggtccgcgtgggtcccaccattattattattattgtgtgtgaaactgacatgtgggtcccacggggtttattatttttcggatcgaattgccacgtaagcgccacatcagtgccacgtcagatcaagaccgagtcaaaattagccacgtaggcgccacgtcagccaaaaccgccatcgaaaccgccgagggacctaatatgcaccggttttgatagttgagggaccaattgtatctggttttgtggttgaagggcgaaaatcggattcgttgacaatttaagagaccttagatgaacttattcctttcttctatacctgacacaggtgggctgcatggaccacttagcaagagtttttcgggcttccgacggtggtgaacgcgcaacgcccaggcccaacaggaatttttgcccatattattgctaaaatttttggaaaaattacaaattacccctcgcatccgatttttaaccctgaactctaataccgattatttttaaccctaaaatttacaaaccggatacatggtagactggcagtctagtcaatcaaaacataagaaatatatgggacccatttgttagccaaaacaaataaacatggtgggacccacttgtcagcctaattccccttcttcccccctcctcttcgccgcttcccctctctccccgtatctggcgcactgaggcgagcggcgggaggccgaggatgagcggcgcgccatgttgcggaggccgaggacgagccgcgcgccagcggtggagcccaaggatgaggtgcccgtcggtggaggccgaagatggcaagcggcggtagtacgtagcagcagcgacaccaaaatcttgtgttcctctaggcgcggctaacaaagcgtgagaaagatcgagaggggcagcagcaacgtgcacagatgccgacggcatcgaggcggaggcgaggacggcacgaccggcggcgggggcgacgcggtcgaaggcgaaggtgcggcggtggagacggccatggtaggggaaatacggtggcggggagacagggcgacgcggcggggcgcctgtagatgccagcggcttggaggcgaagctcctctgcggtggctggcgccgacgagcctagacgacgtcggcgaagctatggaacgtcgatctcgaggccgtttccctgaggcttgagctccgcccccgaccgctagctccaaagtcctcccgctctgactcttcctcctctctttctcgtttgccaaaggaggatgtgctgcttcatgctccgacacgcctggatttgacgcaatcggcacgtcgagccccgtcgcatagctcgtctccatcgccgcctctgcgctaccacgaatcgacgtagcctgctggtcttggatcccaacctcctcgcctccgcctccatgccattggcctctgcaagcgccccgccgcatcgcctcctcttcctgccaccgtatggcccacatcaccggagccatgcctgttgggattgagctgccaggaaggagaggaaatgaagatgcactaacaactgggccccactgtgttttttttcgtttttttttctgactaggctgccatgtatgccatatagaccaaaaaccactccgaattgagttaagggggggtgattcgttcggatttaagagtttagggtttgtaatatccgatattgcagtttaggggtgtaattcgaacgacctcaatagttcagagtatagctgtcaacgagccaaactcgagtgaactcgtctgcccaagctcgagctcaagccgagcctattgcaacttcgagcttttaggcaagctcagttcgagctcgagctcggctataagtagtataatatatattttaatgataatctcttgataagtataattattttctagctaatcacactaataaaagagtagaaaatgattaaaataaatatattgtgctaacacatgctaatttactgtataaatagatactaatatatatttatctattagtttattatattaataaggtaaacatgtaatataaattatatacagtcaagctcacctagactcggtagaagctcgagctcggctgggtaaagctcgcgagcttttgctcaggctcgggttcggcttgtttggagcttgagccgagctcaaatcgagcctaggacgagccaagctcgagctactcggcgagcctcgagcttttttgacagccctatttcagaggggtaattcgtaattttttcaaaaatatatggggcaattgcaaatttaccactactttgaatcgttattgcaaaactgccactagaaaattgcaaaaatgccactagaactgtcattcgagtggtatccttgcaatattcaaaaaaccggtggcaaatttgcaaatgccccaaaatatattgccaagtgggtgcacaacaagactgtgcagggtggtgaacggtgacgccgggtggaagtaatttgtgcagtcttgtaaaaatataacgccattattctatttttttagcacaaccattattctaatttgatttccgttattctctgcatatatggttgctaagtatgaatatgagcaatgttagaaagttttaggtaatacctacaaaatcaaaatgcccacggtaatgaacgggatatcatctactagtaccataatacatgagagatttcttcagttcagacagcctaaatgacaagggggacaaacacaatacagttagcggagcagagccattaactcgtctgcttttgcaagttgcaacaacagcggcaggcagaaacgactgaacctacatctgatcattaccattgaaatcgtagcaaagatcagagtccgaagttgcacaatgtcaggaactccatctcggtgtcgacgtacttggtccagagatgcttgtactggttgaaggcgacgtcgagccacggcttcatgttcccgttgaagtgtatcaccgcggctcccttgatgtcctccggcctgatgtgcgggttgtacccgagtcccatcacgtgccacgacttgtccagcggcctcgtgttgccgtagaacgtcatgagccccgccggcagaacggacgctggatcccacagcgtgccgttctcgttctgcatggcacgaacacgagcaacatcaagctcaaaaaaaccgaaagcgaattgcattttcagccgtatcgagagggatcgcggtgagctagcttaccatttccatgagctggtggaatcgctgggtgcattggtcccggcgccaagcctggagatcgaacacgttgaggccgtaggaccaggcgcacgcgcgcgggttgaaccgctcctgcacggcggggtcggagaagttgatgtgcttgccgtatcggcggaaccctccgaagcaggtctccagcgcggcgttcaccttgccgccgaggtcgacgcgccacagcccggccaggtccctctgcaccaccacgtcgtcctccaggagcaccacccgccgcagcgccgggaacatctccgggaggtagaaccggaggtagtcgagcagcggcacgtccctgttgccgtcctcgatctgcctgatgaccggggaggcggaggcgttcaggaacgggaagtccgagacggcgaggagctgcacgtgcgtgccgagcggcggcggccggcgcgcgaaccagacgcggaaggccgggaggtacatgggcgcggtgaccacgtggaagacgtggcgcgccggctcggcggctgcgcgcgccgcggaggccaccacgacggacacggcgagcacgttgtcggagaagatggcgtagtggtacagcgccgggtcggtgaactgagggggcgggacgggcgggtcgtcggggatggcggaggcgttggcgaggcgtgcctcgaggaggcgcatgacgaggcagtggagcgacttgggcgtggagccggcggcgatgcgggagttgaggaggcccgcgcggcgggcgcggaggagctgctggtcgacggcgaagacggtgtcggagagcttctggatcttggactgcgtgtcgaacgcctccttggcggcgcctgccagggagcgggcgcgcttgatttgcccgcgcgtctccttctccaagagcgcgacggtggacagggagatgcgggacgagagcgagctgagatgcccggagatagacaagaaagactccgtctgggaggcggaggccgcgctgagtttccgcgcctgggccgcgtaggcggcgagaacggcggcgtggtcctcggcgtggcggcgaatggcggccagccggaagggtgcggagttcggggcggaggcggtgcccgtcgccgacaggaggaaagcgagggacgcaagcaagaggagcgtgatcagcgccgcgagcgccgcccgccgctgcgcggaagctctgccgccgccgccgccgcctgccatgggagcgcgtgaagtcggaatcgctcgccgtcgagcaatcccgaggcgaaatgcggaggaaaagggcgcgcaacgctttctaacgccggcgaggtgggtttagttaggttctcgtgggcccttctgccagtgactcatagactgtacatttggggtttcaacggtttgacgtgagaggctggccgtgtcactgacatgtggggcttttctcccaacctccttgtgcgatcggatttgaagtgggttaatggtcagtgtgtccggtagtggcacactgagaggagcagtgagttggtgatgaccagtaaggcgccggatgacgacggccaaccatgttagtgcagaatgcagaataccgtcttctgttttgacaatgtgattgttgggttatcctagcccgatgtcagtgggtgttgcgagggtgcattgacttttttttttgtgtgtcgcaactaaggaaaaaaaggttaaaatattggttttggtttggtcgcactatcatggctagtggtggcatgtcgatgatttgcctaacaatattgttggagttgccgatatcttgacagtgtgaacgagcggactgtcaatctggatgcagataacctattcggatttaggcccaaccatcacgacaggcccagtattctaaccaaactgggcctagtttgagacaaaggtcaacccatttggtccactaataactggacaggaatagatttttatccgggccgattataggtcgaactgtcgaagcgacgaaacgtcagtcctgatgagtctctctctactctctctcctgccgcctcgccaaaacggaaacgagagggctgagggctccatggagatcgcggtttcgatgtcggcgaggcgccgtgaactcgcagccggcggtggcaggccagccgttgggcgtgaaggaacagtagcgggctaatatccggccacaagacggcgaccgccgccgggggagtgccgcttggtggcggtgcgcgccacccgttcggcggaatgcccagcgggacttcgccacggacgggcggctcgccgcacgccgcttcagtcgatcgcgagcacgatccacacctcgaggatttgtaagtgacccaatctgtacgggattccaactaattcagaattcaagtccgacgggggcggagtgcacggggacctcaccatcactgcagcgaggatccctcttgttgcgtctgctatcgattcttcgatttatgaggtgttatgtgcgcaaggtatgtgaaccaaaaaggcaacaactgtcaatgttcagaactaggaaaaacgaagaaatgaagacaatcagctgatcaggggagtatttgctaataccctacgcattttgcagtacatgcaactatggacaaaattggaaccgagctacgattacacatgagacggacgacaaccactcttgcactgcataaggaggtaattagttccatgatgcatcctacattgtggactagtagcatattgcttcctaattctgttagcttcactgttaacagaacgaaattcgaatacctcttcatgctaacagtaatactagcagacagaggtagatgctaatcttcactaccgcattctaaaaccaaacctacattactagaaacctaagtatagcacttggttgactggaaatttgttgagacttctgtcgtgcaagggagtgattcccatggcaaggtcattctccagtcatcagaaagtgttccttgcaggttgaagttgatggaccgtggaccgctgttgatattgttagcaacatcaggcatgtcgaccacacatctgttggtcatgctgctgctgctgttgcacttctgtggttggccaaactctatgtttgcagtcattctatccatgtttgggagtgtgaaggatgatgcattgaaaaccatggatgcaatgtcaatcccagctgtaatatcaagtgggattgctgagaggatacccatggtctgatgctctgcaaccggtgagggtagaggtacagatgcatctggcctgctgttgctgtcaatcatgctgagtgggttgtggcatgaaggaactgttgaaggcaagtagctacttccggtgaactggatggtggaggagatggcatcggtcattactgatgatgtgttatctgaggtatgctgacttctctgtgtggtctgcgagacaggggcagtgtaggcttcatttgtgctggacaagggaggagatacccatgagtgtgagagcgctctttgtgccgtggaattggttttcttgaaaatcctgcagattgcccaggaatcctgctcatgataagaaaaaagaagaataagattagggcagtgttttcaggtaaaaagtgcattcaacttatcttcacaaggaaatggtatatgaaattgttggtgtcatactgaattagctcggaaagcactacatatgctaggccttttgcagtttatattgcaagttttcccattgtaattatgggcagacatgtattgctcagatcatctaccttagtgccagttttggtagctatgcctaagctacttttgtagcatatgtgttaaggtttgaagttttttgttttcaaatgttgcagcatgccagttgcttacatttggtggaatgatcttctcgagtggcttcttctgtggcaatgaagggtcagtgagcgatggcagccggaactcgtgcatcatccagtcagtttgacgcctttagctgctctgcccttgtagaagacaagggacttcttcaagcctatgcactttgatccatcggaggagtagattggcctatcggttccagtggccttccagaaacctgctccagtcaccctgtttggccttgtgctgttccggtacttcctatcccttgggcagtagaaataccattccttctctccagtacttgctaactcttcacggtgaaaaaaggatttgttaagtaaatatgactagaaataagttaaatggtgtctattgtgtaacactgacttaaaacaaaacgtgagctagtcagctaggctaactggtctgactgataaaaggcatatgcatcacatgaaaaataatctatttactatccgcatgcctttttagtcttgagagcccaactgtgatacttgtaaatcaattataccacattaacactactgaaagccaaatctcagaatacatcatgacattaatagcttggtagacttgcaaatcttgctctaaatgttttatgaggcttaaccctaaaactgcatgggcttcgtgatgaatggacattatagtagtagcgcttaagaggcaggttgaaaactcttaggtagttacttttcttatttccttatcaaaacctcagagacaactaaataaagatgcatgcaaaaagtttagagttcgacttcaacatggtggcaaaaagaagaaaaaactattactactaagatacgaagtctcagcatgatggaacatgcaccatgaaagtcataaagtaaaaataggaaacatgatggaacatgcaccatgaaagtcataaagtaaaaataggaaacatataattagtgttatcttgaaagagaaaggcttcatagttctttatttatctgtgcagagaacggaaaaaagaatgaaaatggaagtaacaaatcttacttgggagatcccatggatcatacttgtagatgtccagctgcctgatgagctcaatgggaagagacttctgctggattttccttctaaggtagaatctgacgagctcttcatccgttggatgaaacctgaagccaggtagcatgacttcatcttgcttctctatgtcactactcctcatctcgtccatatcaacacagtacagaaactactggtggatggtaactagctagctcaaacggtgctcactctcacctacttctggttatcaagaccttacgagctaacaaaccctaatggctatacctaaaagattttggtttctgctggttactgaagatagaaaaggaacaattatacataagattacatataactgtagcttcctccagacctgaacaaagctagctcttagcagtacgtgctttcttatcaacaaaagagcgagctatattcttaatctgaactgaaacttgcaagaaaactatgagacagctatcacgtgctgttagaaagaagaagctcgaccttaagtttcagacttcagctaaccctcctcgcttggttgctccctttgtagggtttttatttggcttgtcgttcgcacctttgcctgcactcaggtacagttcttatagcagaattttaaaaccctcacctgttgttgaactcatgcagggtctctttggtctttactccatgacgaggatctcgatgagctgtacaacttcagcagtaattttgggattagcaatctctcttattacactaagttaactgaactgtacttatgcatcattgcttatatagcttagcatctaatctaatagagttctcacatatgcctcatttcttataattagacctttgagagaataatctgactccttagatatttggataattatttttttgtagttgtttccttgggttgtccatagtgaactatgtggaacaattcccaagacatcagagacttccaaattccaagtaagtacagtacagtattatattggaacactaagagcctaattctctctgacaacatctatattttacattggtatcaaaaaatacctatcatcctctaatgatccaaaaatccctttctccattcctttccttttctctcttacctatataattgaagtttactgggaattgttaaacactagcaactgtgtgtctaaaaacatcgcagagaacaatttacatgtttgcttatgttggtcatatttacactctgaggtacattattttaaaattcctccagaaagaaatagagacttttttttatcaacatctctgatttctgttatatggtattaatttaggtcattttctgaagatgtcctttatggtcatgtctggataagttatttatctttctttctcaaagaaaagttatttatctttcatttggaaagatgttaatgtctcttgctgttgtaagcttgcgaatggtcaaacctattataattccaacctaagtcattattttactatctgaatagtgatctattagtcgacgatgaggtgttacagccaagaggtttgtatgtgtaaaggggtgttgagaatttaagaatctgctcatctctagattattatttctctctccttaccgtgcaaagtgctgccaacctaggattgtaattcacactattaactacctttgtcatgtagggacaatgttttgtgcccatctgttcgtcgctattctgagggtccttattttgtcagcccacctggtgtgttcttaggcgcatccctttcttggctattaaccatttaacctgctcagtcagttctagcttcaaggaacggtaacttggcatcctttatgtgttttggttatactgttacacgtctgattttgctagcgtgctaggctgctacagttagttgaaaccagatcaatattttacacactaagttcttgtatggaaataccaagatacaagtatattcataacagtcatagtcatcaagttaccaccatagccacttgccatcacacttttaactaaacgaaaatttcaggcctgcccattcgtgcatatggtgttgcattgggcccatcaacagaacttctacagacattgatgcgaaaatcctgcatggatccaagtgcagccctctcattcgtcccttgcatcaggaaattaaattaggaaaattatgcaacccaaaatcccatgggcccaagttttccttccctgtcgtccaagcacccaacagtgtaagaagcttagaattaaatgagggaagaggtcacttgtagggggtttatagaggggtaattagggtcaaacctctgagttcaaatgctaaaagtcggtccgtggaaacctatgcagttttctattcagatctgaagtgttcataccagttctatttctacgagtattccttcctgcattagtatgatcttgttacaaataactagcggtaaaaatcttgcaaatagatgtgtttttgtgctaatactccctccgtactcgtaaagaaagtcgttttggatagcgacacgatctccaaaacacaactttgacttctcgtttctataaaaatatgtatacttttatgaaagtatttttcaagacaaatctatttatataatttttacattttcaaacttaacaacttaagagttatttatgatttctattcccaaagtttgacttaaacattgttttaaacgattttctttacaagtatggagggagtaccttttaaattattgtgtgctaagcaggtgacatgcactcttgttttacagactttttacggtggagtgttaacatatgtagatacattactaatgcttattgcttcagttgtctgccctttgtagcatggtgtcctggaatggtcgttcgagctggtgactgacctggtgagccaggcgtatctgcctctctcctcgacaggtatggctagttccttgtctcttgcttgcttgacctcgatcttgctgtgcccaatgccaacccactcgtgcggcctccgtttgatgttactactagcaagtgtagtacagtagctagcccctactcgggtgagctgagtcaaacccttccggttcaagttatcctccttctcatgccccttgcaatgcgtggccatgtaataagtttgttagtatccaggatcccatgtttccagggtgcagactccaaatttaattcccttgtacttttgcgcggctaatcgatgtgcttaggccgtgtttgtgcgtgtttacacacgcgcttaaccgcgtggtacgccgagcgtggcacatcggcttttgcccccgtgcacgtgtggtatgggaaagcactctgccctcgaaaggtatagggacagtttcaaaacagctacagcgtagggcgccaataaatagtagtagcagtatgagtgaagaataagcatttatatccaattgttatcgagcaagaaatgctgagattggcgctgcagagctggatgcaggtggcatttcttggagccctgacacccttggtgaaagtctatgttataaatggataggtaaaaatgtgcttgtaatctgtagaccaagttgactttgttggatgatgacaccaaattaacctctggtcgtttaagccttcttcagcttggaatatttaaactggtgaagctccagttttgtcgcttgttttcttctagtcttttgactatattccaagacttaaaccagagttagtacatctgtacatgtctaacataagtcatgctacacgctcccattcccaaactgataaaaccaaagaagacaatgagtgtttcttactccacacttgttctctagaaccacgcgacggaaacacggagtggaaatcaacttgcatcgactaggaacgaggtaaatcacgtccaggagaaaggaaaaaaaaaacagtgatcacgaaacagacacgacgatcaatccgagtagcagcttcccagtttcaccgtttttatcatgtattcatgcatgatggtgcaatggtggaggctagggctgggacttcatggattacttgcaaactaagcgagtgttcctgaaaggtcctgattcacatttctacttgacatgtctatgcagttggttcaggaattctaggtgctgtacttttttgcaaaatttcatgcagtcaaacttccatattactcgactgttcttggtcacaccaccaccacaccagagcccaggtcttgaagagtgttaacatctgaagcccattaaactcattactgtagcaatattgcacagcttaagctcttactaagcaacaaggagaaacatttctcctactgaactgcaaaacagagtctgtaatgctgttccagtgtattgcattgttaattaggagcgcttaatatttttttttgagagaagtacttaatgaaaacagctcaaaaatttcaggcttaatgggctgtcaccacccatctgggccgcaaagagaatcaagtcttcaccgcatatcgttctgattgttgcattcaccgcttcacgggagttcaatcaagtctttcgtgaataataatctaaggtacgtaactggccatcgatatccatcatccatgttttcttgaggggaaaaagttgcctgctttcttttacgtatatctgctaacttttgaaacccataaggatcgatgatgcaagtcactagtgcattgtatccagcacaaaaagtcgctgtgatcatccaaatctaatcgttttatcacatgacaaatttgtcgcaacaggtgataagaacctagttactttagctcgcactactatcacatttcgtgacattgatgttgaattgccatccctcatgaccatccccgctgtcagttactaggattaaacttaaaaaggccaccaggagaacaataattaccaccaaaagaatcctagttcgatatagttcgtcatgtgtcaagcagctgatggagctttttaagggagtcgtggaaatggtgggggttacctgttatagatggatgcgatgcgtaacacaaaagcacctttaggtccgagtcttaggaatcaggcatctgtcgattttactggtgcactataatgcgcgcaggtgattttgccaaatttctttcagttaaaaaatacatcgccacacgtccatccggtaagcagtcccttcaaagttcaaacattcaaggttcgagtcctctttactttccacctcgccaaaactccagtgaaaaaggagatcaaagaaaccgtgtggcgtacatatggttagtgtgccactgtgtcccctgctttgcagagaagatttttagtattatatacaatcccaggatgatagacccagatcgcccacaccaaaggaacgtgaggccgatcgatctccccacccgctgcctgcagcaaaagggccccaaattatttagtgtgattgttctttttattaaaagaagcttatttagtgtgattgtatcacgctcaaaagcgatgcatgatacatttcagtttaatataaacaagcgacgagatgtgcacgagcgcgtagtgcgccagaagctagccagccagccaaatatcccagtcccacgtagccgacgtcgcgtctcgcctccaaagatccgtcaaaagctgccgacggggcgagtatcggatcggtcgagaaaaagatcccgcggatcaaaaggcgcggggcgaccgatcgaacgaccaacacccacccaaccgtgcgcgagtgcgcccgccgcgcggctcgtgtagtcgtgtgtgctcacctcgtccggcaaatcaaccgcgctacgcgacgtacgcgacgcgattgttacgcggatttcgccgtgggtgcggcgtgacgcgcgcgctgccgatcgatcgattgcagcgcgcgccgagccgtacaatagattctctccctcacgcagtcacgcgcgcggttgatcgagcaggcagccgtccgtgaccgtgagatgcatggggtggggtcgggttgggggtacgtcgagatgagcgcgacggcgagcactagcgggcgaggtggtgtgcgtctttcggcgtagtggcggggtgggccggggtgtcagtagtggtcggcgacggtgaggtggcgccgggtggcgggtcgatcgctcgctcgccctgatatatggaaggtaaagatcggcatcaccgagacgccgtccgccgaccggttgaaagcacaccgagactgtgtagcactatgcatgcatgtgaaatgtgataagctaaaggcggtgaggcaaggatgcgtgcttggttttgcaggtgctcactgattgggcgcgcctgaccctgcatgaccgttcagtagagagttgtgcggcgtgcatctgtcgctgattcgacatgtcacgatggccatgcatgcagagaagattcaggagacgctacctagctaccgcttgtcattgtaccgaagacttatttcagtttcagtgcgacttgtgaagttgtgatgcatcggtgatcagtcgtatctatcagtgtgtgaatatgtggctgcatgcatgctcatttgtcatctagtgtgatcgatcaatatcattcagtctcgtggttgtaggcaggtcgatcagttctagaatgtggaggaactgatccgcgtgagtgcgcgtgcttgtccctgatcaggtttgcttttctcgcaaatccagcacccgatcgacgtgatacagttcgattctgcgtgcgtgcgtgcctgtctgcttgcactaaacgcagtatgctgggacgatgtacgcggtgcacgttactgaaagttttattgataagtccgtgtattataacgggttacacccatatataattggggaatggtggagaaagtagattgagacctatatatgattggtgattggctggttaggtggattgaggataaaacacatgacattgtcgtggtagagaaaaaaagtgatagtattaactaacaggttacaaccatacaatgcactttcaaataaatatgtaacacatattactcgcaaatttcaaccaaaacaccaatgaaacatacccacttttgcttcttttttatccctggtttcttctagctatatatatgaagaacaaggaagtggctatataaaattctcttctcttgcaaagcctacatctctagggctcattctagattcttattgcacgacaccagaatatgcttctttctgtccagcagcnnnnnnnnnnnnnnnnnnnnnnnngaccgacggacatatgttcaagccgaccgtgcatggccggcgggtcccggcgccggacgcacgcaaagtcgagcaattaacggccacagcttcatcttacactgatggccgggaggccatccacgacgacatgcggcagcaacagcagacctgacgatcaagcagccattgggcgactgttttgatatgctccggggaccactgcacccatggcgatgcatcggtcgaataacagcgactcctccgggtgattttcagctcccaatgcaagctcgatcgtcctgcgctgtgaggccatgcatgatagcgaaaatggctgtggagcaataggcggcatgctaggctttactggcatgattgtagtactgtattctcatctatcccaagttggttccgcgcgaagaatgtcgtcgccgcccttaattgtgtggaagtgtggtcatcgttgtctcttattccatatatgttcatgggtggcactagctagtagtgataacagtagccagtgttgaacgatcactgtatggtacattggtacagatagcttggtctgtcagctaggtgttttaattggtgcttggcggtggtggagaggaaaaaaaaatcttatgagaccaggtcctatttagactctcaggatatgtttgttcgaaaaaaatatgtagtataaatcacatatgtaatccagtgatcgatctacctccaatatgtttattcgtgaaataaagttttctatttctttctttggtgggaacagaactccatttcactgttggagaaagggtttttaattccggtttataactccatttaatttacccctttatactgaatattgtacatcctaaactctttgaattagagttatttgtttgttagaagagttgaagaaaaaaaaagactggtgtagcatctgaggaggttaattgaacgtaggcagacggtgcaaggaagattaatgtttttcttaattgttcggctggtagtagtattttatacgttggcacgctgttagaaaatggttcagggaacacatcacaaaatcttcttgcgtgagtgagaaacagccttacatagttacatcatcgaattgatggacttcttttgttgattgttgcactggttgcgtcatcatgattgtatattgttgtcttacgaaatgacgtggagcccaccatatgaatttgtgagcctgatcacttgttagagtgaggtaatgattatttagattgcactgcaaatatcatccgcggctcgccgattccaaaatccagaccggggattttctttcgttctatcttttctagagaaagttagtgatccaccgtttccgccgagtcatacaagcagattattattatggattatctatttaatatgagtatatatattaaatatcttgatagttaacaaataacttaaaacaactagtttaaataattagaaattttacgatccttgagagatatcaaaaagtaccagaggcactaaaattttttagtgcagatttttgtatcttctaggatcgaaagtaccgagagatattaaaatttatattagaaaatacggtatctctcgatagcttcgcaagtactataaaatcactcctaaacaataccatagaagttgctttataaaatgtattttttttggaatgtgaagtaaatagtctatttcaatgtacaacctgttaaataattaaaaaaaactaagccttaattaattggcatgtggatgaaaatgactatacgagtacagaatcattagatagctagatatactaaatttaggcacgggaactaaattgcacatatccaagcaaaaggagaaaatgatgaaaaggtagaggagcaaagcacatagtatatgcttgtgctatctattacggatgtagtagtatataagaataagcacgcactttaatccgtttagattagataagaacaatggacagcaccaattattctctttttgctggttttgatcgagcaatctaaaaaaactcgaaagctacagctgaggaccaccttgaagtgataaaaaatgattcattcagtgtctcatacatttcgttagataatatagtttcatgcaaatgttaaaattcaaacctatcaacacgcgcacaatccctatctgcttctatgttatattagttacttaagggaccaccatacactgttatgattttctttaagcttttcacaattatttgcattatatttcactactccacaacatcaaataggatgttgaagagaatatgggagggtaaaatctttataaatttctaaccttataatttgctttacgattcatgctccagtgaacgatgaacctaactccacaactttggtgatcagcaatggcctcatgagtcagggtttagggtatgggttagtgttggggtgagaggaggagataggggggggattgtcgggtttagaggggaggccatgggagatggtggacggtggacacaggcggatgacaacatcggagccaagggaatagaggagggcagtgagccagcattgacctttttttttatatataattagcagcagggagcttccagagacaaggaagacggttggggtaggggcactgtaacgacccgcctctcccaggccggcggatgacaacatcggagccaagggaatagaggagggcagtgagccagcattgaccttttttttatatataattagcagcaggttgcttctagagacgaggaagatggttggggtaggggcactgtaacgacccgcctctcccaggccgggcccacttacatttggcagctttcataggtcatagactgtcctcacataccaacacatgtcttttctgcacattttgtcctcactcgtgtgcacccgggaagaatttcccggttccaggccaagcacgcttaaccctggagttatttggagattggcttccggaaaagaagttgcaacttgttgatatgaatattctattaatcctattaaaccctaggccgggatgttacaggcacttaccgccgccagcttaggaaagagggggcatgggaagggaggaggccagccgactaaggagatgaggggtggcgcgggggggggggggggttgacaccttctggtctgccgagatggcaattaggaggcgagggagcatctgcacgcaatattacggtggtaggagaggctggggaggggatgttgcacaacttcaaaatgattcaacggtttagaattcacaatatttttaggctgtgttcgggaggtgaggttcacctcccgcgtacgcaaaacgtagcgacacattttcttataaataattaagtatttactaattttaaaaaaatatattaaaataatttttaaagtaactttcgtatataaaatttttgtaaaaaacacaccatttagtagtttgaaaaacgagcgcgtggaaaacgagatatgtgagttgtgaaagttgaaaaaagaactcagccttatatatgtattctgtcaaatgccatgtagatagttgaagaaaatggggtgccgaccaatttaccgggaagtacactctgtgtcgataaaaaaaaaaaatctgcaccgactgccgacaattttgagaagtacgccataaaagtgaagttgataaatctaggcagctaggctctaaatgattactccaagcaagcagttcattaattagagcatgaaaaaaaagcagtaaatgtgtcattttaagcttcgccgtatagctttttcttgacgtggagaagaggagaagagaaaactaaggtgccatatcccatgaaaacacactgttttagtgctgtttgtacggttttctcaacaagtgttcatgcccgcgacaggggccgatatcatgacaatactctttccagtgccccacggtattgttcaggtcaaccaagctctatcgatcattagcgacatcatcagttaatcattgacggaatgataacgcacatgcaagacatgcaacccccacaacaatatataaagtcgcagatgttttatataggggagagaacgtgacatccttttaattactttgggggtgaattgaagtggaacaagcaactgctggagagatagtacacctggcacacacgcacaatttgacggcagagactgatgcacaagcggcacacgcacacgcccaaaattagcaggctccagccccggaattaacagagcgagcaatctacgtaccccacacgaaccaccaagcaaccaaagctagcgccactcccccgtgcacgcgcgcgcgttttatgtaactctctccggcgtgtacgaagcagcagtgacacgacacaaaacacacacaaagacgtagctagtgatgacgagaccgagatcgactggtaattttccgagtaagaggacacgatcgacgacatctcgtcgtcctatcacacttggatgttctccatctcgtcgacgtcgtcggcggcgatggactgctggctccgcaagcggcgcagcttgaaggaggagagcttctgggaggagccttccttgggggtgtcctcgaagcggatgaaggtgtaggtccatgctcccgagagcgtgcccatgactgggcccaggaagtagatccacaggccgtcgaacttgttgctcgccagcgccggccccagcgtccttgccgggttcatcgatccacctgaaattgccctgcaaccaccactcgtttttcgctgcgtctcagtctccattgtatattctgctcaactagtttagtttctacgttctgcctgatcaatatgtatgtttccctacatttattaatttggttactgatcgatcaaagataatgttgattagccaggttagtttgacttttcccccccccccctctcacttgtcaggagtcaagtggctacaaattaactaattggtcttgctactagctccaagttaattacttcctaattagctagtactaatcttcttggtcatgaacatgaatgaacgaattgaatagctgattgattaacgggccgtcgatttctagcgtatttaccctgcgaagatggacgtaatgcaaaccgcggaaccaaccgccaacccggccaactcacccacctgcatatggaaaaaaacaccggtcaagagtccatgtattttacggcaaaattcagtcatcatcgatcgacgacaaggaggtgaaagccgtggacgacgcgtaccgctctcgtgtccgtggcgacggcgagcgtgacgaacatcatgttgaacgtcacgatgacctcgacgacgagcgagtgccagtgcggccccacgggcgtggtggttccgatcacatccaccgggtggatcaccgccttgagcacgaacgacgcgcatatcgctccggtgaactgcgccgcccagtagaacggaacctgtgtaagggagaaaaaaaataggttgaaaagatgtttcatttcaacgctttaaccctgcacctctagctggagatcgatctagagcagtcgcagtagtatctaactgcacattgcgagatgtctctgttgaagccgggaacatcgaatcggttccggtcagcctcaccggtgtgtgtgctagtgaatatatagatagatatatagcactatagcagatagcggcaactagcttagccccggattcggtgccgatcgatcggacgacggcgccacaggcgatcgatttccggcggatccctatcgatcgaccgaatatatggcacatgaaccaccacgcacgccaccgcctttacatgaattcttgcgtcgcgaccggttctcctgtactgtatcgctacggacacttgtccctgctagctttacgtgcagtggcaacaaaaaagcctcgaccacgatcatactcttgtcttctactagcagcagcagcagaagtgccctgtggattgcgatgtaaaaatagactatatggaatgtgatccgtggcaactaactcagcgtatcccagcttagtggcttcatctttaatttggctgtgctggggttttgacgcgtgattgctcgtgttcaattagcacgagcctgaattgtttgtggcggtttcatgctagatttcagatgtctgattttttgattgatgtgagcttaattaatctggtgatcgatcgatcacatgctactgcccaacgtgttgtctggctgtactattgtttgtgtgttgctgatatggagtggttgcttgctttcaggctccagctagctagacaaatgtgtagtgaaaaggacctatggattaaggtcgatatatgttgttgacagaagagacgacattaattccttatacaatgcggatgtgtgcatcattatggtatatataagtttaatgaccttgaaagatatgtgattggttggttcggataacaagttacatgagcatataccacctctcgttgccttttgactttctttctggccggcgacataagctagactgaataatttggcatatatgcctaaaatagagatttaatttggcagaatcaaatccatggcaacatcttgacaagaacgcgtgaataaactaagtacttaagtgaggactaaattagccaatgattttgctctcttgagatttaaaaagtttttcagataatgaagagggttgcgtcaaaaattaaaaaaatggagaggatcaaagctgacgaaactctgaaaattgtagctatcggaggtaaatttaacaagattcagataccatcatatgtaaaaagacaaccggaacaagctaaggtcgtttcagaaaaaattcttatgtgactactaatattcaatcagcactcaattggttaggtgtctctgctaacatcttttggcaaagaacagattgaaagaaactaagaaagcatctagctagtatgccgaagtagtgcatggcttaagtcgtacacatagctaactattatattgcatatatattttgatgcaagaagtaatatatatgaagaattggcagtttgaggtagctgtgttgctgcatctgcatacctgaatccaggggaaatgcctgaacacggcgaacgcgagcgtcacggcggggttcatgtgggcgccggagatgtggccgacggcgtagatcatcaccgtcacgatgaggccaccggcgatcgactgtcccagctgcgatatgcgagacaggtcgctgccgctgatccctgccgccccacacgtcatgaacaccagcaggaacgtggccaccacctccgacacgacctgcagccatggcgatccaagcagcgtgcacgcattagctcccccccagctcaatcgatctcgaatcaatcaagcaaccagagaaagacagataaagctctgaaagtctgaagaattaatcattcagctccagactcctcaccttcttgaggaggtgaggagggaagaagtcggcgatggccttctcgccgtagtacatggtaggcatggtgccgttctgcaccgtggagagatcgtggatctcgttggagtagttcgccctggagtttgttctcgagttgttgctggccatttctgacgctctatctagctgagctacttgtgcagcacgcgagtgcaggaggtagaagaagaacaagcagctcaagctctaacactggctggctagctcgctcgctccgtcgatcgcttgctcgttgtggtaatgagcaggagtatttatagggagatcgagctagctaaggttgagaagcctgagcaactgggaggtggcaggtactagtagttacagtcctcactgccttttgattaggcaggcctacttgtcggagcaccactgggtacagtgcttgcatgcatagctcattagccctaattaatcagcataagatcattgtttctggtctaatttttcgacggggattcagattttgtttaatccgttcaaacacgttgtcggatcagcattggccgagaaacagaaacgcatacttgattttgtattctcgtcgagggcataaaaccgcgcgtcatccccccgtgaacgacaacgagagcaacgttgcctctgtctgctgttagactgaaataattgtgggttttcaattcacaaggtgttgtaaactatatgcctggataaagcgcgacgtcgaggtcatgacgccgatatatgggtgacgaacaaattctttttcttttgtagattgggggctcccctgaaagaaatgatactatagggatggatatttttggtcattctacgtacgttttccatgccgaatgttaatacgttttttttgcgaaattcgtcacctgttgtaagttgacatttttcataatctatactcgtagaagagacgaaccatgtgtgccaatgccaactaggataaaccgtaccgaaatttactattggccgaatttgccattgtccctgtcagaggttgccgccattgccagattaatgatggatccgtggcaactgaacaaattttcaattgtaggattgccatctctggtgaccaaattgaaatatccgagcagttaaggatttgcaaaggtgacattacaataaggggttatcctaaccactctattacgcagtgtgcatgcttcggttagcaatgctaagcaatgtcagagcagaggacgttgcacttggatggtcactgtcaaaactgacctgctactattgaaaaatctcatgtcagttggagtacttcagcaatttgcaatcctagcttctctcattgagcttagctcacattcagtttttctttttttgccgtactgtacctgtaggatactccctccagttcgaaatgtttgacaccgttgactttttagcacatgtttaactgttcgtcttattcaaaaacttttgtgagatatgtaaaattatatgtctacataaaaatatatttaataatgaatcaaatgataggaaaataattaataattacttaaattttttgaataagacgaatgatcaaacatgtgataaaaagtcaacggcgtcaaacatttcaaaacggagggagtactatcttgtactaccactatcagtaactgtcttcagagttcagatactacagttcaggaaaacaaaactccaattcaggcagctgaattttcatcaccttgtattaaaaagagcaatgccagaaatcgacatatcatctgaagagcaatgccacctactcctaattaaactcaatgaaaaatcaacaggattcggaactcaaagtctgaagctgatttttacaggtcaatcatgttctgtgaagtaggcccgtatggtcaatgctctgatggccgtagacagcacaagtgtatggcagttatgacgcctcttcttcccttggtaggcatccccggtgggggagcagagtgtggacggcgatgccctgacaaaatcttgccacaatgattttcgattggaaaatcagcacacatcacaaagaatgaaagaacccatattttgatcggtacagctcgttgcagatcagccactcgacttggtgaaaatctcaggccttacagagtttgctaggtatttcgttcacgaggtgtttcaatcaggtttctttcgcaaaaatgcagataatttattgatttgagatgccttctgtaatgagcactcatcaatactttgtagatgtatacatgtagaatcaagaactactttacgagcaaagcaaattaaatgaaaataaatggatattggtactgaaaaataccactaaatacacacatgtgcaaacagagagcgctttctggggcacgtttagaaccagcaccttattttgcacgatctacaggatgaaaagacagcttgtgctgcctgagatgagactagcgcattggcatgaggccaggccacaagagggaaaatccacgcttctctgcaaccccttagcttttcatgagaggcatggaaccaagatagctgacgagtgagcgatcagatcagtgaatcaatcacagatgcaccatccatccagaagctggcataattaccttcgctgattattgatcttcttttgtctgcgctcctcaggccactagtgtagttcttgttaatcacttttgtgtgtatgaatctaactacatttcctggcataatgctaggccctaccctgtgatcaagcagtagcaaaagcaccccatgttgaggtcaggtgtaccatccgatatctgctaagttgatatggtgccctgaaccattctctgaagaagcatcgtttagattcagaataaccatggttttactttgcacaagtctagctaatactgtaggtaggttccctgatgcatctgcaatggcgcgcgcctgacctcagaacttgaatcagttattcctatatggcaatcaatcatgtctgtcttcccatcgaatcacctccgttttcacggccttaacaaaagatctgaggaccatatatgttctcgattgttgtcgaaggttctagatcgattcaccactgtcaaaccaagcaattacgtatggaactatgaaacatatcggattttgacgaataatgattacacatatttttaattcttttctcctatattattatgtttcgaaatcagagcagataatgtatggattcatatgtagatattgattgttctggaatcagacagaaaaagacggactcatagtatgtcttctaatttatcagccgtgaccaaaatttaaattttaaaacataattgtagtgttgaacttaagtttcttacttggaatttattttcaatattgacttataaaccgctaagaatacggatataaaaattttacctgtaaattactttttattgggaaagaacatgtaacctagcagttacagtgataagtagcacatctaggttttgagttcgacaccccaagagagtgaattttaagcctaattaaaaaaaatcacttgttggccctgtaagatcgaacaacgagaactaagattaccaaacagagagaggggagggggaggggggttgaatggtagcaacaccaaacacttttagcggaattaaaagttacaccagtgttagatctttggtctgactgtacaagcctcattggtctgaccgcgcaatcaagccaccgcctcttgttgacacctccggtccaaccgccatagatccgattgtatgaccgagtagttgccgttggtctgaccgtcggtattcttccggtgtgactgttgtactccgagcaaatcacaaatcgaaaaccctcaaaagtagattaaagtttatttgcatatattcgtgtttacaaagtgcaataacaacacttctcttatagaattggactaaactcgaaaccctaacttttctttaaacttaacttacacataatcgatcacaagaggcctcaatcccctctctatttatacccgagataagcagcctaaaaccatgaatctaacttgtgcaatatatcctaatccactaggaaacatttctcgtacctaaaataaacttatctctttccaattcaaattccaatcttcctaaatttaaatcgactccttattccatatgtacacaatctcccatcgtatgcctcatggaatctccatcaaccacgtgcattgttttttagcctaagcatctcgcatgatatcccaatcgcccggatgtcatcttctcccaagttgattcctgaccatcatcggcaacgctctcccgatgcatcaaagcacacctacacaggaatcaaacgaagaaacatatctgagcataagttctttctcaactttactcaacattattacacatgtatagaattcatatataagtcataatcacgaataaacaaataaaaaacccgaaaccaacatcgacataaagttggccggtcatgctgtcgttttggccagtttgacagtgcacaccacgccagtatgaccagcttatcctgcccggtctaactggctccacacaaagagcaaaactacttcactaataatcttcaaatatcgaaatcaattatctcatatgccaattgttcatcataaaataacaatcaaaacacactttgatttcacatgcccctcataaaaatgtgttaagaatcaacctatggagcgtgggcctcgtataggaagcatgggcctcaaagaatgagttaaggaacgatccatatgaatgagtttgcgtgtgtgtgtggggggggtgagggtttgtggcttttctcggttggtttgatggagccttcttcttaatgaaaaccatcggacacttattttctcactggtcaagtttttttaattatttttcgttgtttcgtttatttttctacagtttattagctatggagtaaactatgaggttgagagctaggttactcggttaaattagacagaccaccggaaagccatcaaatttcaaaaagtgttattaatgaatgagggtacaaacggtagaaatgacatgagccattacaatttttacggtggtctatactgatgatagaaaatacaccactaatgtagcaaaccatacagctgttacttatctacagatcgaacattcattaattttggcatcaaaccaaactttcagctctaaccaaacttacactaagctttgatggtactaaaattttggcaaaatatcagacctaaccagccttttaccaaaactttggcatggtccaaatattgacattgttaaaatctattatatactaaaagtccattaaactttctacaaacgctctcaagttatcacgtggcgctctaataaattagagaaaatcctagaaattctaaaaaaaaagcaaaacatctacctcttgattttcacttaaattgatgggtccaatattatacaccattagataaaattgatcttaaaacaaaccaaataatatgggtcccacctctcctatttctcccgcgtgcataagtataggtcacgtacgtacatgtgggcctgtagtacgtacgcctccctccatttttttcttttttttcttcttttttccatttatacaatttgatatatatttgtttaaataatcatattttttttaaaaaaagaaaaaacatcatataactctttataaacacaggtaattaactaaattagctatacagactttgaaaataaaatttacaccatattatatgtaaattagctctaaaatcaatagtgtaagataatttactttgtactattattttcatataatgcactattttaaaataaagcttacacaatattatattgtgtacctatcaaataaacaatttaagatctaaattaactaatatatatatatatgtgtacttaaacagatagacccattatttaaatcatcggatctatttttttattactttggactattattctcaaataatgcattgttttaaaataaaatctacaccattaccattatgttgtgtacccattaaattgacaatttaatatatatatatatatatatatatatatatatatatatatatatatatatatatatatataaactaatttacatttgcactaaaaccggtggacccattatttaaatcatcggatctattgttaataatgtctaaagttctctttttggcccactgcacaatgcacgtctgcacctctacctttcgcacatgtgacaaagtgtcgtatttgaggcatcttgggtgatcacgaccgctgcagcgctaccacttttgttaatagcatgaaaaaaatattaaaggtgtgatgcagcgagagaagaattaagtaccgtggaacacttaactctgtttaagatgaaatcgagagtttattaaataataattataatatattgtgttatgttgtatttggattttgtattatttgttcgtacagttgaaagaaatcattatgttataattgtgaacacaatattaacgaatatcaatagaactcttactaggataagagtgttataagggagtttaaggccctattttttccctgattccatcttttgaattttcatttgcacgctccatgctttccaagttactaaatggtgcttttattaaacaactttttaactttttagaagtcaattcattcgtttataatctcaaatagctatcacataaataagataattcatcaatttcagttatcctaacctctaaagtacatattttttttcatgcgagtcatggtgataagtaaattggtgatcaacgcataatcaaaatcgtatgatgaatctgtaagaactactatgaccaattgtaaataggtgtcaaaattaattgctattaattaaacatctaatggcttgctagcgacatatttaatttttctctacatatatataaacatggacgaagctagaacgaatattaacatacatcccatacatatatattacatgttaatattctaattacatgtggtaagtccattaaaatttcttaaaatgccctcaagatgacacgtggtgctctaataaattagagaaaatattagaaattctaagaaaaaaaaaagcaaagtatctattacttgattttcacttgaatcgatgggtccaatagtttataaactattagattaaattgatattagaataaactaaatactacgaggtcccacctctccacctttggtacgcacctactcccctccctttttttattttttcatttcttcttttctccatgaatatgcttccctccctttcttactatatcatgcaccttcatgagacgatttaatctatttactcaagaaaaaaatatatttcaaaagttgtaagtacttaatccatctcccactcaaagtttgtaaatggatttttaagatatcttaacaaaaaatcgaacccttaaattattataaaataacaatatccgaactttagtttgcccttaattatgagatattttttttaacaaacaataaaaatcttacctttcaataatataagtgcccgcgcgtatgcgcgggccaccttcctagttttgataaaggttgcatcagtaataaaccaaacaagcgctttggtggttctacatgatcaaaagcagtactaccaaacagggcctttaacctcaaaatcactgtaactttaactgctctatccagtaatgatagtagaagcatggatgtatcactacatgattcattcatttgagcaaagccgacatgagaagaccagcaatccagcatttgatcgtggtcgtctgatggttgaaaaggcatttgtatcgacttatgctagcccctatcaaggttggttatccgtcagcgtgatcgttgattttgcacggaaaacaacaggaaaacataaggtctactggaacactacgagagtctacgatacggacgaactgaagggcccttgcgtttgacgccgggtttaggtcgccttggctccgttgatgtcaccgtttgggcgtccgtgtaggaggggccagccaagtactgcactgattagttcttgatcactctgctggccagtaatctctcttcatcttaggtcggcttggctactagtagttgaggagtaaggccctgccttttgtagctggcacacgcttgaaactgttgacaatttttgctccatcgaacatcaggttcagactttcagtcatcgttttcgatccccttgcttgttgcagcaatttcattcagagaaagcatgtgtgtcaatggacactcttcagctgcaagaatcaataatgtacttccttagagtaagtttaataacggagccaactataagcttatagtttatattaaagttaacatatatagtaagtgagctacaaggttatctctttttttttctcctcctctctctatctctcacctatgcatttaatgtatttatcttgaagtatgtgaattgctagctcttgtattagagccaatcctctctaattttcaaattctctttcatccacataagcttatagttggcttatagcctactagtatacttgctcttagtattagggtattcccaacccaatgactaggatggtgtccatagcattaaataagttaccacttaggataaaaaatgatgtggcaagtgaataaatgaggaaagagaaggaaaccatatcttgcatgggacatggttttctacacaacatccaagacatcatgtgagataaatagcattaaattggagtatggaatagtggtgtttgcattggaagagtagtatctaggactagtttcttgatgatgtggagtttatggaaactatgtctagtgttatgggttgggactgcccttactgcttctaaatgagacttgtgactgctggtctcctttgatttacttccttacttgcatgagatttttttcatgtgttattgacgtactacctccgtcccaaaataagtacagccgtgaatatccgtgcccaacgtttgaccgtccgtattatttaaaaaatttgtgaaaaatttaaaaatatttagtcacacataaagtgctattcatgttttatcatctaatagcaataaaaatactaatcataaaaaaatttcaaataagatgaatggtcaaacgttgaacgtgaatagtgcaaaactatacttattttgggacggagggagtactgaagtactggaacaaatatctgatgatgttccaatctttctttagttattgcaccggtaaaagattgcaataagaaactggagttagtacgcactttaggctaccctgaagaattttttgcatggtggttagtttattgaaggtgtggtgtcatccttgcgtgtagagattatcacattgtctaatcaagaagagccaggagctaagctaatctagctcggccgcgaacacgacagcaagttatcttgaaggaatcagtcagttgactaagcaggctctcgctctctccagtccagaaaagcttcggcatttagaatcccctgtttgcaacaggcgacaaggcaactttcatatggcaccaaacatgtcggtaacagctgatgaaaccgtctaatttatctgctaatctcgctgttttttcccttgtcaggatggctcacaagtggaccaagttgtagaatgttgcaaaacccgttgtttatcatggccacattcggctagcgatgcagagcgattgacagagaaatcccatgcgacttaagaaaagcgaaaccggggccctcgtttgccagccagggtggctaacgactggagtgtgtgcaactagccgctgacagacaacgcgacgcttgttatcattcgcaatgccgacctgatggatgtgagctcgacgtgactcagctacaggaggaggagtttggagtcatttgcgtttttagtccaactcggtgaagggtcatcccggatcatctgcactgtagtgtgcagggttcatgacttcctgtgttgcagccctgaacctaaggatcgttctgtagtcgtaggtccatggtatcatgattaatcatggttgaatgattcttttgctcctccgcgttgtggaggtcgatttctactgtatcgtagtccagattcttgtgcaatgttgaccatgttcattggcctggcttgagctccaaagagccctattatttctcttatacatatgcttatccttacagcttattaacaaatagaaaataatttacaaataaaactttcatataagtctcactaacgactcaaaaataaatgttgtaaaataaactgcgataaaaaaaataagttcaatatttagttttaaaatttaacttttgacttataattataagtataaaaaaatgaggccgtaattgaaagtcttttctgaagaaaatgggaataaagatgaggatttgatacagtaaaaggctgtttggggcgaattgggctatcggctcagtaggattgcttagttgatctaacctccatatgggctgacgctgatcatgggctttacatgggcgagttgccatggcccatgggctgtcttgcgcggaagaggcgtgcgtggcagttgatggcggtgtcgccgtgagagaacggagaagcggagaaaccgacccgtctccgcctcatccaccgctccgccacgatgctcgcgaccgccgccccgcgcctccgcgccgccgcgtggggcagcctctcgccgccggcgccagtgcgggcgcagttcgtgagtctcccgctcagtctccccggccgctacgcctcgctgcgcctgcgcgcctcggcggcggcggcggcgaaggaaggggcggaggagatggggttcgaggagatggcggccgggacgcggaggcgctactacatgctcggcgggaagggcggggtcgggaagacgagctgcgcggcgtcgctggccgtgcgcttcgccaacaacgggcaccccaccctcgtcgtctccaccgaccccgcgcactccctcagcgactccttcgcgcaggtcgcctcccccgtcgagcacctgctgtctcggttcgaggtttcttgtgtgcgtactgcgtagctaacatcacttcctgcctactcattttaggatttgagcggcggggcgctcgtgccggtcgaggggcctgaggcgccattgtttgcgcttgaggtgagcggtattagtatatgaaaatcttagggcatccatttgctttgagaagctttgggctatgcaacataatcatttagattgtaatgaagtgttagcatatgaacatcgtagagaacatccattttgctttgagaaactttgagctatgcaatataatcatttagcttctacagtaataagctgaaaacctctacctgtgaaattctaggatttgtttggaatcagaatgatttaatttagatcaaccttctgattgacttactctagatcaatatagatagtgcttgagtgtggcatattcgagttttaatgcagataaatcctgagaaagcccgagaagagtttcgtgcagcaagtcagaagaatggagggactggggtaaaggacttcatggatggcatgggactgggagtgcttgctgagcaggtgcaaggctgcatatctgtttactgtcgctctctgtatttcatcacctcccattatgtctgaatgttgtggtccttgtgttcgtgaatttgcctgaattgctttgtttaactttggtattaccatcttattccatatagctgggggagttaaaactgggggagttattggacacaccaccaccaggattggatgaagcaatagcgatttcaaaggtgagaaaaagcaggtcatgggctttacctggttcatcttgttgttcttcttctagcatgtgactcctacttgcatccaggttatgcaattccttgaagcacaagagtatagcatgtttagacgcattgtttttgacactgctccaacggtaactatcctatatatgtgaatccacaattgactccatacgcacattcacattattacctatgatttgtctccctcatcaacagggccatacactccgtttattatccttgccagatttcctggatgcatctattgggaagatcttgaaggtattatttgcttgattgcttctgcaccttttgctatcatgctacgatgtaaggcctgcagtacatacataattgatgaagaaaatgtgtattatcttgtgtaactattatcctgcctatcgtcacacaaaacaaagtcattttagaatgtgtgtagtcaacacaagttaactttgaccataaatatcacttaaaatataggttttggggctatgaaaaatgatatatttaagtttgccataacaagagatttcataatactacacttatgtaaccttcttttaaaaaaaatgctaaagaactaggtagtcaaagttgtataatggtgaccagagagagtagccactacaatcttgttatttttgtggctaaatggtagcgggaagcttattgcatttctgctattattcatttgtgttcgtttgcgcagcttcagattgtgctttttttttgttaacttgtgaaattggaaggctgcctatcttgttgaatatttatctgctcaaatacattgtttacatctttttcatcagagttttttagacacttgttagaagaaaccgcttatccttgttctgcttcatatgatgaaatatcatgtctctggaatttaataaggaattaatgcaaagttattcttcaagtcctgttaccaagagctaggcattccatctaagttgtggtttgtcatactgatttatcatctttttttttccagcttaggagcaagatcgcttctgcaacatcagctattaaatcagtttttggacaagaagttcaacagcaggatgcagtaagtatttgcctaaaattcctctgaacttggtgtttcttcaccatgtctttaaacctttgaatttgttattctcccccttaaggcaaacaaattggagcagctgagagaaaggatggtccaagtgcgagaactttttcgtgacacagaatcaactgaatttataattgtgactattccaacagtaaagattctgtgtatccattcccccaccaccttctgtatgtatttatcagtgtaatagccatctttatatttccttttggcatttttcaggtgatggcaataagtgaatcagcaagactacattcttccctaagaaatgaaagtgttcccgttaagagactcattgttaaccaaattctaccaccttcgtcatcagactgtaaattctgtgctataaaaagaaaggtagagttcataatctgccgaaatgattctctagtaattgtctgctgcttgtagaaactgtgttgcagggccatttaccatcttctttcatccaggatcaaacacgtgctttggatatgataaggaatgatccagagctaatggggctgaacttaatccaagcacctcttgtcgacatggaaataagaggcgttcctgctctgaagtttttgggcgatatagtatggaagtaacttcacaatggaaaatacgataaacttcatcacacctacttattgaagtgctttgcaatgcaaactttggtagctgcaagtatcagcatggatagagctagaatgcaagtgtgcaacttagcagatgcccaatctcatgtgagtaagtagcatctcgctgaaggtttgccggaatagcatatactagggggattgtgttctaaaaaaaaagggggggggattggatcaagctgcactaatatcaagtccattgaggcaacatgccggtgatatttctgcttctttatccctttaataggagcgattctgagggttttgagtccataactttgcactaaaattaattttgttcgtgcatcatgtaaagtcggttagagaatgaagaatggagaaaatcagacaacacttttaagtaaattttcttacagattagtgtgacttaaatgtaaatagacaatattgacaagacagctgcagcagttgagattttaatttaagtagctgaaaattctaggaaaaactatcctacggggtaagtttttcaaacagaggtaggggtagtatacacaatggacgttgcagtactgataaaccagtgactggggtagtaatcttcctttctgtctttcgtagtactacaagacggttgaagatcttttccatcctatcgagatgtactactccacttctgttctgtgcaggttgaatatatgtggcccaatcacatcttgccactaaaaatcttacatttatccatatactccacgaacagtagattttactcatccctgattagacccaaaacaatcatgagcacggtagacaacacaagcttagggcgtcttgcacgattaggtattgttcggtttagaggggattgaagaggattagaggggactgaggggtaataatttcacaccataataggtattgaataaatcccctctaatcccttcctcatgagaattaaccgaacaagcccttaccccgctacacccaaaaatgtttccgctggggtgcaatactgctatcgatggcttcttacgtaggaatttcatttttctaatattttttcattaaaaattgtacaaatatgacaaatctcttttataaaacaaaggtttctatagaaattatgcgagcacatatgttcacatatacacatatttcatatttatgactaattatttttttcaacgacaccgacaaatccgtcaataggctttatttttctttcacaaagcccgtaaacttccataggagcctactacatcagtggcttcgtgccgcactaacgaggcatctatagtgattgactttatcatgtaaaatatgacagccaaatattttgatgggaggtgttcatggttatatgtacgtttatactccgtatgagtgagtagcactccctccgttctgagatatttactagtactacgaatctggaaatactctttattcagattc

SEQ ID NO: 17790 - DNA, 9571 bp, Oryza sativa
agggtagatgaaaagttcatgcttcaaaaatggcatgtcttggaaactgggattttcctaataatgagaaatcctatgtgcagagaggagacaaaagcactgctcaacacactgcaggctgcaaagatttgctagtactactactccagtacacaaacacatcattggccacttccctaatctcatttaacgtttgcataacgcactcattctgcggttactgcattagctactcatgaatgtggctatttactagtagtacaattctaagtgccattcccaggaggagtgagcagcttctccacccttaatcaggggcggagctaattggttttggcgatcaatctgcctcgtcgagtcgtcgttccgccctccacacttcccagttcgcgactgcgccaacgattgcgcgagcaccgctgccgcaactcaactcccgtgaccgacggcggcaatcggtggccggcgaggcagcgatcaggatcagggtaagtatatttcatctcctcctcctgtcctttggccctcccttctctgatccctcccgtcttcattaagctctaatcctaggtactaaattactaatttgattagtaagcggttaggccactagaacttgcgcccttgccgacggccaacacgacgctcgcaggccacaagacaaaagctgaatgaagcaccggcatcgcatgaactgatcgcattgtgttggtaaattctatacttctatgtcgacatattacatttatagtgttaaagaaaatttatgttcagttggaccatcctagcctaaaatcgtagctacgccactgcccttaagcccttgccaatggagaagtggaggttctatgggggccatcagtttcagagttacagctttcacgaagaggagaacctctttcaggattggaggtaagcagtcaaaatctcatgcaaggtttgtgtttttactaatactctctgaagatgctatcctttgcaaaactttgctcattttaccttgttttcttcaagatgaacttctttttgcactctgcattagaaagagaacttcactgatgcctgtaatttatgttgtactcttcattgacactgtccatttttgccatcttggagtcttgattacctgctgctgggagaggatgagccctttttcactcaccacttcagcactagtgttcatagcaacttcgtgcaaggtaatacaggtctctgtaccgaggaagaatgaagcatcatgtactcaagcaagtatgcagtagaaagttttgaaagttcatgtattttctatctatcaatgcagacgagctttacaccctcttcgacggagatatcctgagcatttggggcgacatgaaagaagacgcctatcacaggagcgacaaagatggcggcgagaaggaagagaagctggatcatgagaaggccatggagctgcagctgcaacgactcccgagcggccgtcaatcaggggaaaagacactgacgttcgagctcgtgtcccagtacttctgcctgccgatcaagcaggcggcgcaggagctcaacgtcgggctcacgcttctgaagaggagatgcagggtgctcggcatcccacgatggccgcaccgcaaggtcaagagcttggagacgatcatcaagaatgtccaggtagtatttttcctatctcattttttttctctcgattagatggaagaggtatacacaccagggtttgaaatttcggttcgaaattaatttcggaaatttcggcccccaccggtatgctcaaatctcgtccgaaattttcgtttttttgcaattttttgtgaatttgtcaaattttattcaaattcagttaaattttcaaataattccggccagaaatttccgaaattttggtcacccccggcataaaatccaatttcgaaattgaaaaccctgatacacacacgcccctgtagtcctctatcctggtgatctttgatgggcgaagtcatttaccaacaattccattaccttaccataagagttttcccgtaattttccatctatgtaaatagtatagtgtctaagtttatatctgagcaaatctgaatttcatgtcctgcaggagctagggatggagactggccaagacgaagataatactaggaacgcagtggagatgttgcagcaaacaaagaagctcatcgagcaaagtcctgatgctaagctggatgattggacgaagatgttaaggcaagcgtgtttcaaggagaactacaagaggaggaggctcctggcgattgaaggatgaagagggatatgtagcaaggtgactctgcttgtagatggtaacatcaggatagtgcaggtaatcaggttattttggctgatcaaatgtgtaggcagtaatttctagtcaggcttttaggtatgacccaaggcagaaaagtaggaatttttgctgtatatacctcttttctagccaagtcttcactgatagtaacagtactagtttggtatgttggtcatgggaagtatcatgtatatatctgttttcagacacgatctggcgtgtgaacaactagtgcttttagttctgaaaataaagatggcgtcttttgctgcacatttgttctgtggagaaattcagaattgcatgaagaacagctaaagtaaaccatttcatgtcattcaccattcgtcaggaaacatgaaccatgcagaaacatggagcttatatagtagtacattgagttcacaccgaagattggtgtgcttcagtaatccaaccaaactgcccccaagtctgaacatcaccttgtgttgtacaagaaaatcggacagggtcgatcggtacacagcctctctctcttatccatctctacttacgcttgttcaaatctgtttgatcagccgcgaatctgtactatacatgcacactgatccaccgcaaattgcagtttctaatgcctcaagaaaatgaagcaaagtgttcgatcgcggtcgtggtcatggcagctcaggctcacaaggtgaccttctccatctcgcggcggagggcggtggcgcggacgaggctgccgatggtgttgacggcgagcttgatgtcgtcgagcgggttgcccggcacgacgcgcttgtagaggtagctgtcgaaggtcatcctctggacgtagtcgtcggcgcacatctcgacgaacgcctcgcgggcggcgttggagcggtagaacaccttctggagcacgtcgagcaccttgtacgtcggccagtagaggcggtcgaactcggccaggtacctgcgcaggtcgctctcctccaccatccgcgtcccgttcgccgacccggccacgatcgcctccgcgcacatccgcccgctcttcgccgcgaagtagatcccctcgccggagcactttgtcacgtaccccgccgcgtcccccaccagcgtcaccctccccgccaccctgtcgaacaggtgtcaaccccgaccgatcgaccagccattgatttgatgcagaaatgcttgtggattctggcattgttgattacctcttaggcctcgggtgctcggggatggggtgagcctcgacgcggatgatcttgccgccctcgatccggtccttggcgcgaaggcgggtggcggcctggaacttcttgatgtcgggcttgtgggtgacggtgccggtgccgacggcgacgtggtcgcacttggggaacacccagccgtagaagtccggcgagacgtcgtcgccgacgtacatctcggcgcgctcctcgtagtacttcatcttgtcgtcggggatcttgacgcgctcctggaacgcgatggcgtactcgtagtcgccggcgcccatgtccttggcgacgcgggagttggcgccgtccgcgcccacgatcgcgtccacctcgaacgtccgcttctcgccgccggccttgccgttggagctgtcgtagtggttgtagtgcaccacgtacgacccgttgggttccttgggcgcctcatacctttcaaacaacagagacgacatgatccaaaaacatgtttattttccccaataaacttgtaatagtgttaatgcacagggcagcataaatcaagtaaaaatgttgcaatcacaccgaatgggcctagtttagaacatggaggtatttctttatacatgtggtgctgaattatgtttcaatgaaatttttgctggactttacggaaatcaatagttagaatcttgcaacatatccaaacatcaagccattatcattttttttcattatttcaacatgcacgtacaaattagtattgcttttttacaggtattagaaaattggggtttccacgcagatagactgttcctaagataaatttgcaacaaatattcatgctattttacggttgctagaattcagggtggttctacaaacatgcacaaatcttctgaacagtactagaaattttgggttttgcacacatgcacacagatcagctcttggtgaggcagtagtaataaacaaacatgtacattttcgtgcaggtactatataattttgttcatcatcgtgcaaaattagtgttcagtgcgcacaaaggttcagagcaatcagaaatccaacacgatggcagaagtttttactcacaaaattcacaatgcatgtgactgagttagcaatatacctcaggaagagaccattgacgacctcggcgccggccccctcggcgcgggagcggaggtaggcgtcgagcacctcgcggcggaccatgccgatgtactcgtgcggcgcgagcgtgccgccgatgtcgacggcgacgttggacggcgaaatcatcttcatcttcctcaccttcctgtcgacgaggtccagcggcaggtcgaactccgacaccatgcacagcgggatggccccgccgcagggcttgcagttgtccagcttccgttcgatgagcaccgtctccacgccgcccttggccagcgcctccgccgccgcgccgcccgcgggtccgcctccgaccaccgccacccgcagccgccgcccgctcgggagcttcgggctcgacgccgccgcgcgcgtcaccagcctcgccatcctcctgccgcggctcatgcccccacgaaccgacgacggcatgacgaaggtggcgcgcgccgcggcggcggaggacgacagcgaggtcatcgtttctgtggcttctcctcctcggattcggaaaagatctctctcgtttgagctcgacctggcggtggaggagtgagcgcgagagtgagacgcgagcagagggtgggagtagtgaagtgttaggtttggggggcgagtagtggataggatgaggggagattgcgggggacacgagccgttggatcgagcgattggacggcgcggattggatacggatgaggtttttgtccgctttctccttcgccgtttgatccgcgcgagtggctgacgctttgccaggtcggaattgaatcttttggatcgttgtgtactgtatgtgatggacgatactttgccacgtcacgtcgtactgtttgttgatcaacgtttttgtaccgtgacgcttgtgtagttgtaatagtacacagtgctacgcgtgctgacaagcttgaagaagtgcttgcttgattatctactgtatcaagtgtggcgggtgccacagtgatcgttgtattattgtatccatcatgattaaaatcttgatgcccacagacttgtcgttggtctctgtttttttttatcgtgtgctggggtgtctatttgcggaattgcgtgtatgtgagcatggtgtgcatgtatgcgtatttcgtgtaatcagaaaacatatttggtaacgatgagttttggcaataaaaagaattgggtggcaaatgattgtgttgggtatttttttaaccaatattttacggcaatgctagatatcgcatatcattcttagcttccagaatgagatcctcttcctccctcatgcgggtatggcaaagaaacgatgcagaggcagccagatttcacgggggctgttgcagtgcttcaatgaagagtgatttcttcgaacacgggattggtgtcacgccccgaactattaccgaccggaactagcccgtgacgctccaaattaacctgttaatcgataccagtcccagaaaacagtgctggtatcacaggaagacagaatatcacagcaacagaggtctctttattatagagtaggagtacaatcaagtcgggctgcggacagatcccgagctcacaaccgcattacaaaagggaagcggaagccaggacttggaccaaacaacacaggcgcgacttgggaactaggccgaaaccctaaaactcatcgtagccggcttgctcctggaagaactcctcgtcagcgggatccgcttcatcttcttcagcaactgggggggattatttatgtagagcaagggtgagtacgggagtactcagcaagccatgggaaataagtgtttaatgcaggcttcaaggaaaggctgttgtttttgtaattgattttatttgaactcttttctgaaagcaactaagtgagtgcttctcaaacgacatggatgagacagtgcgtctcgtccggttgaagtatgtgcaatgtatcagtctttagaattgaatcaaggttggcacccggccaacagcttttcaaacggccacccgggccaacaactttcaaacggccacccgggcctagctgatcccatcagctgcagatttttcaaacatcgaacccctttccacaacagcaatttcacaaggcagtagtcaaacaacactacgcaaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgtaagccgacacaggtttaccatatgccgacgagaggggtcccagaccaacaacaggttaggtcccagaccatactatgccaggaagcccaggggtcctccccgacaccaccccggcgaatccacatgtctctcggcatcaaggctcccttgataagctagttactcagccaggggtgtcccattccacccatgtggtcgtacttgtcttatgttcggatgaaattccaaggaaacggtccttaggtgcaagagcgggaaaccgtacacccggtacgttccccgattcgcggttttggaaattcatttagttcgcaagcaccgactcaggtgtcgggttttccaagccttttgtaaaacccaagttttacccaagaagtttttcagattttaagtttgaaggcgaccgtcgatactcgcacagggtgcacgaatatcgaggcacaactagatggttacaaggggacatgatataacaattaacaaaggaaggatcaaatgcaacaaattaggtaggtccgccaatctgccttgcagacgggacaaacagattaagtgcgatcctatcaatgcgtaatatttttcaagtaacataattaaattcaaatataggctcaagatgctcaaaggtggcttgccttgctcgagatctggagcttgatcctcgaaatcctcgcactgcgagtcttcgggctccgaaactacacgcgaaacgggacaactcaacaaacggcgaaaataaagccctattaaagacctctaagcgtgccattagatagatctcgagatttgaggaattttggaagttgaacggagtcaaacggatttacggttgggaagatattgaatttctaagattattggatttttgggtctaaagtaaaaggatttaattaaatcctttttgaaaaagaaaagaaaagaaaagaaaagagggagggaaattagacttccctcgggcggctagggcgcggcccgagagaaaaggggcggctcggccgagctaaatgggccggccggcccaaggcggcccaaggcacgcgcgcgcgggaggggaggagagagagagccggtggaccgggcccacctcgcgtggtcccgagtgggacccgcttgtcagcggctcggctcaccgtgcggagggagcacgcggcgcggcgctaggatgggggagagacgcggtgcacgcgcgcggttcgcggaggacgcggatgcggcgggcccatgcgcagcctcacggctcgcggtggaacgcacgcacgggaggggctgaccggggtcggcccgacccgatctcggccgagctggcgccgacgtggcgcctacgtggttgccacgcgggctggcgggaggtagacgacgacgccggccggaacggatggcggacgacagcgacgagcggcggagcgaaccacggcgatacaggcgaaagcgagcgcaccgggtggttgctcaggacgaggggagacgagccaatggctcggattcgccggaggatgcccgacggcggcgaattgcggcggcggcaaccggcggcgggagaagggggaaacggcgacgaggtcacgaggggtcgattcccggcggcgagagcatctacgcggctacgggaatccgatgctagcgttggattgggcggagctgcgccgagcgaggccggcgacgagcggcgcttccgagctcgggcggcgacggcggcgagcacatggcgagcggcggcaacggtcggggcggcgccggctagctacggggaggctactcgtgctactacccgagtctaaggggaggaaatggagcgaggagggagaacggggagatgcactaccgtgcgggcgggcgcagtgacgagaggccgacagcgcgggagtaatctctccggcctcgggccggggaagaggaaggagagggcgcgctcggagtccccttccgcgtccttgctcgtgccggctcctccgacacgcgcaacgacgaacggcaacagcgaacagagcacgggaggcggcggcaatggcgtggaggcaaatgggagaggaaaggaaagggggaagcttgggtttataggatggcaatgtcggtttgggaaccgacttagggcggtcaaaggagagggctagcgctcggcggtcgcggccaaagcggcgacagggaggagggaggaggatgacgccggcgggaggaaaaaggggaaaagagggagagaaaaggggcttgtccccttgcctcttcgggaaaaggaggagggagcgggggcgacgcggcagagggaggaggagctctgcctccgtcccttggcagcttgcgcgcggagtggcgggggccgggcgatgacgacggcgatgacggcggggcggtttggagcggagcggcgacacgggcgacaggcgcaggcaggtgctgacgacggcggcgaccaggcggtcggccaccacggcacgcgcgcgcggttgcaacgggaggcgcggcggggcagcggggccgggcggcgcggacggctcaggcgcggcagggcagcggccacacgggcgtgcgcacgcgagggaggagggctcgactcggcgcggctcacgcgcacgcgcgcgcggcgcgcgggcagagcggataagagggagagagagagatagagagagagacccggggagggagggggagatggg

SEQ ID NO: 17791 - DNA, 30237 bp, Oryza sativa
  unsure (1)..(30237): unsure at all n locations
cgacggaacgggcgctacaattggtgacggtgcggggtgggccgatcgagctgatggccacgtggtgcagagtagggaggaggtctcagtatacaagagccggagaaggaagaagaaagggagaaagaaggaggaagagaaagagatagacgggaatggataaggaaaggattgagcgagatagaggggaatggataagggaaggattgagctcccgaagtttggttttagccattgcatattagggaggcaccgggcttcgttttgtcatatagtgtcctcccttaaactcgtcattcctccggtgtttgaatttgatatcatatgtcaagcttcttcttcctcctcgagctccttcttcttttctccctagctagcaagacctcgccagtcttcagttggaagtctcatcatgtgggagtgagaaaaagggaagaggaagaggacaacactacattcatttgtctgtgttgctttctctccttcctcctagtaccaacaggccgatatctaatggcaccaacgagtatcaatgagtatcgaccagtggaaccgatagggtatcaactggtacagacggttaccaattgatactaatgagatgctgatggtacctatagggtatgagatctagtaccaaaacgagcatcaattggtacccatgggtatctagatctaatacctatttgatatcatatcgtccggacggaatcccgtggtatagcggtccaaattgtgatatgggtgcattgacattagcaatttttattacaaaatgaatgtggttggttgtcgctctataaaaccaacttttttttagaaatgcacgaaaatattcatttgctactttgatagggtaacaaactaaaagattttatagattatgcttgaaacaaatattatccgttgctcattaatcttgggtcttagtaactcttgaaactctcgaaccttcgtctattaagtgattgctatgggcgtatgcggtatgaacactcagaacattaaagattttactttctttcaaaggcatctactggagaccccaagcttcaagagctatatcatcaaaggttttggtttttctactcctcggtttttggagatacgcttcttaagggtaagtggatacctacaccctacgcaagcatactcatgtttgcttccacatagtaggaatatatgataccgatccgaccttcaacaaatatgaaaaccactatctcactgatgcgcatacatatgtgccatgactaacccaaggatcaaatccaagggtttatatgaggcgcaataggtaatagcatgggattgaacctagccacatggccataccttagttctataatctataatgtttagagctttcttcgatgattgacaatatgcaaatgagtggcaattgaaagaaggcaagagcaaatggtgaaaagtgctatgtgccacatgatagaaaagttaggtcgtaaatttttcatgtgttaagtgccctatgttgactcgatctcttggaagaagtgaagattatatgtcatgcatatgtggccaaccccatgtggattcatgcatgtgtttgtgtgtgttttgtgcatgtgtggtggagatgagctcggcaaatttgaggccatggagaaattacaaatattgatctcaacataagggtgtttttcagctggtgaaaggccatgaatgttagtctctttaaaagcatgggacaattttttttttagagaatggtattttttatctggtctctatacccaaccgaatatatgaagccttttaaattgagaacttagcccctcaaacaactcaatctaaaatttgctcatatggagatttgaactcaggacttggtgtactacttatgtcactgtaaccactaggctacatgcccattcgcaaagcatgagacaataagaacgttataacctaatatagtaagtaagccgatttgtgccacctagtaaggatagagcccatagaaatgtatactccacatagcatgttcctttgattgtgctagtgttaattgttgaatgacttgggcctctctgattgtcttaagttagcaaaacttattatgatatttttctagaacatggccgcctcatactagcaaattagttattttcttggatttcttgtatgaacatgcattcctctcaaattgaaatttattgttttattgtattttttggagcattttggagatgcatgtgccattttcattggtaggtcgaaacagagatatgcacaaaccagacatgaaatatttgaggcattcatgttttatatttcttcatcattatgatttgctccgagatacatacaaagtacctattgtttatcactgttggttggtttcaatacaccccttgcattgcaattgtatgtgccatggagttggtctaaacattcataattgagtgttatgttcaagaaatctcgggccacatcttttcgcttatacttatacttatcaatcaaaatttaaattttcaaccttaaatttgaagttgattttgggtttttttcatcgaagtttatttttcagcctttgcttttagatctctaaaaacacgtatataaaagttttattcacaaattatttttcatttgaaaatataccgtttgagtccgctcgatttgaacacagtatgtttgcctcagcgacatcaaacgatatatagggtttgttcggatcagctagacagtggctgtacagccgcagtgctgcagttgttttagtacaaatttacttggtagatcctgttggtgtggctgcagcgcagccactgctagctcttccgaacacagccataataaaagattttgttggtttttggtaagtaaacaagttgactggctgggtggatttacaatccaactccggctgaaatgattcatatccatatagaaattaagacgaaaatttaggccgagtataatgcacaactaattgtgtactttgcacaacggtaccgtaggaaaattctttgaagaggtaaactattgaattgaagtatgaaaattattgtttggagacgtgaattattggactgaagttgattagcgaaccgattgcatatgcactccgcacactgcattttccactagccacatcgccaccacatcatcaagtccaaagactggacagggccacgagcccacgacgtgtttcaggccggtccttctggcaccttctcccctctgcctgacacgtgggccccacaccatcacccaccaaattgaggccccacaggtcagtcaaaccaaaacccaatcttgttctcccatgcccctttccatggcccaccccagtacccacaaccaatcggagacggccattccaaacggtggggcccacttgtcagaaaatagaaaaaaatacaggaaaatatcctgaaaattttggtgcacaagagcggcgagccgtttgccttccctccaatctcttttctctcgtcgtcgtctcgtcttcccacctctcggattcccgagctccacacgacacgacccacctcggccactctccgccgtcggtggccagtggcctccaccccctccgtcccccggggaccacaccggcgtaacatcagccacacctccggcagatctttcccccgccgcttaattcacctcgtgcgcgcgcggcgccgctcgttgcctagctagctagctcggccgcaatctagtagtagtagtaggaggaggaggagcggcggcggcggcggatcctatgtcgggggcaatcgcttcctcgccggcggctactctcttcctcgctggctcctcctcctcttcgccgcggcgcaggcggagcagggtgagcggggtttggtggcacttgtatggtggcacggggctgcggttgcattgggagcggcggggtttggttcgggacggagccgtcgtgtgctcggcgtcggccgccggtggtgaggatggcgtcgcgaaggcgaagacgaagtcagcggggagctcgaaggcggtcgctgtgcagggcagcacggccaaggttgatacttttcctccattttttttagaaccaagcttgagactgttggcccacgtgtttcagactttcagatcgtgtcattttgatattttaactacttttcgtgatttgattatagtatgcgtgccagaacgtgcaattagttagtgcaaatagcgcagttacatgtagagccatgttgctagaactacagttgcttgatctagcgagctaggagctaattatttaccatttgttattcggaaatgttacctcgctgcactttttgacatgaatttccctatccaacttgtttagtatattccactacccctgtgtgacatttcatttttcaagttgataatgcttaaatgcttataactttgctgattctggttgagtgatggtgtatatgcattcaggctgatcatgttgaggattcagtttcatcacccaaatacgtgaaacctgccgttgcgaagcaaaatggagaggttgtgagcagagctaccaaatctgatgcaccagtgtctaaacccaaagttgacccgtcagttcctgcttccaaggctgaagctgatggtaatgcacaagctgtggaatcgaaggctgcactggacaagaaggaagacgtcggtgttgctgaaccgttggaagctaaggctgatgctggtggagatgcaggtgcagtaagctctgcagatgatagtgagaacaaggaatctggtccattggcagggccaaatgtgatgaatgtcattgtggtggcttctgaatgttctcctttctgtaaaacaggtatgcatatctaaactggaaattgggcctgaccccatcatttcccctttttgagcatgaccaatcaggcttttacttttaagcttaggcaatgttccttctaataactgctatcatgtgaaggtggtcttggagatgttgtgggtgctttgcctaaggctctggcaagaagaggacatcgtgttatggtacgtactccttcacatttgtctttgtttgattgtctcggaagagattaacaatctgtagtactagtatatgtgcaatccacaacgtaagagactaagaggtggtattttgattgttatatctgaaactcttaagtctcattcttttgatttgcgtgcatcatggaaaacaatcctcaaattgttaccctgttgtctctgtcagctattaaatgttgtttcacatatttaggagagaagtgtggaaatctatcttgtattcttgttagataacaatttttgagctgtatgatttagcatgcttgagatggatgacaattcttaagatagcatcttaaattgaaatgtagtaggatatgcaccgattgagttcagtggcttagttttaagtgatccaaatataagtggctatttcaattttaggttgtgataccaagatacggagaatatgcagaagccaaggatctaggtgtccgcaaacgttacagggtagctggacaggtaagaaaacattgaaacagttattgtgcaatgtgaaatgaaaagtttaaaggttcatgatagaatctttttttttctgtgtgtgtggttttcaggattcagaagtgagttattttcatgcttttatcgatggtgttgattttgtgtttctagaggcccctccctttcgacaccggcacaatgatatttatggaggagaaagatttgtaagtcccaatttttctatagcttaattgacttacaaataagttccttttaaatcttctgtaaatattttttgcacaattttatcatttgatggcaggatgttttgaagcgtatgattttgttctgcaaagctgctgttgaggtaacttcccattttattgctactagtctataaatgtactccttacagttctgttagattcgcagctcactccaccacgagtgggccacccaggtctcaccaccatcaatttccagtgggactaaacacaataatttcttactacagtccacaattagaatttcgtacaccagctggtcagtcgatgcatatccaagtttcttgcagcaagctgtttatgcacctttcactacttcgtagcaaacagttaatactaaaattttgatgtttgacaattagaatttagtacaccatctagtcagtcgatatatatctgagtgtcttgcagcaagctgtttgtgtgccattgactactttgtagaaaacacaagaacaattaatgataagattttcatgtttgttttagtttatgaggtgaatgagcctgatgttatgttctcgaataagtacaattcattcatctgatgaaacatttgcaggttccttggtttgctccatgtggtggttccatctacggtgatggcaatttagtcttcattgcaaatgattggcatactgcacttttacccgtatatttgaaggcatattaccgagataatggcttgatgcagtatactcgctctgttcttgtgatacacaacattgctcatcaggtttttcacctagtcttattctgcaatttcattcttcgaatattatctgaaccactaatgtacttgttttcaagtgatctgctcaatggcatttgtattttgcaagtgtttctccttttctttaataagggccatacaattttaaacctggtattcagataaagtacaaaattcagttcagagttgtgtactggaatacagcagagtgcacctgctattttaccctatatgtagaaaatataggaaatttgtgtttatttatgacaccagttttgttcttacgaagttgaattagttattgattttgcctcttgaaagataattgactatactactgtcatagtgacaccaatttagttctaatgaaagttaaattggcttctatttattttatgattgcgtttcgcaatgtaattcaatcttgttttcccgcttgtcatccgtgggcatttaccttgatgctaatctcttatagatgtttcatgattttcttctttcagggtcgtggccctgtagatgacttcgccacgatggacttgcccgagcactacatcgatcatttcagactgtacgaccccgtcggcggtgagcacagcaacgtgttcgccgctggcctgaagatggctgaccgcgcggtcaccgtcagccatggctatctgtgggagatcaagacaatggacggtggctggggcctccacgagataataaaccacaacgactggaagctgcagggcatcgtgaacggcatcgacatggccgaatggaaccccgaggtggacgagcacctgcagtccgacggctacgccaactacacgttcgagacgctggacaccggcaagaaacagtgcaaggaggcgctgcagcggcagctgggcctgcaggtccgcgacgacgtgccgctgatcgggttcatcgggcggctcgaccaccagaagggcgtggacatcatcggcgacgcgatgccgtggatcgccgggcaggacgtgcaggtggtgatgctgggcacggggcggccggacctggaggagatgctgcggcggttcgagtcggagcacaacgacaaagtgcgcgggtgggtggggttctcggtgcagctggcgcaccggatcacggcgggcgccgacgtcctcctgatgccgtcgcggttcgagccgtgcgggctgaaccagctgtacgccatggcgtacgggcaccgtgcccgtggtgcacgccgtgggcgggctccgcgacacggtggcgccgttcgacccgttcgccgacacggggctcgggtggacgttcgaccgcgccgaggcgaaccggatgatcgacgcgctcgggcactgcctcaacacgtaccggaactacaaggagagctggagggggctccaggcgcgcggcatggcgcaggacctcagctgggaccacgccgccgagctctacgaggacgtcctcgtcaaggccaagtaccagtggtgagctggtggtatttttcgcgacgcctctggatcccgccgtggatgggcgcgctttttctctagggcggctctgcgtcggagacgctcagacgcatcgcgcgcgttcgcgcccacacgatgactggcacgctgctgctgagacggcggcacgcgatgccatcatgccaccggacggtaggagcaacggtggaagtgaactgtactactggtgctacactgctactacatgagatctgctcttattggtcacgtactcacgttcacgctgaattaccgaatgtgttgtgtcttgtgtgtgtgtgttaaaggcattgtcctggtaaatggtggagacgagatggccgggtcgcgggagttatatttgtatatgttgccagctttctgagtttttcaagccagtgcggctcttcagtgcaggttccaagcaagttcagtgccggatgttaaccatgttctgaatcttgtcttttctttcatataagcagtgaagcacagggcttctactgacactaccatgtcatgctgctatttggaactgtgttaggggataggaacaccattaaacaacccgggattcgcgcgctcgtgttaatgtcaatgactaaatgactgtgttccaataattgccatcccaagatactgcacgtacaaggaagaaacacagccggagacatctcagtcagacggccattgcggctgctagctcagtagtaccaacagtagtactctatccgttttacgatataagactttttaatattatctatattcatatatagatatcaataaatctagatatataactaaatatatatatatgtttatggtaatgcttaggttgtgaaaaggagtaagtagttttttttttcgcctgagcctgaccacaattaagcggcctaccaaacacgttaacatctcgcatatattgctcctactatcacacaggctgtcatacgcatgtagtagatcctagcctgggtacctagctagtactggctcgcatggcaccaacacaagtcagccaaccgcgtgggatgcggatatggctaaaaacacaaattgaccacaggtcaacaaagcatccaaaggctcacatggcagccataaaccaaaggcaatacttacccagctataaccatatgcaattatctccgataaaacaatgttacgcagcagctagcagctttgcataaatatcagctaaattcagcgaagagaacgtgccaatcgtaaacagcgccgtcttaccctagatctggaatatgcccatgtccatgtacatccaaagcccgattcaaccagtaacagtgcgcccattgccgtcatggccattcatgtcttaaccaccactgcaccaccacttgctctgctgcctcctcaatcaagtgtctgaaactgcacaagggccaggaagcagcagcagcaatgcaaggtagtagtacatcaatattgcattttgttccttctgatcctaccagcactagtgttcttgacttcttgtctccgactccaagaggcacctcacccgtgcacgatcgccgattgcatgcaggtgatcttgcgttgcgcgccggcggtgataggctcttggtcgccgacacggtggccgccgtggtggagagcttggtgcaggcatggcggcaggtgaggatggagctgctggtgccgctgcttagaggcgcggtggtggcgtgcatggtcatgtcggtgatcgtgctcgcggagaaggtgttcctcggggtggtcagcgcggtggtgaagttgctccgccggcggccggcgaggctgtacaggtgcgatcccgtcgtcgtggaggacgacgatgaggctggccgggcgtccttccccatggttcttgtccagatccccatgtacaacgagaaggaggtaacatggctttcaatcagttctgaactctgccatttccgggaacactgcagtgctctgtcgtttttttcagaagagcaaagtgataatccccgtttttgtcgccgcattcagcatcgtgttcagatttacatgcattaaacatttaaaattttgagcagaaatgcatgattgattagttagcatagaacaggcaattcttggctgtaggattcgttcacgggggtaaccttagctccacctgacaaaaacagtgaacaatgcaggtataccaactatcaattggggcggcatgcaggctcacatggccggcagatcggttaatagtacaggtcctggacgactccaccgacgccatcgtcaaggtgggaccatcgaatcctgaaagttgcccaaccaaaacgaagtaaattttggaagtaatcaactgacaaagtaatctgtctgtgtgttcttgggtcaggagctggtgaggaaggagtgcgagaggtgggggaagaaggggatcaacgtcaagtacgagacgcgcaaggacagggccgggtacaaggccggcaacctcagggaagggatgcggcgtggctacgtgcaggggtgcgagttcgtggccatgctcgacgccgacttccagccgccgccggacttcctcctcaagacggtgccgttcctcgtccacaacccacgcctcgcgctcgtgcagacgcgatgggagttcggtgagtcacctccgctttgtttgtttgttttcggggcaattgggcaggaaagaaagtagcctacgctgctacagcactgaccatggtacggtgtcgttattcgtttgcgccactcgtcgtagtactacgaagataatgctgctgccggttgtcgtcttccatccacagttgattcgaggagcagttgaagacttactgtactgtgctactaataaacctcgtgctctactgctctagtacagtttctgggtagtgatagaagtactccctctgcctaagaatattgtaatttctaagtggatggaacgtatcctagtcagagactcagggctccccaaatcgttttttagtggttaccagttacaaccaccctatgatttggcgattaccgcgatacccatgcggttatcacataccgtggtttcaaaaactgacaaggttaccgcacgtgataatcacgaaaaaccttgaccataatactatacaaactctctatctagattcataatatacgatatgtcccatccatttaaaatttgctatattttaggatggagatgtatgaatcttagccgagctaaacaagatgggcccagtgctagtgtccacatatggcggcctagtcggtattttagagacagacggcccatccacccaggcgatctcaacatctttgtcatgccaacttttcctctctttttttttgcagtggaccccatgtgtcatcctctcattatttttgccgcacattaccaatgttttagctaggtggtgttgcaatgtttgataatcaaccaatgaactaaacatggccgaagctcatatcaattattctaaatttttgaagtatgagagtgcttgtcatatgctgagagaaattctgtttaagctgccttgcagtgaatgctaacgactgcttgctgacgagaatgcaagagatgtcaatggactaccatttcaaggttgagcaagaggccggctcctcgctctgcaacttctttggctacaatggtatgatccttgctcgcctctgccactgcaattgctccttgctttccttctcctctacaagtttttcagaggttttgagaattttatatgctcatgaacgcatccaggaactgctggagtgtggagaaggcaagtgattgatgaatccggtggttgggaggaccgaactacggcagaagatatggatctggcactgagagcaggactgctgggctgggaatttgtctatgttggtagcattaaggtatttttacctcacttcagcagttcagttctaccatgatgacatggcaatccatgaacaaaaacattagcagattaattggataacttgagagtttgcttccaattccaggttaagagtgagctgccgagtactttgaaagcctatcggtcccaacaacatcgctggtcatgtggacctgcactcttgttcaagaaaatgttctgggaaattctggctgccaaggttagtattattttctcaagttgcacagcaccctggaaactgatgcatcgaaactgtatttgactcggagaattattgcagcattctttcttctagtgctagaattacctgaaagcccttatattcttccattgttttccaacgcagaaagtctcgttctggaaaaagttatacatgacatatgacttcttcatcgcacggaggatcatatcgacgttcttcacctttttctttttcagcgtactgcttcctatgaaagttttctttccagaggtgcagattcctttgtgggagctgatcctcatacctacagctatcattctactccattcagttgggactccaaggttagatcagtgctgtttacccttttttgtgtgtgtgtcaccagctactatgatcaaaaggatggtacatctcatgaactccatgtgcttcaggtcaatccatctgatcatactgtggttcttatttgagaatgttatggcattgcaccggttgaaagccaccctgatcggattttttgaggctggaagggcaaacgaatggattgtcacgcaaaagttgggaaacatccagaagctcaaatccattgtcagagttaccaagaattgccgtttcaaagacaggtaaattcttatatgaatataagaatcactttgaacttgatctgtgccatgagttatgcgctaatttctccatctgccggtgcttcttaggttccactgccttgagctattcattggtggatttcttcttacgtctgcatgctatgactacttgtacagagatgatattttttacatctttcttctgtcccaatcgatcatatattttgcaattggatttgaattcatgggcgtcagtgtctccagttagatcaaggcagggcaattgcaagatctgctccagaagcaggatccatgttaaagcagtcaatggggaactcttgtgccttgcatgtgacaggaaagctcaacgctgcggcaattgagggcttcaacaaattgcgataagcatatgggagataagaacacattgagcaagaagaaaatcatctagtattgtcaacgtatttaataggcaagtgctatctttagtgaagagtagcttcgcatcttatgtaacttagcatgttaatagtgacaattatcatttcagagctacagatattgtagcacgacatttaacacctatgaacttcaatggaatacatttacgataacaaaactggaggaaactatacgctctaaacccgatttcaagaagggggaaatctactgccaatgtactaatacagtgtgcttggaatcctacagtacttcgcaattctgatttgtttgtgttcataaaaatgcgctgaaaatatttgcagcagaccaaggctgtgtttagattggcccaaagtttggaatttggttgaaattgaaggcgatgtgactgaaaagttgtgtgtatgaaaggtttaatgtgatggaaagttggaagtttggaaaaaaaaactttggaactaaacacacttcaagaactcactaaagtagggtcaaaagacattgaaataacatctaaattggtcttttcgattgatgtgttgctgataatcagttagagaagggttccaagatgaataaaaacgaagagaactgggcgaaacggaaactcaccttgtgggttgcggattgcaacacgagggccgccgggagcctcaggctgggtgaacaagacgcgtggggagaggaatcgagttgagcacgccgcagagacgatcgagtcgccggtgatggccaccgccgccgccgccgcggccaaactgtacttgtagggtgtagccatcaagaagagccgagacggtggagcagttggctcttgggccaaaactcaggcgttctgatggctttgcattgggctattggagatttgatgggccatatatatcggattggaataagttcaagttaggtcccttaatttgtcaacgaattcgattttcgtccttcaaccggaaaaccagatacaacaggtcccttaattgtcaaaaccggtgcaaaataagtcccaggcggtttggatggtggttttcgctgacgtggcgcatacgtggctaatttgactcgttcttcgtctcacatggcattaacgtgatgcttacgtggcaatttagttttgaaaatgataaaaacatcgggcccacatgtaagttacacaaaaaacaataattaaaaaaggcggggccaacgtggcccccacctgtcaatctcactcccctcttcttcctcctcactcccaatctcccctctgtccgtctctctcctctctcctctctcctctctcttctctctcgggcgcgacgaccgacgggcggcggagcagagcggaccgcgggaggcggccgaagaaacccacggccgggagcgcgaccacgtcgacgcgccccgtccgcgcgtcgcatgacaccctgggccaggcgcaggcgcggtcggcatcctccgaccacggcgccaataggccccccgggtcggacacccccgacttgaagaccaccagcgcaagtacgtcgtcgttcacggcgtccgctgcggcgaggatggcgacggctggacgacatccgttcggcacgagaccggcgtcggcttcagcctgcatcacctcgagcagcttcgtaaaatgctctatgagtagaagtagcatttagcatcactacatcactattagatatgcttgctgccttttcatgtgcttgacctttgaggtttgagccacacgaacatgttatattcgatccagccaacatccagtcgatcccactggagcggagacagactacggccttgacccggcgaagctgctcgaggtgatgcaggctgacgccgacgctagtcttgtgcccaccaacgtctgcgccatggtggactcctccacctcccgctgcgacgcggccgatgggtcgggctcccggcggaaggggttggcctcgagggagaaaacgaggcagtcggcgcggatgggcggactccggctgcgtcggcgggagcagcaacgacgtcggcggcggcagcgggcgctcagaagccatgggggactggagaggggagagagagttgaggagagggagatggggagagaggaggaagaaaggggggctgagaatgactggtggggccccaccattttttattaatttatgtgtaaaactgacatgtgggtcccacgaagttttttttttttggtcgaattgccacgtaagcgccacgtcaatgccatatcagatgaagaccaagtcaaattagccacgtaggcgatacgtcagccaaaaccgccgtcaaaaccgccgagggacctcatctgcactggttttgacagttgagggacccatcatattttctggttgaggaacgaaaatcggattcgttgacaagttaagggaccttaaatgaacttatttctatcggattaaaacctggatgcaaacaggcccgtctccttatggcccaatagggacccaaccttccgctatcctcggtgaacccgaggcacagagcacggtgcgatgcgagtatcgtgttcggacttccgacggaaccgacaagccacaaggcaacggcaacacgcgaccgtcggatcagttgatacggccacgaaacgtcgccgcagcgctcgagatcgagtccgacgagacgacgacgactcctccctctcggctcccgtgccggacgaggacgcgctggctcgatccatggaaaacgtgcgcttcggaatttcctctggtcttttggcgtactcttcgtcgccctttactgatgctccgtactcccttcctcttaaataaaacccattcctaacatcccaatataaaattagtatagtgtgagaataactaaaatacccttaattattaaaaaaaatagtaagggtgatagatagataaaagatattaaagggataaaacttttcgtttgagattaggtagaatgatagaagttggttttttatgggataaaatttaaactctagaaattaagttttttttaagatggagggagaatgccgtagcccatcgcactgtactccctctgttgagtatagtactgctctcttcttaactacacattcttaagaaaaaatattgatccaattgggcagaatcaagagtgtctatagatcacacctgtataattgctcactgacagtatcaggttaacgtcgcgcgtacattttaccctccaaaagaattcagatcaacaccaccacccacggaaaaacaaaggtaaaaaggtacaagtagtattagtaaaggcacaaaggcataccccaactaaccaccatctcacagtccacggcgacgcagtacacccagcaagtgggaggcagagacatcgcaaagatttcaatgcacagtagctgtagcatcatgtgcaccacgccatccgtatctcctccatgcggctgcaggctcgcatactgggttcagtgagacgagccaccgacactcgcacgttgcttgccaccaccaccatccctttcgtgtgagccgagtaaccgggacgtgtggcctttgtgaccgccatgtctcctctccgctactactagtagtacgaccaagcaaggggaagggaaaaaaaagagcccatcaatggcgcgcctgaccggcgtcttcctgcctcttttgtgaatcgattcaagacgccgcatgcaaaagcaaaacaatcgcagcatctttttcccatgccttgtatatgttgtcggttatctcctcagcgaaacctcctgcagatgccaaaagatttacctgtctgcaggacagtgttatctgttgtgcccggtatgtgtccaacatgctgagggggtgttttggaactaggtaacttttagtctctctcacaaaagcataagatagtgtttggaaagtagtgactaagctttaatctctctcacaaaaacataagtccctatagaagagactaaaatttttgtgagagggactaaactctagtccctccttacctaccctagagatttatgtttttagtttagccctctctcccaaacacccctagtttgttcgctgttgcctgaggttggctgatcgatgaccttgcaggattagcaaaagttttgatcggcctggtttgtgcatggcacgttaaattcaaatgctctactagtagtactcctgtactactcaaaacagagtctcttatctttgtcgctaacagcctcgttaatcttacacttgagtgctactgctcgacaacatcaaagaatccaatgggtagctcgctggcaatgacggtctctggtcaaaaattgggtcagagattggaatgacggttctagaaatccgcatcgagcggaaccagattccttgtttcctgaccattgctccgagtgttccactttctggagcccaactacttgagctctgcaaccttgcaggcacgagttttaccggtaagttgatgactggctggagtgtttgattgcttgacggtccgtgcaggaatctctatggctgtgtttgcaaccccagttcccaacccttctccctcgttttttcggacgcacgcttttcaaactactaaacggtgtgttttttgtaaaaattttctatacgaaagttgcttaaaaaaatcaaattgatctatttttgaaaaaaaaattagctaatatttaattaatcacgcgctaatagaccgttccgtattccgtgcgtgggtgataggttctcaacacccaccaccgaacacacccatagggatctgtatgccttctgtatgtaggagtagttctagtatgtgtatcaaacagtaggtgctctccgtatacatagtagtactacgctactttatacagttcatatcctgatttcctggagactggactggattagtacacggtttgagccggatacaaccaatgactaaaatggagcagcctacatacgcgcggatacaattgtgtatcaaacagtaggtgctctccatataatacgtagtagtactatgctactttagggcatgtacagtggtttttattagcggtctctctttattactccctccatctattttttaatagttacatttcatcttaacacacagaccaaggataagtaattctacttatcattcatttaagcatgctactattcattcctcgtaaacaagcgattcattaatatttacatttctcaaagcccatgtagccaatcatgtgtggaagaatggagagtcacgtattaaattcgagaaaatcattaagatgataggttgttggattgaaatatgcctatcaaaaataaaattttcagatttggaaatatgattatcaaaagtagatggagggagtatcatgcaagcatatttggtgacgtggaagagagaggaagaaggaaagagaaagatggttgctacgcatgacaacggtgtagagtcgactcttagcatttattaggaaatttttttattgcattgagtctaataaaggaaagatgactagtaagaaaatattttggtacattaatgattagagactgtaacttaaatattgtaacgtgatagcctctaattaacgtagagactttaccgttctctacttttgtacttgccctacagttcatatcctgatttcctggagactggactggagtagtacacggtttggagtcggatacaaccaaaccgtggatacatacgcgcggatacaattgtttttgccaatcccaaaatccaattgtttacagattggtattgacatttcacatacacgccggcgactgcacatggctttaacggcaatgtgttggtgatcggactcgtgaagtcgtgagtcgtctccccgttgctgccgtcgctccacacgaacaactcctacattcggtgagcccatgacacgcagactgaccggcgatgctgcctattgtcgccgactcgccgtgagccggtgaacactgtacatagccttgacgttgctcgctgccgacggtgcgttgggtcaccgcacttctttctctcgctcggttgaaaacttccgccaacgccgggttgttcatgtccccggcctgcggcgcctgtgcgcgtcgagcagctttggacaccgacgcgtctctcgtagaactcttgctcggcggtctaaccgagcgaacacaggaacgtaatccggtcattcgttttcccttcacgcgcgccacgccgctgtctagtctgtgtgcaacgaccacgcagcgccgtaccgcgcactacgatcggcacaagagattgatgcgcacagcgaaaacgagcagtacggtgcaatgggcctcgcacgagcagatgtacactaggctcgacacactcatttgcacggttgttgacgcagcaagcaaatcatgtacggcggtttcttggatttgtttcagattgtttcagattgtgatacggtggattgaattcaaatgcattaatactcccgcataagagaagcacgagtaaaaagaaattgttcataagcagcacacagggcataccccagatgcctaaactgtttggcacccccaaaatgaggtccggtactggggtccggtacagacaacaaccaggcaaaaccattactagcagaaggccattcccattaggcccaattttgctattttggcgggtgatacaaggcggcctctgtcaatcaagccacagccttaccaccacttccaatccctagccaaaagataccacaaaagctcaactaatggtacttgtaacaaactaccactagcagtgacaccagcacaaagcccatgttgatactaggccaaactacccactaaatactttcccaagaaccaaggcgagactgagtaccaatcataaaacaatggcacttcccagcacggtccagttgggagtactactgcaactaccacgacgatgctcgagtaaaattgagcggaatcagttgaactgggccccgctgaaggtctggccgaaggaccagccacgggggacggcgttgttggagacgacggagcggccgtcgccggtggtgacgcggaaggagagcgcctgaccgtcgaggagcgcggcgctctgccagttctggccccagttgcgcgacagggcctgccacgccgccgagcgctccgacttcacggccaccgcgtgcacgtcgccggcgccgcccacgttggtcaccagcaccaggttgaagtaggagtgcccgttgatggtgaaccggatcccgcccttcttctggcaagccaccctgcactcgagagcacgcacgccatggtcagtaagttccggtagatccaagaaagcgaaacgcgaaggcaagaaattgccggcgttggctactcaccggcggtaggagacggggacaatgccggccttgaagagagcgatgcgctggaagacgggctgggacatgtcgaagtgcgcgcgcggagggttgcaccagccgccgtcgtcggacgggagcgcgttgttcggcgggcagaagttggtggccgtgacgacgaccgagccgggcaggcacgagtggctcccgccgccgccggcgtcgcagcgcacctcgaagcacgcgccgcagctgaggccgttgttgaacagcgccgtgctcagcgccgccgtgttcgtcccgtacccctggctgtagaggttcccgtacccgcacgcccctcctgcacgcgaccaaaaacgcacacgcaaaacagtgagcacaacacgcagatgtaacaacatttcagcacagtgcacagcgagaaaaaaacgtacccatggtgcccgacgcgtcacccccgccgtagaacgtggcgtgcgccgacgaccacccgccgccgccgagcggcgcgtgctgctgcggcccctgtccctggccgtgtccgccgacatgcggcgcgcgccatcgcccgtgcccgtgccccagcccgtggtgccccagccaaagcccacgggacaacgccggcgggagcagcgcggccacgaggacaacagcgaggacgtctcggcgggacgacattgttgtgacggggatggagtcgtcgcacgcgacggggtgcgctgcgacgagagcgggcggaggcgtggagtgtggagtgcagcgaggttgttgggggcggggataaatagaggggtgcgtggtgggaacggtgaaacgaaaggaacgggtttgaaacggcgcggcgcagtagggtggggtggagtggagtgcggcgtaggccgcggcgtacgcgggtggggctcacagcgtgggtgcaaaagctcgcagctgctccggcacgtagggacacgagatttcgggggcgttgggaggcgtggcgggagtgtgaaaaaaaagggatggcgtggtggggtaataaagacggggaagctgccgccgcggcggtgcctttggaagtcgaaaccgagcgcggcgagcgggagcactgcttttgctttcttttttttcgccgccgtcccgtactactaccaaccaaaatcgctgccctccgcccctcccagcttcaaaacctaacgcggtgatacattccgcaaatgttgtcacggcaaagcttccatctttactctaaccctcaggagtacataccctaacccttacgtttggccatacaagtcttcttcacatacctgcactattctaacggagttgtcagctccaggagctgagctacacatccctccatattttaaggcaagggtttataaatggcatctttgactgaaccacgggacaacagtccacacagcagtctgacgggttttactgcacaacattattccctccgttaaaaaaaaatactcaactttcaaaaaaaatttgaaacttttaactttttcatcacatcaaaacttttctacacacataaaatttcaacttttccgtcacatcgttccaattttaaccaaacttctaattttcgcgtgaactaaacacacccttacgaggttgagtttattttttagacggagagagtactcattcacctttattttcaaatactccctccatccacaaaagttacacatattttatatttaagtttttctaaataagttgttcctattttagtctttatgcattgaagacttaaattaaatgaagagataaattaaacatttgattagaaccaaggagtcatctaaatacttattggttggattttgtatcatccaagacgatttaatttcttcttaatctttgtgataaaactaagtaacttttgtggatggaggaagtattacgtaaaaatataatgtgaccatgagtaaaaattaaaatcagttcattctttttacagcgtaagaccctatttagatgagactaaaattttcaagtctctatcacataagatatttggacactaattataaatattaaacatagacaattaataaaacacatccataatcttatactaattcacgagacgaatctattgagcctaattaatctataattagcctatatgatgttacggtaaatattctctaattatggattaattaggcttaaaaattttgtctcgcaaattagtttttatttatataattagttttataactagtttatatttaatactttaaattagtatctaaatgtatagactaaaattaagtatctgaatcaaaacaacacctaataatattcgcagtaactgtgtggcaggcttatttaatgcttccggtagaaagtatccatatttaatcattaatgtactccactctacttccacctctaccggttcacgaagacatgaagtccaattcattcatgggccaattggctaatgggccaaatgggtgtgcttgctgctcacccaacacgaaaaacggagcagatcattaacacgtgattaattaaatattaactattttttttaaaaatagatcaatatgatttttttaaaataacttttatatataaacttttttaaaaaacgtacattttagcagtttaaaaagcgtgcgcgtggaatatgacggtgagaggttgggaacccttgggtttgaacaaacccaaggcctggtttagttcccatctttttttttcaaacttccaacttttatatcatatcaaaaatttttctacacacaaacttccaacttttccgtcacatcatttcaatttcaatcaaacttacaattgtaacatgaactaaacacaccccaaatataaaggcgtacagccatagcggcatagtagtgataactgtgagtagagtagcataatatgtaaatactctatccgtcccataaaaaaccaatctaatactaggtgtgtttagttcacgttaaaattaaaagtttggttgaaattagaacgatgtgatgaaaaagttgaaagtttatgtgtgtaagaacagttttaatgtgatgaaaaaattgaaagtttgaaaaaaaaaattgtaactatacaagggcgtagtcaaaatacgtgggtagtatttccatgagagcattccgtttcaggtgccttcaatgctgaagggaagttctggctgaaccactgtgaatccagcaaacaagtcatgtgctctttcactcgtcagagcggaagaatccaaaaaaggccgagagaccgtgggctgctccgctgcttgcttgcccacaattgtgtaaccactctgtagatcggttggttccgtcttaaatttctccctcccccgataaaaaaaaaatcacaagtagaggaaagtaggaaggcaatattcatttcgtaagatggtggagcctattatgtagttgtaactgtttgctcaataagtggtactcgctgcggttttattttaattgacgctttgaacaatgacacgctctataaaatatatatttaaccttatttttctattataatatatacaataaataaatgcatgtttacttttattatagtgttttgaaagacaaatctatatatgtttttctagtttctttaaattaaatatttttaaagttattgatggttaaagttataaaagtttaatcttaaccttgtccaaaacgtcaattaatatagaaccagagggagtatatgtctacatactatgtaaatgtaaatatattaattatagagtaaattgcacccacggtagattaacttgttaggtgggtgcaatttggtgtaagaacttgagaaatgagcggtcgagtgcaacaacttggctggtatgtgcaatttaatataagaacttataagatcatataaatgcaacaacttacaaggtatatatgattttgatacaataaattaagaggttatgcggcaacttaatagtatttttttatatagattcaatttttaagtacttattttgacagtatactaacgtgtatttgtataagcatatttatatttttatcctaataactaataactgaaagtcaattaaacaggatatagaaattattatattccggttgatatttgagaaggtcaagaaaaaaagtcttaaaaggtaattggatgtaaattgtatgtgcagtataattcttaaagattaagttcaatattataaggtaatatccgtaggattactatgtaatggcatattgacaacgtggaaaaaattcacctagcatatacttagcaaagttgatgcataaaaatactaaattatcaagttcttgtactagaacgcacacacttatcaagttgttatatttggacgtttaattcttaagttcttgcactatatcgcacaaacttgccaagttgttgtactacgggcgcaatttactcttaattataaaacaggagagcttgtctacatattttcacccaaaaaaaatcaatcagatttgcaacaatgtgataataaatgtccttcgtagtttatatgtagtcatttatctataagccatttttacaaaaacaaaaacaaccaccaaccacctacaccaccagagtttaccaaatcgtgcggttataacgtatgataacattttcggttttactaaaccacagggtggtgataatcccaccctaaatagttcggtaaaccctgaccaccacacggagcctatctccaccagaccaccttacagacgatgcaacaccactgggtgctcactcattcccttcattcctaacaatacattaggtgcaaccctctgtgtggtctttcgtgccctctcgctagcatgctattcacataacattatttatttttcatgtccaatctcgttcgattccagtgtttttcatatgttccacttaaactcacattttctgttttcatatattttttcattccttgttcaggtcagaattatgtgattttcttattattccttttgtttcattctgcgattcaaaggggcatgagtagttatgtctcaatcatacacgagctgccaaagcaataagctttggtttttttttctctagaactatagagtagaaaaatttccacatttttccttttcctcgttcctatgaatcaatggtacgagcattgatttattttttaaagaaaacctctaaaaaattggcatagagttacatcctctatcgtcacggaagaaaaaaactgacaattttattaaggaaaaacttgccctgcagtcatgcaactgtgaagttaattggtgagtaatcgccgaaaacctccacggcgagaacacacttcgaggcggcaagccaccgcaactgatgacccaagaaaattgagacacatcacgagtcattgttgccatgttttaaagtcaaagaccaagcaacaccgactttcctacgttgatccacaccctccacggtcaacaaccgaaaaaaaaaatcagcaaccacccaaagcgctactccccttcgtctaaaaaaaaaaacaaaccctggtttccgtgtccaacgtttgaccctccgtcttatttaaaaaaattatgaaaaaaattaaaaagacaagtcacgtataaaatattaatcatgttttatcatctaacaacaataaaaatacgaattataaaaaaaaatcatataagacggacaattaaagttggacacggaaacccagggtttgtctttttttggggcggagggagtaccttctaaggccgaatttagttctaaactttttcttcaaacttttaatttttccatcacatcaatatttttctacacacataaacttctaacttttccgtcatatcgttctaatttcaaccaaacatccaattttagcgtgaaagttagaagtttatgtgtgtaggaaagttttgatgtgatggaaaagttggaaatttgaagaattattttggaactaaacacgtcctaaatgaaacttctagagaggacatttgtcaactcttgctccgaacaccaggactaggttttcacccgaataaaaagggagaagacgacgttcatatgcaccaacatctatcgtcgacaccaatcaaaactaggacaagattttcacccaatgtacattctcacttcctgtcatccatgccctttacaaagtgtccctttgccgtggctagaatacgaggaattgaaattatcgttgtcaagctcaccacaggtaccatctttggttgcatactatagttgttctaataagcggcaactacgctatcatccgtaggatcccgattcctacggcatttccttcctttcgaaaagactataagaccattcacagtgcgtctatgtggcattcaacccccgactagtcacctaggagattcccctccacgtaggcaactagcgtggtcctagaaataatgattaccgctatgaggaatgagtagcattgtcagagaaagcatgagagtaagtagaaaaaaaacacaaacacacgtaagagagatagagagagagagaggaatgacgtagtgaagtgtcgcagacgacgatgccatcaccgccgagctccatgttccatcaccgttgggcaacatgtttatcgccgcaagctccatatccaccgtcgccccctcgatctacaccgctgaagaataaggaggcttcctcgtattggatagcttgcataggcgacaaggaacggcgacaactggagttggaagctagtggagggaggaaggcaccgacagtaggagggagggataatgtggcgtcgacaccggtggatggaggaggggagaaatggtgccatcatcgccgctagctggatgcaatggcaagaagtgaaaagatcaggtgaggatagggcgtgattttatattatttatagattttagggtgttgagtgtaaaattttataccactatatgtatatatagtagaaaacagaaggggttgaaatgcaaaaatatctataggggtttaaggctacgttcgttaggactggttttaaattgcatcactgtcactgatattggtagcagaagtaacaaaggctgtgtttagattcaaacttctaactttttccatcacatcaacctattatacacacacaacttttcagttacattgtaccaattttaaccaaaacttattaactttggaagtaactaaaaacagccaaaattgccatgtcactggcccgcgtcttctgataacgtgtcaggccctgacgctgcaagctgcaacagcaacaaaggacggaaggagcacatgctgaccgcgacaacgtgcatgccagcatctgcgcaaaagatcatttgtccaacgcacacaggttccgacggcgaaaacactggaccaggagtccagaagaattcaacatgcccaccaaacccagattacggggatcactacccagttgttttgccaacggaaatgcgtcgcccgtgccacgaaatgataaaaaaacaactaaacaaacgacgaataatttgaaggtctacttcacatcaatctctacctcttcatgcccatgccttgtttggaacgggaatagtactacagattttacaaattttcgcaaggggaagcagtaaagggtgccgcagaaacgggatgacgggccctttggcagaaacgggagggggacccgtgactggcccccagcaccggcacaggcgtagtgaatgcacggcgtactacgagccaaaccatcgttgctcacacttggcgcgtatcctcggggcgggcacatgcgaggcgcagcgccagcgcgctgctgcaaagggacgcggcccggcggccgcgccatgtgtcgcgcgggcgaagcaggggaacgtgcaagtgtcctgtgccgtgcgtgacacggggtcccctcgccgcgtgccccacggtggtcacctacacttgccacgtgccccacggtggagtaactaacctaactgaactggaatgaatgctgtgggctggtggtgaacacgtcgcacatgcacgcaggactactactacttttgcaccccaagttctagagcaatggtttggtgtgttcggttcacgccaaaattagaagtttgattgaaattagatgatatgacggaaaagttaaaagtttatgtgtgtagaaaaatcttgatgtgatggaaaagtttgaagtttgaagaaaatgttaggaactaaaccatgcccaaggttaatagtttcggcgactgttggcggcaaccgagtgccacgtcctctaatagacaactaatctacaatgcatacaacaacaacacttctttattttttttaatcgagctagtgcctactccgaaggaacttgcccagtattttacgtccccatttatttttccattggttgttgtgagagcaaatgggcccatggtaagtgaaatgtagaggctcgcgcaaaaagccggcgactaaatagttgctcacttttctctctccaagttttctttcttggccacgtatacaaaaatcctatatgtaagcaggctattagcccattgttgtacctgctcttatggttcacaatcgacaatttgaagagttccaagctgcaagaaatcagcagacaggacacgggcccagcccaacagcaacgaaatgttaacagaaaaggcccatttaatatcttcgaggcatccagccatttctgaagaccagcccatctaacgtgtggcatggaatattcagccttggaaacctagcgtgatactgtagctcatattgctgacaaataacaatttacacaattagatggaacaacgaaaggagaggaaatatcatttacatgctactccataaacatgggggctgaggataaatgcagtagacaagcgagtcgtgttcaggtccaagctcgagaacccagcatccctgatgatttcgcctgtttctctggtgaggtggcacccgtcagagacaaactgctgcagaggattaagggcaccttgcacgaatcggaggaaggatccatctattgcacggggcaaaaggagaaggagagtcaataatgcacaacaacagaaaatctctaaacagaaatggtcttaagccatttgtgtgtaaaatgtgaaagagaatagcaggtggtaccaggcgcagcaacatgctcaatgaatatgtagagaccaccaggcttcaggactcgttttatttctgtacaattaaaggctctgagttgtttagctagaaaatgattattataatttaatatagatgaagtttgttgtctatgcaaggcaaaaatgattatgccaaaattcaagagatgcaaaaatattgtggaaatatacagacaagaacagatgtcatacttcagttatgtaaaaggggatgaagagtttcacttctttttcagataatggaaatagtttacatttacggtgaagagtttaacacaaaacggtaaacttcagtttaaacctttcttagcattggatggctcgagttctaggtaacgccaatttcttataattgggaaaacacaagacgaagagtatgaagtgtaaaagtatccgacacatcatattaccttgttcaataatgtgcatatttcaagcccagtgacagtgagtgcatttatttttttggatagaaaatcagtgacaatttcaggtagctaagaaacaatagtaaaattaaaatattcttgataataattttatggaatattttaaacatcttgcctcatggacatatctaaagattccatatgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17792 - DNA, 417 bp, Oryza sativa
tacatcagccgatagaaccagcaatagtgcagaatatacacgaaagtattttgatggagtcgctgatggtgaagcattgagctgttcaaggcgttctctagccaatgattgaaacatctggatgtacgagaaattttagttaatgtagggtataatcttaactagttgaagacttgaagttctaaaacattaccttcagggaacaaagaaggcccaaccaacttgaccacaggattatttgttgagaattaggaggcacaaccagtgggagaaaagttccctggaatacgagagagatcattggcatttcttcacatggcaggcaacaacaagaacataaataaataactgtaaattgatcatacatcctcccttagggcttgttcggtttggaaggggttgaaggggattggaggg

SEQ ID NO: 17793 - DNA, 3451 bp, Oryza sativa
agtctatcaagtgacaaacagaattagaagttgcaaaatcaagtcgaacacaggggttaaaaacatttatcaccagtttaggtctatgttgaggacagaacaattcggtgcaacaataaatatatagtgcagatcaagctacatctgaatagatatgtaactctaagtatattacttagaaacaaattgaaaatttatactagttgacatcaaggaagttttattacagtataaattaaattacctatatagactctagaatcccccttaggccaaaaggacatgcagtaacttgtagccacacaacctctaacaaatagcatgcatttagcatcagcctaagtatattcagcacaatgcgccatctacctaagtggcatgaaaaaaatgtatattcagcactcaaaggcagaatatcagatccttgtatcctcaaattcagatcaacacatggccaccaactttcagttaatctcaaacagaagagcagctagttcgaccaacacagtttcagattatatatgtgtgtttatttaaaatccaagatatatacaacttaatgtattacaagttgcagaagtacaaatcattatatgcccagaattttctctattacagattcctaaaattcaatatgagttacagttaacttctcggaataatcatcacaaagaactaataatctaaaacatgatattcgttagaaaaatcatttcagtgtcagtagtacaactgaaagtggcaaagaaggcttttgacacaaagagggactagcaagaataacaatgccttgaaacaatattcgttcctctgcatatacttcttatttaagagaatcctatgatctctctatacaagcttatacattatattcaatgtctaatctaatcctaatagctttttacaagtttgtactgtgaatcggcaaacaaataagcaatccctagctggatcaacaatttcaacatgtgataaagatttgcttcattcagatgttagcagagcaatctaatctgctgcaccgaaaccaagaacaaaaatagcaatgcctgtagcaaagaaaacaaaccttggttgcagaaaccgacttgcagagaaagggttgcacggtgctgtggatctcgaacaggaggcggaggcgacggaggacggcggcgcggtgccggatcttgaccgggaggcggaggaccgacagctggtggaggcgtacgacgcgccggcggacggggtggcgcgatctggatgggaaggacggagcgtcggcgctcgcggacagggatcgggacagcaacggaggatcgcgacggggagggagaggaggaggcggaagcggagggggagagggcggcgcaaggcggcggcgggcggtggccgccgatccagtcgccgagctcctaccgccgtgggttctcccataaagaagacccttttttactgcccatgggctgaaccccattctgagctacagtgtccagcccatcgtaaccctcattttatatggcccaacccaaccctgcccttatccctcctataacccatacaagacacaccattttcaacccattactgtttcaacccgtacaacccatgggttggccagcccattaccaggcttagctgcagtagagtagccaaacatgtttgtcctataaaaaaatattctatctataataatctaccaaaataaatggtcttcatttgcagtaacataattactttttatcgaggatggaatcgtctattcccttcatattgtaagatttctttcaagttctattctaataagtcaaaacatttttaactttgaccaaatctatagcatccagatatttacagtaacaaacatattcattgtcggtacataatttatggaggatttaacgaaaccaagtcaatgttgttataagttactccctccgtttcaggttataagactttttaacattgcatacattcatatagatgttaatgtgtgtgtctagattcattaacatatatatgaatgtgggtaatgctagaaactcttataatatgaaacggaggaagtagatagttttgatttttgatgaaactaaagtgcgcgattgcgatttactgcaacggagggataattttaacttataataaaattaaagtgatttacaacataaaatgaattaaggggagtatttaaatacctcggcggcacgggaaacgagggtacgtgatgttgctaaagaggaggttgatgatggggaaagatgggaggccagtttactaaacacgaagcgcccgaccattgttgccaatcgatcaatctgtggtgaactcggcttcgaaattctcgagaaatcgatcggattggatgaaaagggtcagcttggctcttcttatatgaaggaagggatcgatcaccttttgaaccacacacgaaattgaagctgaatacggaaacatattaggataaggatatgtatttgtgatccgttttctgagcagaaagtggggggctgctagctggcatgagcgtgccagcagcgagcacttccctcccataactactatatattagttaacacttaacactaatgatgggtaattaggaagattctcaagatttttctttcttttttcgggagatttttttactaacagattgaaaatttttaagtcagatttgaaaactttcgatttaagatttaaattttaaagtcaaattttgaaaactttcaactcggatttgaaaattttcagctcgaaatttgaaaactttcaactcagattcaaaaactttcaactcgagattcgaaaactttcaagtccatatttgaaaaatttgaaaacttttaacttgagattttaaaattttcaactcgagatttgaaaactttcaacttgagatttgaaaattttcaactcaagatttgaaaactttcaacacaagatttgaatactttcaagtctagatttgaaatacttgaaaactttctacttgagatttgaaaattttcaactcgagatttgaaaactttcaagtccaaatttgaaaattttaaagttgagatttaaaaattactagtaaactattcactagtaaaaataggaaactagtctaaactaattacgattttttctctaatccatacggcaggaacagcgaacagcgaaaaaaaagaagaaacggcggtgtcaaaaaaaaaaggaaaaaagcggcggtgtcaaaaaaaaaagaaaaaagagagaagaagcgcgcgtgtgtaggccttgtgggccggaaatacgcaatggcaacgcgcgttcgccaattagcattcgcacataaagcgtccaaattcccaaatctgcatggctaaagaaccttttgctttcagataatcaaaactaattacgagaaaactacctttcatcactgggtcctaatattcattctaactttctaaggtactccctactcggttcattttattttttt

SEQ ID NO: 17794 - DNA, 916 bp, Oryza sativa
  unsure (1)..(916): unsure at all n locations
nnnnnnnnnnnnnnnnnnnnnnnnnnnnnnnnnnnnnnnnnnnnnnnnnncaatctcagcgaatcgatcagagcgagacctaatagaatttttttaacgactagcaccaaagacagcgaagttcaaactgatagagcagaaaaaaaaatacatgattacaactctggaaggtcgtaaccgggaaaacgaaaaaattaaccaccgcccacgcaccgacaacgccaatacatagacctaggagaaggctagcaccggaccggccgccgttaagcgtggccagggccgaccaccgctaggccaacaaagaaactacagccgggaacgcccgaaacccaccctaaaaaccagcaccaaaactccgctctagccacatttttaagattgaggagagggtgagagagaagatgaaactgctctccctctaggccttccaatgtgaccaacttgtataagctaggacgccgacgcaaaaggacaaacatctagagcgagcatgtaccaattgcttgggaggttttagcaaggggctgccaagacgatgtctacagggagtgaagcgacggtggtactgtcgctgccgtctgtcgaggtctcaaagagaaccaagactaggttttcatccgttagcccacaagaggagggggacatcacgacaatgccctcaggagggaaaacgacgcccgaagcgtcgtcattgtcagcccagctaagaccgggcgcaggttatcacccgcagccctcccctgccaatccatagctattgctttgatgctccaccaccgaccatcctctgccggcacgtgggcaaagctacatcgacgtcctccacgggccagcctcctgcgtactgccacacggccaannnnnnnnnnnnnnnnnnnnnnnnnnnnnnnnnnnnnnnnnnnnnnnnnnnnnn

SEQ ID NO: 17795 - DNA, 280 bp, Oryza sativa
agttatctctctaagtttatatgcatctagtatatattagcaacagagcttagttgcagcttcacccacccaattgttttttttctatattttgctatgtaattgatgtccattttcatgtatgatgaagttatattcaacggccaatttcatattcgccactagttgaccaggtattgcgaacctgtcattaagggtgcgtttggttgcaaggatggggtgggatgggatggaacgaacccacttttggggttgtttggttgaggggtgagtgggatgg

SEQ ID NO: 17796 - DNA, 976 bp, Oryza sativa
  unsure (1)..(976): unsure at all n locations
acatggcacctaaatcaaaacaaataatataaaaccttatgagctccacataatagtgaaaacaacattttcttcctcctttactctcctctcttccccatctctatccaaatctccagtgtgcgaccaagagaaaggcgaccgacagggagaagggtgcatgacaaccaacagagaggagctgggtggcagcagccgtgtcaccaagctcgacccgcagggaggtccagggatctcctctctcgcctcaccgccacgggcctcctccgctcccgccgcccgtcctccgtggagtcaccatctactacatttttgtgaggaggcaggaggcatgcacagtgtcaccgtccttactctgtatccctgacgctgccatgacctaatcgaaccagccctggtcgaacctctcccatgtccacttggggtaccactcctggctctccatcgggtgctaggtctcgaggtcgcaccaccactcgaggatctcgaacaccaacatgctgaatagctgaagctgtacacgttgcacttatgtgtcactggcaacaatagctacagctctagcgccacgtagccccgcgtgccccgcacgccggtcatcgtcaggtgggtattgtcacggttgcagagcttggcaagccttgatgttagcaccctttgctccaattcaaatagcaaacatatatgcttcaacactcaaatatttggaggaacaaaagaagaaatgggggatacaagttgctagtaacacaggaaggaggaggaggaggaagaagagaagtagatcaacgagggatgcccaccggccgcccaggtcaccgccgccgccgtgagcctcagctcgccaaattgatcaatcgatgcccccatgttttctgttgctgctcatatatgctggtagtggtgcttgcttgggcctnnnnnnnnnnnnnnnnnnnnnnnnnnnnnnnnnnnnnnnnnnnnnnnnnnnnnnnnn

SEQ ID NO: 17797 - DNA, 732 bp, Oryza sativa
aaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtaaggagctaccaatgaagagtgttgcagaacagtgaaatgggctttacggaataaattgttgtctaccgtcataattgctttccttccgagagttccctttccccgtagtctcccttcatggcgtgattccggtaccccgattgggcgaaggtcttcgataaattctacgcaaaattcgatgacctcctctgttccataacccttggcgatgcttgcctctggacgagcacggtta

SEQ ID NO: 17798 - DNA, 431 bp, Oryza sativa
cgggttctccaagatcttcactcctgcttcacagctggcttcactgcttcctccacttcgctagcggatcctgcagtcttccggagcttcggcaaacaactgatgatgtcttcttcttcactgacctgaccatctagtactagttgaagtccgaagaaggaagaaaggagttaaccttttgcaaatagcattgggggaaggagaaaaaaggaacaaatagttttatttataaaatatgtccttaggttttatccacttggcttatcctacagtcgagatggctctgataccagcttgtcgcgaccgggaaaattgcttttcccgaacgctagtgtattaatccccgtcccaagaaaagccggggtacaccatacaaacatgatataaaagacacatctttattacatcgataatatttacatttatacaaa

SEQ ID NO: 17799 - DNA, 752 bp, Oryza sativa
  unsure (1)..(752): unsure at all n locations
gtagagcaaggtttccgagaaaatgattgctgccatcagggcaatcaccgtcatcctcaagggtgcatcatctccaacaccaatggcaccaccccttccagtgcacaccaactgtttgatggaatgccccaatgatagtagctcgagcacaatatcgagatccatctacatcaacgaggggactgctccgactgtcatcctggagcatgaggatggtgagggcaaggatcacatgcccttcattgtcatcaaggaccttcctgagttcacgcccactatgtgttcgatgatatgttctagctccgacaccaagcctgatctcactgtggctgttgtggttacttgtgccacttctgtggagtcatcaatggagatggtagctactggcagcaccaccgacgacacccacatcgacacccttgatagtaccaaggtgatgcccgccagctgttcgacggttggccttgatgtcaagggtggcgcagaccataccagggtcacgtgtcggaccatgatgggtgtgcccgagggcgttctagtacctgatgcatcatccaaagtcttctcgccatggttgatggctgaaatggatcttattccattgctgcccactgggtgttcgatgaaatgtcccaaagacaagaagctgctaatggggaatgctaagagaaattcatggccaccggttgggtggagtnnnnnnnnnnnnnnnnnnnnnnnnnnnnnnnnnnnnnnnnnnnnnnnnnnnnnnn

SEQ ID NO: 17800 - DNA, 1187 bp, Oryza sativa
aaaatgaaagtgacaagtcagatccccttatcaatgaaaagaaagaaaagaggcataagtacttgatgctgcttgcaattcttgctgcatccattgcttaccaagctggtctgaacccacccgggggtttctggtcagaggacagtcgtgatggctacaaggctggcaacccgctccttaaggacatacactccagacgctatatggtgttctatgtttctaattccatctctttcatggcatctattgctgtaatcatgcttctgctgagtaaatctgtgagaaagaataaggttccactccaagcattgttgttgatcatgatactagacctgttggctctgatgacagcttatgcagctggaagctgcagaaaggtcagacatcaatatttgtcttcttggtagtatgcggggtggtgctataccttatgattgtaattattttattgagtggtatcgcaaaatggctgaaagaaaggaaaggtaggtggcctctgtgctggagaataacaaggagtaacaaaataacaaggagctgagcagattgttggaacaatgttttcaaattccttgatcatttggttcaagaaatcaaaaggacagtaataggtggaggtagactgtgtcttgtatcacatataagttctcttaagtcattttgaatagttcagtgtgcttgtcatttcgttttagttgtttcccaagtttggctagggggcagtagtcgcacatgttctcaattgtctgccccattcttttacttcttaatgctatgatgtgcgaacgtcttgcaggttgttgaaaaaaaaaactcctttttgccactgttgtgatgtctttgtattttagatgaaaatcatgtctttggtttttgttcaggactacaggatatgatgttctttgttgctgaacaaaatattcaacatttttcatttagggagataagattccagacgcagcagccttttttattcttctccttggttgaatatgattagaattttgatcatgtttagttgtatgtaactgattggtttcatgaggagatgaataatgcttgaaacatgcgaattttcttttcgttcgttataatacaggtggctgttcacatgaaaatgaattggacagttttgcatgaataggtttggggaaacatctcgttggttttatctcaggattgggtta

SEQ ID NO: 17801 - DNA, 15359 bp, Oryza sativa
ccttggttgaatatgattagaattttgatcatgtttagttgtatgtaactgattggtttcatgaggagatgaataatgcttgaaacatgcgaattttcttttcgttcgttataatacaggtggctgttcacatgaaaatgaattggacagttttgcatgaataggtttggggaaacatctcgttggttttatctcaggattgggttaagtcgtattttggtccttgaaatcttcttgaagtccacttttcacccttaactaaaaacaccatttgttgttgaccctcaacggttaacattcaaaaccgggtaaatcacaccctaaaccatattccaaggtggctttgattggcatgatagtaagcatgtacaccaattaagtttcatttcattgatgtgaacttatctaagtgtcatctatgtctggaaaatatgtataataggagttggcacttgtgaaaaccacctttgttttaaacaaaaccactataaaataggccttaaggtggtgtttgtccagttttgaaacttgaggctgaaaaacaactggtcttttagttgagatcgaaaaatgaattttgagaagggttcaaaagacaaaatggaattttcccgccaagatttctccatccattttgacacccccaatagaaaaggcaactgatgtacatcttggggagaatggcatcaccaggttctgcaatttgtgataacaaaatcttcactagttcccttctattccagttgatattaagctttggttatttagtgctatatatatattgctgccagtcaagttgcattaagcttttgcatcgactatgtagttttatgcagagcatacatatgtggtactggcacatatcctgattcccttctttacctgtgatatttaagataaggaaagtgaaggaaaacgattgtagctgtgttgactttctgcacttctccaggtacttattttgtgactttgccgctatggttcactgatactgcgatacgcttttttttttctgtattcagaaccttatcaagttctgcaatcccaaacgcaagaggatctctgagggtagcaaaaagaaaaggaacatgggatggtatagatgcacataactcgcatcaggtaaatcatttttaattattaattcctgtcctagagaaaatcctgtgtctatctttgaattccctatcttttttttttttctaatttgtaacatgctgtttactcaggacatagcaaaatactgtaaatggtcctgttctcaaagaatgctgccctagtgttccgtgtgcactgtaagtaaagttactgcagtgctgagatattgaagagcttcaatggtaccatcactccatcagaaacagtaagaaactcttccatccatgtgacatgttctattattctgtaccctatgcattttgtcatatagggcctgttgtattcacaggatcgaattctttacgcgggtaatttgatataaaacattagaatgacctcatttggtgggggtgcctaaggggattgaattacttgtgtttatcaaaagggattgttagcccttcactcttggcagattctctctgggaacagagtttggcacaattagctacatggatagttagacattgacacaggctacaaaacaacagttcctactgaaatcatcgatgcaccccaatctttagctgttttgtcataataaagcatagtgttgggaataactagagtgaaactcgaatcaatagtgctaatctgagatagatttaagccacatgcacacctgatggcctaaaaatgtgggtggctgttaacaactgagtcagaataaagctctgatgatagcatcatgggtataaagtggcgactatgggagttagtagacttcactattttcctttacctttctttgatataaaccttcatatgtagtcatatatcagggttgctgcatgttagatagaacacactgaaaatccaactcatcttgagttaaagctagagttcagcctggagtctggacacaatatttttcttttcttttctgtaatactagctctcacttcggttcatggaacatgttcctgcatcgacattcattgaatgaatgcaaaaggtcatactgatggttgctatagcaacacgagaatttgtataggcaatgtaccccagattctttataccaagcacgtttttcttttctaggtaaatttggatggacatattgaaattggaggcctctacaattgtactacctccttttcaagttataagactttctagcattgcctacattcatatagatatacatgtctagattcattaacatatatatgaatgtgaacaatgctagaaagtcttataatatgaaacggagaaagtagcattaccctaaagaaagctttttacccccaaagctttgaaggtccccacaataatctttctttcactcatatcccaaagccaaactctgtggtcacgtggctgttttactcttctctcaaagtaatcttcacagaatcacagccccatatggttacaagcaaaacgagtcaatctcacatgcagacgccaaagcgtatactgctaatcttcagacagcaatgacaagtagattcagcgaaaatgggaatatcttttagtaactgatactgattcagatatatcaaatatggcaggcatgattttcgagagagggcataagctggagatcaagaggatgcatgtatatgaagatctgtgtaagaataagatgatgggccatagacccttacactcgaactgctggaggctccctgcatttgccgtccatgattgtgatgtccaaccttctgcatggcaaattggtgagcgattctgaggatcaatctggtccaacttactggaccgtcgcttgtcgggaggcatcttgcgtatctttttttttttttgaaaggaatcagcacgagattgtgctatttcattagatataggcgtaaaaaaatacaacccctaggggcaaaaaaaagagctgtacaaaattacataagcgctatgattaagttggtaggaattctccaagtcgccttgcgcctgccattatccaggttcttgcctcttcctttatttttgccataaggttgggggctgccgtttccttgtgctcgaagatcctttggttcctttctttccagatttcctaggctatgagtaggattaaggatcgcagccctttcttgggcacttcccttttgttggctagcatttcccaccattcgtgtacgctttggcatggctcccaattgctgataagccacccagttggccgtcagtctccagatccttctggtgtatctacaggaagctaaaaggtggcataccgtctcgttcgtcatacggcatagggggcacactccgctatttggccatcctcttgtagctagtcgatcggaagtccaaactctattttgaatcacaagccacgcataaaatttgcattttgcaggggcccaagatttccaaattaggggattgaagttggtgccgactgttcctagacactgagccttgtatgccgaagaggccgagtattctccatgattcgagagcttccagacgatgtgatccgactcattttggtttagcatgatgtcctgggttgcgctccatagggacacaagctggctgatcagctccagtgtaaaagtagtgttcccatttagctccaggtcatcgatgcaggtgtcattttcaatgccttcacgtagcgatttgcttcttttcttggaaatagcatagacgagcggcatgttgtcctttggtctttgcccgtccagccaggcggactcccaaaagtagatcgtgtttccatcccctattgttattttggtagctgcagcgaagagaagtttgtccgtttcatcacacggtgtctctagtcccacccacggcttggtggggtctttccattcatgccagagccatctcagtcgcaaggccctcgtaaacatctccatgttcagaacccctagtcctcctagtgcggttgggaggcacgtccttttccagttcaccttgcatttccctcctgtaatgtcccccgtccctacccagaggaattttcttctctttgcatctagaacgcccaaggcttccttagagatcttgagggcagtgagcaaatagataggctgcgcagtcagtaccgacttgactagagttgatcgccctgctggcctgatgttttttcccctccagccggtgacccggtttgctattttatcaaagatcggttggacgtccgtcttgcgcagccttccaagcagaagcggtagtcctaagtattttatggggaattgggcccgtaacgctgggacgccctcaagaatggagtctagatcaatgcttgcacatctgattgccgccacctgcgatttttgcatgtttgtgaccaatcctgtcgcacgtccaaaacgcacgagaatgtcggtgaaagcctggacatcctctctaacagggtttatgaaaaccactgcgtcatcagcgtacatggagattctaaggcgagccgctctgcctcttagcttggttatggcgtttagttccgttgctttggagaggatccattgtagggggtcaattgccaatatgaagtgaagcggtgatagcgggtccccttgtctgagtcctctgccatgtgctatcttttctcctggtatcccgttgagtagtacttgcgaggtggaggtagtgagtatggccgtcacccagtctctccatttctgcgggaacccatgatgttgcatcatggctaaaaggtaatcccaacgcaccgaatcgaaggctttggttatgtcaagcttgaagagaagcattggccgccttgttctatggtatcttcttgccaaatttctaacatagaggaagttgtcgtggatgctcctgcctttgatgaaggcgctttgattgactgtgacgagggttcgcatgtgtaatcgtagtcgcaaagccaaggttttggagaggatctttgctatactgtggattaggctaatgggcctgtagtccgtcacctcatccgcgccttccttttttggaatcaggacgatgttagctgagttcaggaggttcatgttcgcacatctcagattattaagcgattcgaagaccgccataatgtcccccttgataatgtcccagcaaactttaaagaagttccccgtgtagccatctggccctggtgccttgtcagctggcatctccttgattgcccgatgaatctcctgttccgtgaaaggatcgtccagatgcgagaggtccgtcgttggggcatgcaaggcttgccagttaatatcgcatgttctcggttctggcctactcatcatcctagaaaagtgttcgaagataacatcatctttgtcttggtggctcaccgcccagccacctccactgcgaagtctttggatgtaattctttcttcttcgagcattgactttgaggtggaaaaattttgtatttgcatctccctccttgatgtgcattacgcgggaagcttgcctcttccttgcgcgttcaagcgttgccagaccaagtaggcggcgtttaagtcctgctctcagccagtgctctagcgttgtgagctctctttgctcctgtgcggagtctagccgctgtatgacgtcaagcgccatgtggaattggattttcgcctcagtgcagattcccctggaccactctcgcagactttttccggtaatttgcagcttatgatttaaccgatgcatgggttctgtgtgagtcgtctgcttgctccaagccgccgcaacaacgtccttgaatcctggtatccttgtctaaaaattctcgaacttgaagggacgtggtttccgtggccctgaagtattggaaaggagtagcggacagtggtcagaagggcctgatggtagagcatttaggatgtgctgggggaaagctaggtcccaagcctcgttacaaaagcatcggtccagtttcaccatgatcggccgtcgcctctcattactccaagtgaactttctgttctgtaagtggatttcttttagctcacaatggtcaagggctaagcggaagcgggtcatacgcgcaaggttaatgttcccattgctcttgtctctagccctgtaaatcatgttgaaatctcccaggagcagccagctctctcccgagtatggcttgagtcttcttatatgccgaaggaaggcatcttttagacggtgccttgtaggcccatatactccggttagcatgaaggtagtgtttgattggatgactttgacatctgctgagatagagaagcgaccgtctcggacgttttgcacatttaatgtgtcactgtcccaaagtagcaggattcctccctttgtccctctagctggtttgaagtcgaagcgatccagtttgtatcctcctagaacctggcgagtgaatcatccatgttttggagtttcgtttcctgaaaacatgccatgttgcatttcgtgtccagcacgagctcatgcaccgtgttgcaccgcgcagcggaattcaacccccgcacattccagttagggagtacctatacatctttcgaaagatttttataatcgtatcacacagatttttaatctttgtattaaaatccgatagatataataaaaagcaaaaagcaattaagaaacaccataatgaacattaaattaccatatcctcaagaaaaagaccaaatcaaatacaaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgttccagttaactatttgcaagttttgtgacatttggaatgatggttgcctcactgattctgctcggcccaaacagccagagtttggtccagcttaaaagggcccaacttgctagaagtgatggccatgtggtttcccggcccaacccgcaaggcccatggggcacggtggcgcagtactcgtgtaagtgcgaaggtgggctttgtgttgggccggtggcattagaggaggagtaggaaggcttttttcctttttctagcggcccatgcactctgtcgtcgtagattttttggcgatgcactcggtcgtcgtcgttttggcgatcgctgaggccgttgatgccctgagtgcactgcctcgttaccacgctcttttcgtgattccgcgtcgtagaaatcacagttgaaaacgaagaatgtaggagattcaaatcaggcttatgccctggaaaataattcgtgctactccctccgtttcatattagaagtcgtttgatttttttcttagttaaatttctttaaggttgaccaaatttatagaaaaacataatagtatttttaacacaaaacaaacatattacgaaaatatattcaatgttaaattaaatgacactaattttatatgagtaaatttcataaaactgtaattttagtgacaaaactatcaatttgctgcaacattagtggcatgtttcagtttgctgcaacaatagcttgagaaattatcataaaactgtaaattttacgttatatgctgttacaatacatataggtgacaactatagcagcatataatgtaaaagttatatgttgctacaatacatataggtgacaactatagtagcatataacgtaaaagttgcagttttctgaaacatactcattttatattttagatgttaaatttttctataaattttgtcaaacttaacaaaatttgactaggaaaaaagtcaaacgtcttataatatgaaacggagggagtataattcttgtatcttccactgcaggtgggcattcgcatcaacacacacctacaatcgtcaatcactcgtgtaagtcttagttcggtagtgagttttggtttggctactccctcttttaccactttaccatgagcatgtttttcaaactggtaaggtatatttttaataatttttataagtttctttaaaatattaaataaacccatatttcaagtttataataattattaataccgaattaagtatgccgcagaaaatctccatcaaagcaaattccgaactcagccttagactcatttttttttactagaaagactaccagggctttgtctagtagtatattttcattgaaaaaagaaactatatatgtacaaagaaaaccaaagttacaagggccaaaaaaggattataaaggttgtaaccaatcaaaaaactaattgctctaaaggctccttcattctgcacatatgcagaagaatttcattcttgaagaggcttctccatgactgaaaaagagggcacaacattctgaaagataaacctatttctctgtttccagatgtgccaagaggcaataaaaaaaatttccaagaaacccattctggcaaagttcaaccttgatagaacaatcatttgaaagaactccatgtgctgattccaagtgatacccagatgtcgccaacatctaacactgaaagggcgggtgaagaagagatgaagcccggtttctctttgacccccattacacaggacacaagttaaatcagcattctcctttgcacaatgccttctgtcaagcatatccgtggtatttagcatgtcactgaaaagaagccaagcaaacaccttaattttcataacacactttgacttccatagccaaatatagggtcttgggggctgaaggggcataaaattgagcttgtaaaatctcttagaattgtatgtacccgaattccaaataaagctccagctatctccttgtcctggctacaaatgcaaaagactgagctcttcttccatcaataggaattcttcataggcctgcactgacagaggaagaagaaaagaatcttccagtggtcttgagcacatgcctaagactcatttttgtgtgggcttcctaatttttatatgggaaattggttaattagtatatttttttcaatatgctctattgttacactgataataatacatatggtaaatactccgacggaccaccgtaaaatactacttcctcggtttcacgacgtaagacttcctagcgttatctacattcatgctatgaatctatttgaatgtggacaatgtcgtagacaatgctagtgcctactaggaagtgttatagtgtgaaacggaggaagtattagttatatacacatgttttcattatttttaagaacttggctctgcttttactgaattctattctttttgcctttttggaaagtagtaagtatttcagtttatacattagtgctccaaaattctttttaaccaaaatttcgatgcggaaaatggctacttcgtcccttctttctccttccttgtcccttgtactgatcttaaaatgatggtgtaaattttacatatatggtgtcggacattattcctgcattgatggctgctgatatgggccatcggagtgcactgatagcgaatacggaacttctatctgacctgcccacatttatggatacaataactctgcacgtttgaattttgaattttttaggcgaagtttgatctctgcatttttcagatttttttggactcgtttgaatcttggcatcgtttgagcagctagtacgtacgttggcttccgtgcatcagagatgagaatccaagccataaagaagccatgaatgctcctgaatgagagagaactgtgctggagtacttcatccataggagtacggccaaaatagggttcaaaagattcgagaaaagacagcaaattttttacgtttagcctgctaaatcctgaccatgtccggacaaatttatcccggcagtatttacacagagcttcttttggctcattagctgtgctttacttaggtggtgtttggatccagagacttaactttagtccctctatttaaacactaatttagagtattaaatatagactacttacaaaactaattacataaataaaaactaattcacgtgacaaattttttaaggctaattaatccataattagagaatgtttactgtagcatcacataggctaatcatggattaattaggctcaatagatccgtctcgcgaattagtccaagattatggatgggttttattaatagtctacgtttaatatttataattaattttcaaacatccgatgtgatagggacttaaaagttttagtcccatctaaacagggccttaggcccctcacagtggcttagtcatgccacgtaggttttttgccgccgtggagggagggaccgcgccttagctaggttcgtcgtcccctaccttagcgacgcaaagcctcgccaaaacgagggcgcgcagcgaggagaaaaggcgggtcacgcacgctgtgggcggcgcagcctcgtgctcgcgtggcctagcgcccaaaatcccctcacgcggcagcaaaattcctgattcaccctcccaaaatcccctcccgccacaacattctttctcccgccacagatcggattgatagataagcaataaaatcttgaagattggaagagaagaacagatcggattcaacaagatgaaaacgaaaacgaaagcaaaatcatcacaacaagattcaacagatcggactcctcctgcaacaccacccccgcctgctccgattccgacgacgaggaggacgacggcgaggtggggagcgacgctgatggcggaggacttgccgctccccccgccggcaagaacccccccccgctcgacaagaaccccgcgccgctcgccgggactcctcccctcctcctcgccgccgccaagaacccgccgccaagaactcgccgccgctcgccaagaaccggcacgggagacatggaggtgaggaggcacagcagcacgggaggcgaggaggaccagctcaccggtgctccagatccggccgccgccgccaagaaccgcctaccgcccgccaagaaccggcacgggaggtggcgaggtcagccgttggcgtcgaactagacgaggccagccgccgccgacggagtccgtcccgctcgaggtcgccgcggccggagagatgccgagctccaccgccaacaccgccgcggataagctacggcggcggtggacggagacgacgcgggagggtgccttggccgccgctgcttgaggtcgccgcggtggaggaggcgcggcgaggcgcgcgtgagacggtgcggtcgacggggaggaggcagcgaggtcgacggggaggaggcggcgctgtcgaggagaaggaggcgaagaggcgtgggagggaggagaagaaggggcggcgcggctgagagaaagagaagggtaggtgaggaattaaatttccttcacctgctagtgccccatgtgctagggtatgcccactgtagactttgtatccttcaacagtagcttcatctcgttaggtcactcaaaagaagatacctgcactgtaggcttgagtgtctttaggtcacttttttaggctaagcccccttattgcgtgtcttgcactgtgagaggccttattgataccggaagttttaactttttacccaaagcttcaaatagaatgtacaagcactgcaactaacccggaatcgtctgcaaatactcacaaatatttgcatctgaaaacagttacagtgactgtacaactattgatactggagagtcgtgtacgttgcacaaccgtcatatacattattgtatcgttccaactaattggttgagccgtaccgttccaactagaaaaatgacgtttcatatactccattgaattaggcgtctacttgatttgtctcaaataatcgtggaaatttttaagtggggtcagcataatttacacacatggctttcccaccatttttggggcctttattccaacaaaatagggaatgatattctattatgagatgtttacatcataaaatactagtatcaattacttgatttttttaagataatgaaattactctatcttaaatctgtagtttcatatcaattcaatgtgaactactatgtagttttagttttgtaatatggtgccttaagtatgtagtctttcaatttctaatactcaatcttaaatatgtaattatgtgataagtttatagctaaatctgtaattatgtgttatatcgtcaagtttgtagttttgtgataatttaatagaaataatctacaattttacaatatttactcaaaattttctaatgcttcccctttttctcggtaagatctaatccaaccttacgagtgaaaggaaatcattttaaaaagaaataaaaaagcatgaagtgcttactattatcagaaagaactagaatagtatttatactcctttaaaaataccaatgatattggtgaatggtaaatctgccaccactcactaccaatactatgtaagtctccccaaatagtgagataggtggacttttatcactttctcaacctcaacccaataaacaagaaaattttcttttgaagtgaggaaaaatgatgacaaataatatgatctgaagattttacaataagaataattttagtttttaggctttagagtgtacggcggggttctcctttttaaatgccattgcaacacaagagcattcaactagtttatgttaaagaaaggagatcaaaagaagagaaggttcagtaaaaacaaataatatatgcaactactatatacatatatgtaacaagtacttattgtcatgaattttacctgattataggtatttcttttaaccgaaccgacaacacaatgtgctaatttcattgaatatagtatgagaaaaatatatatatcaatatttaagagaaaaaaattataccggccggggttgtgaacactacggtaaaaaagctctgagaggtgtcttgcttcaccagttcagctcgggtccaggttctagcccatttagggccatttttctttggtgccaattcttcccctactaatcctttggtagttttgaataatgcatgttagcattttggattgaagccaatttttgccaaatcaatagagtggagctaaatctatactattaaaaatttggtagtgtcaaaatttgctcaaggtttgatactaccaatattttggtagattttcgaaccaaacatgcccttatttttgctcccaaggttaaagtggatagtttcttgtatggaagcagggcggccatgtcattcggggggacaaatccgcgaggagatcacatcaaggccctccacatcaaccaccaaatatactaggcagaatcattgcgatcttagaacgaatccacatcaaatgccagtgaaaagatcagttctttctcatccactgatctctcgtagtcgtagtggtagcagcgtaggagtagtatttccatttcgatcccttctcttgtagattcaggcgtgtttaattttaggggtgaaaagttttggcttgtcggatatacgaacatacatttgaagcgttaaacgtagactactaacaaaacaaattaaagattctacctgtaaactgcgagacgaatttattaagccctaattgatccgtcattagcaattgtatactgtagcaccatattgtcaaattatggagcaattaggcttaaaagattcgtctcgcaatttacacgcaatcggttgtaattagtttttttcctatatttaatactctatgtatgtgtccaaacattcagtgtgacagggtgaaaagtttttgcgtgggaactaatcagggcctcagtctcttcttgtttcgtgttgtttatttctctgctgtttttcttgggatgtgattttggctctgtttagattccaccttataatttttcaccttatcatatcaaacggttgaacaactgcatgaagtattaaatatagacttaaaaaataactaattgcacaaattgtgactaatttacgagactaatcttttaagcttaattgtttcatgatttgacaatgtagtgctacaataaacatttactaatgatggattatttatgcttaataaattcgtctcgcggttcactgatggattctataattagtttttctattagcgtccgaacactctatacgacaccctatataacacccgatatgacacgccaaaactttacgcgcctgatctatacacccccttagcctctctgcaaatttgcctttttccctttctttctttttatgttttgtccgatgaacgcgaggttccatggctgcgtctgcattcctgcagaaaaggatgaaaggaggcatcttgcttttggccgttcttggtggtattcttgctttcctctcggctttctgcgagaaagtttgcgttttgatgtgactggtggttgtataatatcagcagcagcagccattgcaatgacttgctgctctcaaactttggaagattataatttgatatttcagaaaatttttaaccaaatttggaaagttcatcacggggtatttcggtcattaggataaaattgtacaatagcactaatggagcctaactgaatgacgatggtatattatagaagttaaacaaaatacgatggcatattgtagaacttgacaaactcattgatacattaatataatatagaatatggccaaaatcagtggcatacaacaaattctctactccctccgtactataatataaaataaaagattttaggtgaatgtgttatattatgggatggagggcgtatttcttatggttgttcactaaactacccatctactatggtgccacatttttttaaaaaagataaatcttatactataagtccatatcttacatattaaattacatacacttaaaatattttagataaatatagaaaaaagatttatttatccatttaattatgggaaaaaatattagtctaaattaacatatatgtaaaaactaatatgaaagaattagaaaaataccatataaatactgatacttatcatatatcatgcattgagaaaagaagaccataattgaatgtttttattgagcaaaatgatggtattatttttatctttttagttggatctatctaaccataattaatcaacctatattagcaaaagtctgtatcgtcattcaataacatatcataacattattagtaataattgagtagaccggcccacccacactgtgcagagacgataaaactgtagttggcttagcatagcatgagattatcggctaatggacaacccactttattaattgctctagagaaaaaaaataaattaccgtttgtacttatatcatcctttaaccattcttttcatttacactacag

SEQ ID NO: 17802 - DNA, 1172 bp, Oryza sativa
  unsure (1)..(1172): unsure at all n locations
nnnnnnnnnnnnnnnnnnnnnnnnnnnnnnnnnnnnnnatagggtatttacaaacttgtggctaactattacagtagaagctatacgatgactcaactctagtgttttgctatagacttaaactatctatctaatctatatttgagaattaagttagaatgagactaacttatgattgaactcccggcttcggcaagaactccaaaatgactctggaaaagggggttgaagcaagggtgagtacaacgtactcagcaagctattatattcaataataaatgtatgaaatggtaatatttgagtagagctaggtttaattgcagaaagctgagaataaagaagtagaaatcctgaaatgtttgatatgcaacagtatttaatagagtttgaaattatgtttctaaccaagatgccattgtgagtcccaatgctcgataaccgcgagcacggctatttgaatagttttaataatattcatactgcagtagatgtacgctttacccgcaatccatgacgtgccaaacacattagccttgtcatggcaaagcttttcggttactaacatcagtggtacctgttccatgaactctagtccccatgcgctctgaacgtaacgttatcagcagcaagaggagttctggcgttcccggggttttcagagagaactggttgagagacccccgtcatctcaatcaggttttcataattcacacacagctcgcgagataatcaagatatttacctgcgcctcggtaaatatcataatcgccctgctcggcgtaagtttgcctcctgcgcgaggacttaagaagaaccactatacagaggtaccacctttgctagataacttaatcagctaggtctatgcccatacgagaattgtggtcgtactcgtatgttcttcacatgtacttggcagttttatgtcggttggaacagtactagccacccggaaatcaaccatttctaccgtactgtcccaatctaagtttattatattttatgcaatctaactaggcatggctaagcaaaatctagcatatctggtttgctatgttcaggttatgcatttgaaatcatgtatgactaatgcatagaacagagatatagaatatagggtagttatgctcaaaggagaggaataataacttgccttgctccaacgcaaataa

SEQ ID NO: 17803 - DNA, 1548 bp, Oryza sativa
  unsure (1)..(1548): unsure at all n locations
gttttgccgggctttacaaccaatagtccaacgtcgaggatagtaaaccacacgaacgtccccgtggaaggcgtaaagttccaaccggcagcttttcagtggctaatgggtattttggggtaaaagaaaatatttgcaaaaggcaaatataaattcaaatgatatttgaataaattcaaataaaattataaaatagcaattaggcatcaaaatgaagcatttgaatttatatgaatttaggtccaagtttcactggaatcggatctacggtttaggagatatgggcttttaaagaataggatttgaattaaatctagaaaatatgaaaggttactattcatggggcccacctgtcagcctttctattctttttcttttctttctctctcctcctcttcttcctcccgtcactttctttcttctcctccttccagcccggtaacagaggggagagagagaatagggcgccgatgcactgatgatggaacggcctcgacggcggtggtaaagtgtgttcccgaacattgagaactcggggaggtatgtggaaggaagaggggaagaggtgagtggctggaacggcggcgacaaaagctcggccgcggcagtaaatagagtagcggtggtggtttgattcaaaagaaaagggaagggggaaaggggcaaaatggaatcacctcgacggggcggatttagtggcgcgaggatttggccgacaacgctccggtaagggagatcggtggacggccggccatggctagagagagannnnnnnnnnnnnnnnnnnnnnnnnnnnnnnnnnnnnnnnnnnnnnnngagagaaaagaggagagcttcaagctcggatgtcggggataaacagagggggttcctcctcttatataggcgatgaaaggcggttgtggaggcggtcgtcaactcggtcacggtgatgctagcgtgaaggaagaaaagacggcgccggcttgattccttagcggcgacgtttgcggcggcatttgcggcggcgtgcgcgtgtggaacacgcgcactgggaggaggagggaggcggctgggttgtgggctgacttgggccggctcggcttagctgggccggaagcccaagaggaaggaggaaaatagaaagaaaaaggattgggccaaaaggaagaaagaacggagtttcggcccgatgacaaaaagaaagaagtctaatttatatatttgatttggataactaggttttgcgaagaatttgaattcggagagaattcacaaaagagattttctaatttatttgagtgcaatatttagaggtggagtttgagggaatttatttggaagcactcaaatagaaaaggaaattaatagtattcctcaaaatatttttgggaatatggtaggaaaataggtggaggcaaaaggataggatttgaaccctaatatatatggcataggtttcaaggaattgtttgaggctaaaaggaaatttaggtgacaaggatataannnnnnnnnnnnnnnnnnnnnnnnnnnnnnnnnnnnnnnnnnnnnnnnnnnnnnnnnnnn

SEQ ID NO: 17804 - DNA, 5800 bp, Oryza sativa
tgaggaatttatttggaagcactcaaatagaaaaggaaattaatagtattcctcaaaatatttttgggaatatggtaggaaaataggtggaggcaaaaggataggatttgaaccctaatatatatggcataggtttcaaggaattgtttgaggctaaaaggaaatttaggtgacaaggatataatttattttcttagcacgagagcaattattcacaatatttgtaataataatattcttgtgccgagaaagaaatcaagccacaggaattaaattagcggctagatcaaaatgaagaatttagatatttggcgataaataagaataggccggtttggaatcaaaggataggtttaagatcaaaggacgggtcgacaattgaatccaattggaatcatttggtttaagttataggataatagtggagaatttattggaccataattcataaaaaatagaaaggggttttcaaactaaatttgaataaaagaatttttgtcaaaagaaggttttaaaccaaatcaagaaatacctcaatttaaccaaatatatattttaaaatgaaaaacacaaaagagattaaatactatagaggttttgtgcgagttagttttaggaggtccctctaattatactgtcctaagtttaggaggttattaaaaacataagaatcggcatgatgcaggattagaaaatgacacattttcaggatgttacatttatgccgctggagcagatgacaatgcgttggcaaactatttaccaaccgcgttgaagggttctgcacgttcgtggctgatgtatctcccccctactcaatttcttcgtggtcagacctgtggcagcagttcgtcgccaatttccaaggaacatacaagcgtcatgcgatcgaagacgatcttcacgcgttaacacataactcaggggaatctttgagggaatacgttcggcgctttaacgagtgcaggaacaccatccccgagatcaccgacgcttatgtaattcgcgcctttaagtttggtgtcagagatcgctacactacccaggagttggcaacaagacgcatcacaactactcgaagactattcgagatcgtggaaaggtgtgcccacgtggatgatgcactaaggcgcaagaacgacaagccgaagactgggggagagaagaaatcagctgcagacacatctgagtcaaacaagaagaaaaatcgcaaaaacgggaaaaggaaagctcaagcggaagtcctcgcagcagaatacgcgaaccctcccaagcacccggacccacaaggaagcgaaacaaagaaatcttggtgccccatacacaaaacagatagacattctctggaggattgccttgttttcaaaaagtcgcccgagaagcacatggcgtttgaaaaaggcaagcgagtacgcgttgtcgagaaaaacgaggagtcacctcctcacgaatcggacttcgcgtacccagactccgacctccatgtttcacacatcttcggcggctccatgacgtactcctccaagcgagaatacaagaaagtggaacgcgaagtttgttcgacatggcagggggctgcacccaggatgaagtggtctgagcagaagatggagttctcggaagcagaccatcccaaaacctcggttatcccgggacggtatccgatcgtggtcgaacccactattcggaacatcaaggtagcacgagttctcatcgacgggggcagctcgatcaaccttctttttgccaccactttggatgcaatgggaattccacaaagtgagctgacaccaactgatcaacccttccatggaattactccccaatcatcatccagacctttgggcaagattacgctgcctgtgacctttggccaagccaacaacttccgaacagagcagatcaccttcgatgtcgctgaattcgatacagcttacaacgccatcatcgggagaactgcacttgcgaagttcatggccgcatcccactacgcatatcaagtgctcaagatgccgggaccgaagggaacaatcactattcaagggaacgcaaagctggcggtgcagtgcaacaagcgaagcctcgacatggtcgagcaaacgcccactccacccgccatgtctgagccacccaagaaagtgagcaagccaaacaagacgccgaagccggacggcgccatcaagatcgttccgctctctagtgctaaccccgacaagactgtcaaaatcggggctacactagacgagaaataggaactcgcgctcatcgccttcctccgcgacaatgccgacgtgttcgcttggcaaccgtccgacatgccgggggtccccagggaggtgattgagcacaaactaatggtgcgacccgataccaagccagtaaaacaaagactgcggagatttgcaccagatcgaaaacaagccatacgagaagagctcgacaaacttctcaaagctggcttcatcagagaagtcctccatccagagtggctcgtcaacccagttatggtgcggaaagccaatggaaaatggagaatgtgcgtcgacttcacagacctcaacaaggcgtgccccaaggatcactttcctctccctcgaatagaccaactggtggattcgacacccggatgcgaactattaagcttcctcgacgcttactctggctacgaccaaattagcatggcgaaggaggacgaggaaaaaacaacgttcatcacactgttcggggtattttgctacgtcaagatgcccttcggattgataacagttgggaatactttccaacgcacggtccagggcgcacttagcaatcagcttggcaacaatgtcgaagcgtacgtcgacgacatcgttgtcaaaaccaagacaagcgactcattgattgatgacctccgggaaacgttcgacaacctccgacgatatcgcctcatgctcaatccagagaagtgcatgttcggagtaccgtcgggcaagctactcggattccttgtttctggcagaggaatagaggcaaatcccgagaagatcaaagcaatcgagaacatgaagtcgcccacaagactcaaggaggtacagaagctaaccggatgcatggcagcattaagcagattcgtcgctaggatggtagaacgaggacaaccttttttcgccttattgaagaaacaagacaaatttgtatggacacaggaagccgaagaggcatttattgcactcaagcgctacctatcaaacccccctgtactcgttgctccccaacctaatgaagaattattcctttatattgccgctacgccacactccgttagcactgtcattgtcgtcgagcgagagaaagtacagcgaccagtctattacgtcagcgaagctctccatgacgcaaagacaagatacccacagattcaaaaactgctctacatagtcattatgacatcaaggaagctacgccactacttccaagcccacagggtcacaattgtttcctccttccctcttggcgaagttgtcagaaacaaagacgttgtcggccgcatcgcgaaatgggtagtcgagctaagccaatttgatgtccacttcgtgccgcgaacagccattaaatctcaggtactcgccgatttcgtggccgattggaccatgccagataacaagtcagataaccaaggcgacaatgagacatggacaatggcgttcgatggtgcactcaatagccaaggagcaggcgctggatttatcttaacatctccatccggagatcaattcaaacacgcaatccaccttaacttcagagcaacgaataacactgcagaatacgaaggactacttgccgggatacgagatgcagccgcacttggcgccaagcgactaatcgtcaaaggggactctgagctagtcgcaaaccaggtgcacaaagactataaatgctctaaccccgagttatccaagtaccttgcagaagtcaggaagctcgagaagaggttcgacgggatcgaggtccgacacgtctatcgcaaggacaacgtcgagccagacgacctagcccgacgcgcatccagacgagaaccgctcgagcccagcacctttctcgacatcctgacaaaaccttcggtaaaagaagtaagcggcgaagttggcccaagcaccctcgacatcagctcggaggtcatcgcggcagaacgcgccgtggctgacattgaaacaacggatgactggcgcaccccattaatcaaattcatcagcagcgaggagttacccgaagacgacacagaggccgagaaaataacccgtaaagcaaaaatctactgtatgatcggcaacgacttatacaaaaaagcgccaaacaggatacttctcaaatgcgtctctaccgacgacggcagacaactcctcctcgacatacacgaaggcatatgtgggtcccacgccgccggtcggacattggtcgggaaagcctttcgacaagggttttctagccaacagccctcaaagatgcatgcgacatggtccagcgatgtgaagcctgtcaattccacagcaaacacacaaagctacctgcacaagcgcttcaaacaatccctctgatttggccgttctcgtgctgggggctagaaaaacttggcccattcccacgaggacaaggcggctacaaattcctatttgtagcgatcgacaaattcaccaaatggatcgaagcagcacccactggagaaatcatggccgacaacgccatcaagttcatcagagggatattttgcagatacggactaccgcaccgcatcataaccgacaacggctcccaattcatcagcgccgatttccaagattactgcatcggcttaggagtcaaaatatgcttcgcctcggtctctcaccctcaaagcaatggacaagtcgaaagggcaaacgacatagtactagaagggataaaaacccgcgtctacgacagactcatgtcacatgacaaaaaatgggttgaagaactcccatcagtactatgggccgtgcgcactacaccgacaacgtccaataaggaaacactcttcttcctcgtgtacggctctgaagccatgctccccggtgagctacgacatcaaagtacacgagtacagaagcattccgacaagaagcaggatgaacagcgagacatctatgtaaaccttctcgaggagcatcgtgagcgagttgccgtgcgagcagcaagctaccaacaggccctccgccgttatcacgagaagcgcatccgagcacgcatactttcgatcggtgactacgtcctccgacgagttcaaacctaagcagggcgaaacaaactctcaccaaaatgggaaggaccctacatgatcacacaagccttgcggccaggcgcatacaaaatcgcagacggcgacggtcgcgaattagcaaattcatggaacattgaccaactacgtaaattctatgtatgagtcaataccattgtacctgtaagcacccttacagtatcaataaagactacttcttggtctcatataatgaccaaagtgttttcacccaacaactcctcactctgacgacgcctagcgttgaaacctgtccttatgtccgtttacaccgtctcgacaaggcctccgaggaacccaagggatcttcggctggagatgcccagagccgataaggccttgtcagatccttcagagacgaaagaccatgtaagatctggtcgtgtaagagttctcgccgtgcgtattaaccaaaccgtgtaatcggaaaccaatctttccaacttcacggctgggggctaggatcagagcttattcaaccaagacagg

SEQ ID NO: 17805 - DNA, 1715 bp, Oryza sativa
  unsure (1)..(1715): unsure at all n locations
nnnnnnnnnnnnnnnnnnnnnnnnnnnnnnnnnnnnnnnnnnnnnnnnnnnnnnnnncatttgttaaagatagatttctttattcacaaaatattccttacaatttgtacataaatattttgtcacattacatcttttcccaagatatcttgttgcagggtacgaatcctaccaagaaggccaacgccagtccattgattggaaaatcttctcggccaacggcgacatcgatctcgcgagatggtctatctccgccggatccctccgagaacgaccaaaaccttcgcggagaaattcaagatccatgcgtgggcagtgatctcgtatgcaagccagcacatgtcctccggcatatcggctcgctcgacaacactcttgcttcaaggcctcgtcgatacgcttaccaatgccatcgagttgggcgcaggcctcgttgagccacgagatgtacccggccgccgatttttcaggatcaccgcgggctacccgaagatcccgacacaccctctccatcgaggtgcaacaactcttcaagtaagatgagaaccacacctcgcggcctcggagcgtttccacagcttgatctttcttcacggccagcattgccctctcgagttccaccacttcaaattttgtcttccaatattggatacgacgatcttgggtcgcaagggaatcctcgagatctgctaaacataacgactactaagataactcggaaacccccaaaacagcatcaaggttgacaggatcactcactcgggccagttgctgtcacttcgacctccgcgtcaagagtttggtcctcgacgttatgcgatgcgtgcggttcaaactcgagtaccggaattattgccagcgactcaggctgcccgcgctgctggacatcctcatcatcggcatctctacaatcgacaagatagacttccgagatcaacggtgaacaaagatggcaatcatgcgcataagggtaaccagagtttaaaatttacgagtcagaaaaatacaagaggtcctactcttcaaagtgggggaggacagattcccccagatcactgacttcctccatcacctccttccgcgcgtcgcttgccgctccctgatccaagacctcacgcaggttgagctcaggacgcgacaacttcatgcaagcgaggatgtgacacgccccggtatagataccgttagacgactcctccgcgatcctggccgcgtgcttggagggaattttccccatcgccgtcgctagctccgcaagagaagaggtcaacgaaaactcgtcggggttcgccggaatcgtggacttgatgccacactcctcggcaagttggtggagaccggtgtaggtgacccgcaacgaacctcggatctcggagaggttatccccgagttccgacatgcggtcctcgagccctttgcgctagcgctcgttgccggccaccagctccctcatcttcgtgaagtcctcacgggcttcggccagttcccgcaccaagcgctcagcgcgcgcgttggccgccgccgtctccgccctagcttacgagacctcgcggccaatgccgcgagcaccggcctcgagaagacgccccatctcagcttggagctcctcccaggtgaggatagcctctggcagaccacggcctccagcgggatcgctggcagggccgctgggcgtcgcctcccgactcccgatcgcgggaatgatgtcggtagat

SEQ ID NO: 17806 - DNA, 884 bp, Oryza sativa
tttcgtcaaaattaagaatttcggctaaacagccgaaatcaatctacactgtcatcgtttcatcgagttgaggcaactttcggccgtgtggccgaaattgattgcaatagtactgatctgcagcagcccgccgccatcgacgccatctgcttgtcggctacagctgcgatctgcatcgacgtgtctcatctgccgcttagtgcttagggtcatcaagtcgtagcaacgtcgtatacaggtgcatgcgcgtgtaccctgaccgaggagaagcagtagcagggccggcagagttttgctgtgcacggccagaaattttgagtatcaaatctattcggtttgctgtgtaaaagaagagaagaaaaaaaaggatcaggctatcacagccgatctattactgctcacgtacccaaaaaaaaaaaacatagcagccgatctaatctaagatcggttgatctttggtatattttggtacagtaccgaagttactgttacgtccagaaaaatcaacaaaggctagttttaataaaattggctaaacacagtaacatatcaagaccatatattaatctattcggtcaaatatttcggctatgagctatatggccggatttaatcaaggaatttcttcatcaaccatgatgagcgggaacgagatcatgtcggtcacattggatgatttcgaaggagaagaccgcaagtccatggaggagtacatcaaggagatcacacaggaggcgttgatgagggcgtgcactaggactcgtcaaggcgtgatcatcaagcccgggccttcctaagctcgctcccgatttggtaagcaatgacgaggtaatacaatctatccaacaacaagtagcatctacaatgggtaccgagctcgaatt

SEQ ID NO: 17807 - DNA, 9144 bp, Oryza sativa
  unsure (1)..(9144): unsure at all n locations
nnnnnnnnnnnnnnnnnnnnnnnnnnnnnnnnnnnnnnnnnnnnnnnnnnnnnnnnntctacatgggtcttaggttaggaaattttttggttggtccggggtagatacacccatactttctatcctctaactccaaattactccctctatccataaaagttagacatatttcacatttgagttcttccaaataagttgttcctatttgtggtctttatgcattcatgacttaaatgatgagataaattaaatgtttgattagaacccaatgagtcatctaaatactcgttggttgcatgcttgcattcactacttgattttataacatccaagatgatttaatttctccttagttgtcacaccctgaaaattcaaaatatataaattgttgtttaattggaatttttagaaataattttaaaagtcttgaaaagaaaatctaattttaattaataaattccaatataaaatggggccagataaaatttcattaaatacttggcttaattctataattcctagatttttctgggatttatttgagctaaggaagtatttttaataaatgaaattgcatttaaggaataatttaaattgaaaaaggttttaaaaagtctcttttggctttgggccgaaagtcggcccaaaaccgctctctctctcctcggcccagttcggcccagtccgcagccgccgcgcgcgcgcgttcggtcgctgacaggtgggtcccacctgtcggacccatcgtctaccttcgtccgccgccgcccgaaaccctagcgcgccgccgccgccgttcctttccaaatccggccgttcctttccttctccggccgaattgtttgagggaaaacaatctccgggatctcctctaccttttctcctttggaatctttggctaaatcgttttggaagttcgtggaatcgagttcgtttcggatcggtttccctctctccaagccgagctttccttcgccgttgccgccgccatgggccttcgccgccgcctctgagcccctttaaaaggacccccggtgtctcctctacccgtcgccaccttcgccttcgcctctcgtcgtcggaaaagccctagcgccgtgtgccctagctttgccgtcgccgccgccgctccagccgtgcgccgccgtcgtttcagccgtcgccgtcgctcgggaagaccaccgtcgtgctcgccaagtcgtcgccgtcctcgtccgccccttcgccgtcgccagagatcgtcggagcttcgtcgccgtcgtcaagccgaagagcttcgccgcttcctcctcgtcgccgtcgccgtccgttgaccttccgccgtcgttttggtcgccggtgagttcgccgtgccgcccgcttcatcttggtgccctccgtttgcgtcctcgcgccgccgttcgccggcgagcgtgcgccgttcgagccgtctcctccaccgagccgccgccgctgtcggtgatgtcaccgctgacgtcatcggggtcgtccgccgtgagccgccgtggacccgatcgatctcggccgtccattttggattggttcgatctcggccgtccgttcgtgtgaaccgccgcccgtgcgcccggtccaccaaaccctagcccgctgacgcaataaaccctcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacatttatgggataactaatgattcactattatttcatgatggcttaatgatagttcacgatggtcgatcgtgattagttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgtggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacacctctcatcattgtaaaagatgcttaaactggtaataatttgtttagctcctggtttggaatggtatattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcctgtgcacttgcatatttgctgcgtggcttgctgagtatgtcatatactcaccttgcaatcattcatcagaggaagagttctacaatgaggctgatggagtggaggaataggtgtagctttggtcaagctgcctgtggagtggagccgtctgcgccgtttatttattttccgctgcttagatccttattgattgagaggaactatctacctctgtaatgacattttattcgcttattaattagagtaataattgtactctattatcaatttgttattgtgtgcctcggctgattcctggacgagggttcacacacatttaagcgtttggaattttggatagaaattccgggcgtgacaagttggtatcagagccaggttgaccctaggttatgccaaatggttatccatagaagccctctaaaaatattggaaaagtagaactggtctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatccaaaaacttgtgctattaattggataaaggtcttaactacctcctttcacttgtctttagatgccgcgttacaagcctgagtacctgtttggtgttgagggttttgtccaggagttgcgtacgatgtcctttgtcattggatttgggactgcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgccataggagagctccgtgatcgctacagtgatcaattggccgacactgagtatcgctaccatcctcgccaaccccagggaagtgaccgtggcagttaccttgagactgaaggaattgagaatgatgctaccacgaagcatttggttgagatgttgtgggctatggatgaaagtcgtgcggagactgtgttagccgctcaagatcgtgaagaccggaatcgtggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaggatgataaagacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgtgagtctttagtttgtaataatgaaactcagttaagatcaataaaagttaaagtaattctctgtcctaagtagtttccccggtttctcttcttgtgccctgcccatgccagatggtgaacactcgcagcaatgggaatggtcccaacaaccccaataacaacaacaatggagagaatcccactcttgctcaagttcttgctcaacagacacagcttatgaacatgatgatgcagcaatttcagaatcagcaaaaccaaggaaataatcatgcacctccacagaacaagttagcagaatttcttcgtgtgaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccggaagacgcatataccatcaggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtacaatcgcatggagcagaagaaacgtcggattgctcaattcaagacacaacaggggaataatcagaagccgcgtcttactttaggaccccagcccatgccacagggaggttcttcgtctgttgttcgtccgcagcgtcatttcttcaacaacaatgctggcaacaacatccgtaatcaagctccacgtcctgttgcagctccagcacagcaacaacctgccaagagggagcaaggcagcaagcccgtggtgtgtttcaactgtggagatccaggacattatgctgacaagtgtccgaagccccgacgcgtgaaggttgtccctgcccagaataactctgctgtaccagcatccaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttagaatccaaagaccttgatgtcatcctagggatggactggttagccagacataaaggtgtgatagactgtgccaacaaaaaagtaactctcaccagctatgatggtcgagttgtaactgttcatgcattgtcatctgagtctttaaggtcaagactgaaccaaataactttggaagagattcctatagtccgggagtatcccgatgtgttcccagatgatttacctggtatgccgcctaaaagggatatagagttcacaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccatgatagatcttcgatcagggtatcatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcggaccaaagaagagcatgaggaacatcttcgccttgcattggagaagctacgagaacatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattatcggaggtttatagagaatttttctaagattgctaagcccatgacacgactgcttcagaaagatgtgaagtacaagtggtcggaagaatgtgagcagagttttcaagagttgaaaagtcgcttaatatcagctcctattttgattttgcctgatccaaagaagggttttcaagtgtattgcgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcagccttagaagcgaagcccactctaattgatcaagttagagaagcccaaattaatgatcctgatattcaagagatcaagaagaatatgagaagaggaaaagctattggtttcttggaggatgagcaaggaactgtatggttgggtgagagaatttgtgtccccgacaacaaagatctaaaagatgcagttctgaaagaagctcatgatactttatactccattcaccctggtagtactaagatgtaccaggatctcaaggaaagattttggtgggcaagtatgaagcgtgaaatcgcggaatatgtagcagtatgtgatgtttgtcagcgagtcaaggcagaacatcagaaacccgccggtttgttgcagccattgaagattcctgaatggaaatgggaagaaataggtatggattttattactggtttacccagaacgtcatcaggccatgactctatttgggtgatagtcgacagacttaccaaagtggctcattttattccggtaaagacaacctattccggaagtcgcttggcggaattgtacatggcaaggattgtgtgtttgcatggcgtccctaagaagatagtgtctgatcgaggcagtcagtttacttcaaatttttggaagaaacttcaggaagagatgggttctaagctgaactttagtactgcttatcatccacagacagacggacaaaccgaaagggtgaatcagattttggaagacatgttgagagcttgtgctttagatttcggtggaagttgggataagaatctaccttatgcagaattttcatacaacaacagttatcaagctagtttacagatggctccttacgaagcactgtatggtcggaagtgccgcactccgcttttgtgggatcaaacgggagaacgtcaggttttcgggacggatatcctaagggaagcagaagaaaaggtaaaggtcattcaagaaagattgcgagtggctcagtctcgacataagagttatgccgacaatcgccgtagagatttgagttttgaagaaggagattatgtgtatcttcgtgtcacgcctcttcgaggagttcatcgttttcacaccaaaggaaaattggcaccgcgttatggggaccttataagattgtcagtagaagaggagaggttgcttatcagttagaattacctcaatctttggcaggagtccataatgtgttccatgtgtcgcaattgaagaagtgtttaagagtacctaccgaagaagctaatcttgnnnnnnnnnnnnnnnnnnnnnnnnnnnnnnnnnnnnn

SEQ ID NO: 17808 - DNA, 568 bp, Oryza sativa
ttcttgaaaggaatatgcagctcacatggtgtccgctgactgatgtcatcaacgggacaggtccattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggctcccactgcatctgttagtcgttgcgcaacctctcgtatctgaacgccgaataccagtgagccatcagctgggttgagcgttccaccgtgagcatagtaccaga

SEQ ID NO: 17809 - DNA, 1032 bp, Oryza sativa
  unsure (1)..(1032): unsure at all n locations
nnnnnnnnnnnnnnnnnnnnnnnnnnnnnnnnnnnnnnnnnnnnnnnnnnnnnnnnnnatacaagaaacatctgctaagtcacgagacatttatgttttaacaatctaagtcatgtatgctaagtgtaaatgtcgtacattagaaccctacacaaaccctacattagatatctttagtcccggttgttgagaacaaccgggagtaaatatcttttcccgctatttcgaaattctttttaaacccggttagggttaagaaccgggactaaagattatagcactgcatatgattttctcttacatatgtgtttataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatacaatagtcaattataattagcatatgaatgctagtaaattaaatgttaaaaactctaattaacgtacatatgaaattgccacctgtgtgatttaaaacttttaaaaattgtaagtatcacatataactagcatatacatgatttgaa

SEQ ID NO: 17810 - DNA, 1585 bp, Oryza sativa
gtgcttattattcgcttgatattcgtggagtatccagacggtacctatatgctctccaagcattcaaacatactttccttctctgccttgataagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccagggccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcctcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctatcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagctctgtggccctccaacatgttgtccaatctatgggcctccttttcactttcgcagtcctccctggcgt

SEQ ID NO: 17811 - DNA, 718 bp, Oryza sativa
tctctttaatgcatataggcaataaaaatatgcttattttgtagtattacttttggaaccatcaattttaaaaatgttattgaaaagtacaataaattgtcataaacaagattagcataaattaattattttattccttgagttagacaccgttgatatttgaatatatgtctgaccattcatcttatttaagatttttatgcaaatatataaacatatagtcatattcaaaataacattagtaacaatataaataaaaaaaataaattataacaatatatttttttaaacaagattaacgatcaaatgcagatttaaacgcaaacataaaaaatagagttaaatgtacaatataaacatatccagaaatagacagcctataaataaagcgcgtcatacggcgtgcttattaattttctagtctaggaggaaagtcaatttatgtctccaacattggaaaaagtttacctgaggtccccctttttgttaagttacgaaccagattttagctaacatggcaactgagttagacccacatgtcggggcatttcagtccaatacatttctgttggcatcagtggtggtcactggcgagaacttgctgagaaaaggcgaaagcatggtggagtggggagaggaggcggcgaaggagcaaaggtattaccacctcctctgcgggcttggccggtgggacacgaaatttttttattttttatac

SEQ ID NO: 17812 - DNA, 949 bp, Oryza sativa
tacatctcgtggctcaacgaggcctgcgcccaactcgatggcattggtaagcgtatcgacgaggccttgaagcaagagtgttgtcgagcgagccgatatgccggaggacatgtgctggcttgcatacgagatcactgcccacgcatggatcttgaatttctccgcaaaggttttggtcgttctcggagggatccggcggagatagaccatctcgcgagatcgatgtcgccgttggccgagaagattttccaatcaatggactggcgttggccttcttggtaggattcgtaccctgcaacaagatatcttgggaaaagatgtaatgtgacaaaatatttatgtacaaattgtaaggaatattttgtgaataaagaaatctatctttaacaaatgtttcttactcagggtgtcgtgtgtaaggccgtgttctcagttaacgaccttagttagccgtttgagttgtacactctccctagcccccagccttgtcgtcggagggatgtcctcgggtggcaaggctcttggacccctggcctgtcttggttgaataagctctgatcctagcccccagccgtgaagttggaaagattggtttccgattacacggtttggttaatacgcacggcgagaactcttacacgaccagatcttacatggtctttcgtctctgaaggatctgacaaggccttatcggctctgggcatctccagccgaagatcccttgggttcctcggaggccttgtcgagacggtgtaaacggacataaggacaggtttcaacgctaggcgtcgtcagagtgaggagttgttgggtgaaaacactttggtcattatatgagaccaagaagtagtctttattgatactgtaagggtgcttacaggtacaatggtattgaatcttacatagaatttaaggaagttgggcaatgttccatgaatttgttaattcg

SEQ ID NO: 17813 - DNA, 2410 bp, Oryza sativa
atggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgacaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgccaaggaggccatcaagctatcgaactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaaattccatcagctgtacatggagatgagcgccgccggtagagagatgatcggagcgaggatcagggacacggacttcttgcaaggagatgacattctctggatcaatttcaagggaatctacgaactataccagctggacgccctcgacgtctctattatgagttgctggattttgtaagtatatcgttcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcattgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatatctatatacatatgcattaatttgcataacatatatatgtgtataaatacatatatattatgcatgtatatacatataatataatataatatatatatatatacatatatatatatgtatgcatatatatgtattgaaacatatatatgcatggtttatatatatatatatatatatatatatatatataaactatatatatatataaaccatgcagcaacagggccatgcaaaaaaaaatggtcagctcgatctttagtcccggatatttac

SEQ ID NO: 17814 - DNA, 440 bp, Oryza sativa
  unsure (1)..(440): unsure at all n locations
nnnnnnnnnnnnnnnnnnnnnnnnnnnnnnnnnnnnnnnnnnnnnnnnnnnnnnnnnnnnnnnnnnnnnnnnttgtgttttccccaaaatcatatatgattcataaaatcttgtttatttaccaaatactgtaaatgtatatatgtctacttaagaaagcagggatgagactacagccataccagctggctcctgctgtccatacgccgcaaaggaattactcctaagagatacattgcccatccaataattgggaacataaatatacttgtcttgcttataaacttgaaacaccttcctagagttagaagggtatagatatccaagaaactctgatggttcgcaacatagacagcagggctactattcggtggcaggttctccattccctcgacgnnnnnnnnnnnnnnnnnnnnnnnnnnnnnnnnnnnnnnnnnnnn

SEQ ID NO: 17815 - DNA, 351 bp, Oryza sativa
  unsure (1)..(351): unsure at all n locations
nnnnnnnnnnnnnnnnnnnnnnnnnnnnnnnnnnnnnnnnnncacacgggggtgcttggcgaaagtcaatgtaccaataacgaagaagcgcaaacttagacctaagactgtggacagagtatcggacatatttgacctttttattgtgcttttctcctttctttttacagcgtccacacggattcttttttttttggccggacttttttttcacctgttttttttttcgcctgtttttttagaatcggacagattcctttttttttctttatgcccttttttttacttgggaatcggattcagttttcttttccctttttccgcccgtttttttattcttttttcgaccgg

SEQ ID NO: 17816 - DNA, 758 bp, Oryza sativa
  unsure (1)..(758): unsure at all n locations
ggacaaatttatcccggcagtatttacacagagcttcttttggctcattagctgtgctttacttaggtggtgtttacatccagggacttaacttaagtccctgtctttagacactaatttagagtattaaatatagactgcttacaaaactaattacataaataaaagctaattcacgtgacaaattttttaagcctaattaatctataattagagaatgtttactgtagcatcacataggctaatcatggattaattaggctcattagatccgtctcgcgaattagtccaagattatggatgggttttattaatagtctacgtttaatatttataattaattttcaaacatccgatgtgatagggacttaaaagttttagtcccatctaaacagggccttaggcccctcacagtggcttagtcatgccacgtaggttttttgccgccgtggagggagggaccgcgccttagctaggttcgtcgtcccctaccttagcgacgcaaagcctcgccaaaacgagggcgcgcagcgaggagaaaaggcgggtcacgcacgctgtgggcggcgcagcctcgtgctcgcgtggcctagcgcccaaaatcccctcacgcggcagcaaaattcctgattcaccctcccaaaatcccctcccgccacaacattctttctcccgccacagatcggattgatagataagcannnnnnnnnnnnnnnnnnnnnnnnnnnnnnnnnnnnnnnnnnnnnnnnnnnnnnnnn

SEQ ID NO: 17817 - DNA, 1072 bp, Oryza sativa
  unsure (1)..(1072): unsure at all n locations
tcaaacaattcggccggagaaggaaaggaacggccggatttggaaaggaacggcggcggcggcgcgctagggtttcgggcggcggcggccgaaggtagacgatgggtccgacaggtgggacccacctgtcagcgaccgaacgcgcgcgcgcggcggctgcggactgggccgaactgggccgaggagagagagagcggttttgggccgactttcggcccaaagccaaaagagactttttaaaacctttttcaatttaaattattccttaaatgcaattccatttattaaaaatacttccttagctcaaataaatcccagaaaaatctaggaattatagaattaagccaagtatttaatgaaattttatctggccccattttatattggaatttattaattaaaattagattttcttttcaagacttttaaaattatttctaaaaattccaattaaacaacaatttatatattttgaattttcagggtgtgacaaacctaccccccttaaacagaatctcgtcctcgagattcggaagaactggcaaataggtgcggatgagctgacttcaattcatcttctcgttcccaagttgattcttcttccgagtgattactccattggagtttgcaaaaacggataactcgattcctggttcttctctcatttgtttccaagatacggattggtttctcaacataagtcaaatcctcttggacttctatctgttcaagattagcttcttcggtaggtactcttaaacacttcttcaattgcgacacatggaacacattatggactcctgccaaagattgaggtaattctaactgataagcaacctctcctcttctactgacaatcttataaggtcccacataacgcggtgccaattttcctttggtgtgaaaacgatgaactcctcgaagaggcgtgacacgaagatacacataatctccttcttcaaaactcaaatctctacggcgattgtcggcataactcttatgtcgagactgagnnnnnnnnnnnnnnnnnnnnnnnnnnnnnnnnnnnnnnnnnnnnnnnnnnnnnnnnnta

SEQ ID NO: 17818 - DNA, 1124 bp, Oryza sativa
cccaagccaatgaaagaaacctcttggatcccatggtacctttagtcctttaggctgcaaaaactttgcttccagcagataactaattgttgatataaaagctgcattccttggtaaaatctgaatttgctctgtgataagataaaaaaaaatgcatgtttgatagattgcagaggctctgaaatcaccatcttagtctgaaagcttgcccaatggttgccactgaaatcttcatcttgtttcttgactaccaaacgatttctagcctccacatcccaaattaagttggcagctattgatttaatcacctggagcatggaaattgattcacatatagagagcttgagtgtgcgcctatatccttgtgcaactcttctatggtacagtagagctgcagcattaaggaactgaagcagaaccccgccagagtccaaatgcacctccaagttccatgtcagatcaaaccgaaccattatgtctgaacactgggacaagcttaatgacttgatatgctcttgcttagtgaaggaaagggcatttggaatagagtgaacttgtagcttggatagcaatgacctcaaagatccatcatgaattaatgcttttgggttaatacacatcttcccaggacttgcaccttcaaatatacattgcagctctttgttgctcaactgtctttccttcataatacgagcaagttctttagatataatacgagcaagttccatagattggctattcatatgatgcccctgcattgcaagaccatagacctctcttccctccatcccccatgccaaagaacttactagacttggtggaggccatggtttcaacccagccatctcctgtgttaaaatcacggttccaatgactaaaactccaatatcaaaaggctcccatgccaggaagcttactccagccggtggtggccatgggggcatcaatggtaaaccttccaaatataatttggatcctggccaatgcaaaggttgcaactcccatcgtctaatcactccacccaaccaagaaggtggccatgaatttctcttagcattccccattagcagcttcttgtctttgggacatttcatcgaacacccagtgggcagcaatggaataag

SEQ ID NO: 17819 - DNA, 820 bp, Oryza sativa
ccgggactaaagatatctaatgtagggtttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaag

SEQ ID NO: 17820 - DNA, 956 bp, Oryza sativa
atcgattgcccaacttcccagtcagaccgcactaccaacacctcactatcagactgccaaaacctagaaaaatacaaatcaaaaactcttaaaagtaaataaatttatttcttataattgtgtttataaagtacaacaacaacactcctctcaatttttgactaaattcaaattctaagctaaaccataatttttcttaaaattattctcttataaaatcaataccaagaggcctcagcccctcttctatttatatcataagatagtatcctaaaaaccacgaattctactcaaataaatactcctaatcccatagaaaacctacgcatacaagtataaagcttatctttttacaattcaaacttcaatcttttcaaatttagaccctatccaaatttaactccacttttcatacgcacacaatccctctgcatatcgaatcttcaccaccacatgcgttactttttagcctaagtatcccgtatgatctcctaatcgtttgatcatcaacttctcccaagttgactcccgatccatcaccggcaacactctcccgaggcattaagacacaactgcacatgaataaacaagaaacatatctgagcacaagtcctttcccaacttaactcaacattagcatataacagtatagcataaattagaattcataaacatgaaataatcacgagtgttcaaagaaacaacccgaaactaactccaatcaggagccagtcgatcagatcgatgggctagccggtcttaccgcaagcatcatactaaaaccctatttttcgtacaatcatgttcattgtattttccccggtctgaccagcatgcatagaccggtcagaccgatcctaactacaaaccaccactccacaaataaaacaccaaatatcaaaaccaatataaatcaaacatctcatgctaattggtcatcacaaaataatagtgaa

SEQ ID NO: 17821 - DNA, 822 bp, Oryza sativa
  unsure (1)..(822): unsure at all n locations
tcgacaccgttgatagtaccaaggtgatgcccgccagctgttcgacggttggccttgatgtcaagggtggcgcagaccataccagggtcacgtgtcggaccatgatgggtgtgcccgagggcgttctagtacctgatgcatcatccaaagtcttctcgccatggttgatggctgaaatggatcttattccattgctgcccactgggtgttcgatgaaatgtcccaaagacaagaagctgctaatggggaatgctaagagaaattcatggccaccttcttggttgggtggagtgattagacgatgggagttgcaacctttgcattggccaggatccaaattatatttggaaggtttaccattgatgcccccatggccaccaccggctggagtaagcttcctggcatgggagccttttgatattggagttttagtcattggaaccgtgattttaacacaggagatggctgggttgaaaccatggcctccaccaagtctagtaagttctttggcatgggggatggagggaagagaggtctatggtcttgcaatgcaggggcatcatatgaatagccaatctatggaacttgctcgtattatatctaaagaacttgctcgtattatgaaggaaagacagttgagcaacaaagagctgcaatgtatatttgaaggtgcaagtcctgggaagatgtgtattaacccaaaagcattaattcatgatggatctttgaggtcattgctatccaagctacaagttaannnnnnnnnnnnnnnnnnnnnnnnnnnnnnnnnnnnnnnnnnnnnnnnnnnnnnnnnnnnnnnnn

SEQ ID NO: 17822 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnnnntggtgtatgtctttgggagatctagacctttactgttcttaaaaaaaaaatctctagtgtagtactagctactgttcgtcccttcgcatatccatgcacacttaacagttgaaatgtccttttgtataattaattgaaatgtccttttgtcagttgttaagggactgaaatttttaaacagatatattcatctatctggcacaatacagtgacgcatatcgggggtgtttggatggggctaaaaatttttcagtacacgtcatatcggatgtttgatactaattagaagtattaaatatagtctactgacaaaacctatttcataactctggactaattcgcaagatgaatctattgagcataattaatccatgattagcccgcgtgatgctacagtaaacattctctaattataaattaattaggcttaaaaaaattgtctcgcgaattagctctcatttatgtaattagttttgcatgtagtctatgtctattactctaaattaattatcaaacatccgataggacagggacagtttagtccatgatccaagtaccaccgggggtgtctggatgatgacaacatacagagtatatgtaagacaccgctagcgcttaccgctttggcgcacctcccctgcagttgcacagcatgcccatgaagcccg

SEQ ID NO: 17823 - DNA, 1521 bp, Oryza sativa
  unsure (1)..(1521): unsure at all n locations
nnnnnnnnnnnnnnnnnnnnnnnnnnnnnnnnnnnnnnnnnnnnnnnnnnnnnnnntgctttcccccaatgagacagctttccctcacacagcagacaagaaactacctatgggtaaccttcacacctatcatctagttactgccagtagtagtgccaagactcggaatcatactagttcaggtattctcataagaacaaatgcctgtatggtaggctcacataaatggcttatgaagtgaagtcctcaattgatagggcaacttaccaaactacaatagcacacgacattggtagtatcatatatttataattaaggacacacagttgtcactttgagcaactaaatagcacacagcttgacagtaggctcacacatataccatacccggtaatgatcacataggtacattaccaccgaacccaggttcacacataaccacccatcaccctgatccaaaacgttttatccgcccgttgtttattacacaacaacacgtgctatcgaaaagatagtacacagtcacacggttcatatacaaataattataaatatatgattaatcaaaattatattttgcttcaaaacaaccttgagcagagctaagcataactactctaccttgaaatgagcccaatgttcaactcagaaaaactaggatgacaaggtatcataggtaatcaataattataaaaggcaaggtataatagcaattaggtcaccctacccatcgatagcatataaataaaagaatgcatgtgttcaaaaaaatatttataaattgggtccaatatgttcacttgccttcctccaagtatcattcctgcattgtgccttctgcagcgaaccactcctctactccaacgtctacacaatcacaaacgaaaaacaaataaacaaaagaaaagactaactaaataacatcaaataaaataaaccaatgaaccaggaatttgagctcgattttacaagaatttagtaggggtaaaaatggagcggattcggatggatagtggtattttaagcggattcagagtggatgcggatgtagaacggattgttttggatgtcggaattggtgtggactcagttcggaaactgattaaatttgtcagatgctatgtgtgtatgcaagcaatacaccattgagttagcaatgcaaaggacaacaacgcaataatcaatgaacggaccatcgtaataattatgtacttaagtactaaataacatgaatacatgatatccacaatataaaaaacaactaagcaagtgttagttagacggtgaaagccctggactaacgaatctaggttaattgatgaattgggccattagatgtgccaactcatgttatatgcaacagattgaatggttacataagttgataatttcggattatgcggcaaatagcctatcggatagtccgcatctgttgtattttagagatatcttgtccgcatctgcatccatatccatcggatttctaaaaactcataccatatcatcgtttcagatggattc

SEQ ID NO: 17824 - DNA, 5721 bp, Oryza sativa
caatatagattagatagatagtttaagtctatagcaaaacactagagttgagtcatcgtatagcttctactgtaatagttagccacaagtttgtaaataccctatcattttatgtaaaggaatctcctttaaaaccttgatcaaatgtatgcaatgaagatccagatcgttgaacctgtatcaatctactgatccaggtcttgatacagtctaaacatgtcggttttcgaatcattagttttgggacccgacaataaagcactgtcaagtagacttggaggaattcttctgggtcggtgctcccatcatacttttcaatagctccgggtcggaatctctcaggccatcggacatcacgtagggaacgaccgaaagccctgcacccagcgcttggagcggcgggttgtcggcggtcgcgtgaccttcgtggatcttggtctgacgatgaagaggactcggatgatgatgatgatgacgatgggtcgcttggttccggcgtacgattacgagggtgacgacctggatctcgggaatcttgtcttcgtctctcgctgttgtctcgacgccgatcttcttcatcttcgtcattacggcgacggccatgaccaatgctgtccggcccccgccggtcgcgatcgtcgtagtctcggtcctcgtttggacgacttcttcgatcatggtgtcgtgaggagacatgacgccgggagtggttcacgtcatcccgtgctcgccgtgcttctcgacgaccattgatttgatctcgaagatcgccagtaccacgaggtggaggggtagcttgtcgaggtgattctctccgttctagaatttcaccgttagcatcgccgacgggagatcggttttgttgggctgcggtggcggcttcttcgaacgcgttgctgaggttagtcaccgatgcccgtagttgttccgtccaacgctcgaggtcgtcgtttagaacaggatcgtaaggtgtttccctcagtatggcctaaacagccctgatgtgttgggctggggtagtcgattgattcgccgtctccgcgttggcttgtgctgacgtgccaacgccatcgatagccaacacctcccgcgccgcgtctgatatcgatgaccccaacgaatcgatctggggccggagtcgctccttgttccttgccgttatccctgacggggacgtatgacttaggagacggagttttcatagcgccgagtagaactttgcaactcgagaggtcgtgattctttgtcttatgaataggacaatagacgtcccgagttggagaagtacgttgaattccacgttctttgcaggcgcggatttcagcatggacgttgatgaatacccagcaatcttgaagagtatgtttcttggttttatggataggacaccaagacctggtagtttcggaagtcatctttgttggcccgtgattttcgtcggggggacaaggcttggccgcatcagaatccttcacgagtttgggtgtagtcggtaatccgttctctgtttcaacgggtggatttttcgacatgtaggcgtctcggttcgtagccactgcgttctcgttgccagttattgggggcccggttgagatcggcatagtggtgtaaaccgggtagacgatttcgccgacttgagtccataccagcattgttgaagtaggaagaacttcaccgaagctggtgttggcattgttgtcatcgaagcttcatggcatagtagtagaaccttgaataccaggcccccctacctggcgcgccactgtcgacgggggatacccgtagaccggatatagagggtattggggtacgctggtataaggatctacgtagtatgacatcgagcaattaaaagacaagaattatactggttcaggccccttgataggtaatagccctaatccagttgatatgggattatatggtggaaaacacagattacaaaggaaaagacggaactcaggggatttggcgagattgtagtcgagatgattcgactagctctcgtcgacttggctccttgcaggctccgacttcgtaggctgtgtggggtgtgttggctctgagattcgatgatctatgccctccccggggggtcccttttataccgtaggttgggtgctctccgagtaggactcgaacataccagacctggcacgatacgtaggtaacccaattcttgtccgaggaggtctctcttcgtccattgactttacgaagagtttccttagacgccaaaggatttatccatgcacatgtgaataggccttgtcaatatgtgacgtatgtcgaggggtagagggtatgcctgactcgtaaccctgatagtagcccccgacttttgctcaaaaatgaactcgcgcgactgtttgcgatttcaggtgtcgagaacgttgtcattccaggtgcgagaaccacgcagatgacgtgtagtcgagcacaccgtttgaagcccaacggtcacgagtgaattttgaactgaagtccaaaaaccgccatgcacaacggacctagaaatctccgacggagatttctcttatttccttggaattcgcaccgtcaggagtgcgcttatttaaagggattttgggtgtgagttttgaggtccgcctacttcaccaagcaaacactgctcattagtgctcctcgccttcttcgccaccgcaaagaaccctaacctcgccaatccttgtccgtctccggcgatcctccagcggcgatggatcttggcaagtcaacttccaccaccgcgaccctgaagaagctccaggaggagggcgccctccctggccgcgacaaggcggagagggaagcaggaggtactaatccacagcccctcttaggtcgcatggttgcgatcgaagattacattgtctgcggatttcttcctcccccctctgaattccttgtactagtcttgaatttctatgggctttcacttttgcacttgaatcccaactccattgctttccttagcgtttttgtgcatctttgtgaggcctacattggggtagagccctttctcgatctgtttcgcttctattatgagttgcgctggatgaaatccaataaggtgtctggctgtgtcgggttccgacttcgagatggtatgaagttgcgctatgtccccttccagtgtccctcttctcgcagcaaatggcggaacagatggttctatcttgaaatcaaagatttgaatcctgtcctcgttgttcctgaggagcaaccggacaagattccggtttggaccgccaagccccctttgaccccctctctgcaatcgtttatcgacatcatcgatgatctccgagaacggggcttatcgggatatgaagttgttgcagacttcgtcggtaggcggatccagccgctccaggctcgggcccacccggcatataactattccgggccagatgacgcgacccgggtttctcctcggggtatccttctcgtattcactttgatacatttgtattcacgttccatttgacttatcaagaattgattctttcttgacaggtctgagcagtgaagtcatggagcggtgcgctggtcaagtgatgatcagcgacccatcagcgacgagcaacattccaaaacccctctgcgataaggatgcggcggaacgcgatgaagcaatcaatgtgagtttatttgaatgtctttttccttccctgtttgaaatcagcttatgatcggacttagcgtagccccttcccttgactgacgtcgtcggaccactcgcggatcatcaagtggcggcttccctgaaggagaaggtcgtcgaggaggcgtccgacattgccaccggtagtggtggcaaggctccgaccaagccgaggaaattctcgtctgtgctcggacatcgccgcaaagcggagacttcctcggtaactttcaccttgtcattatgctaagtagtgaggaaggtttctgacgcgtctcctccacctgcgcgtcgtcaacgcattgtgacgatccgcgagaagtaagtcaggggacttttagattctcatgtcttctatttgagtggaattttgatctgctgaagctgatagggaggcgcgtgttggcaactttttgtgacaagtcgacaagcacgatcgcagcacctaaacgccttgcggtgatcctagagtcgccaaccacctcgatctagctaaagggccaaatcaagatgggttttgttgaaaaacagctaaaccagctagcagagccgatttagagataaaatcagcctctaggccaatttagatcaatatgaggataactacccgtctcgtgggcaaaacggaaggttttcaggacaaacctacaaagaggtgtcgcactcttgcagcggcggcggacggtttacggcgcaaaccgacaaagatggactaaactagggtaaaatagaaaacatagtaaaagaacgattcaagtagattgtattcgggggttttacaatgaaccggccttgtcccttatataggggttggtcttgccctctacaggcccttctccacgtccaactcgggatagaaactaaaggaaacacgaaacatgccttcccgagcaaggaaacccgagacccgacgaaaatagagtcggactcggaccctgacagtttgaccgcccacatacctgcggtcagaccggccctactagccggtcagaccgcccacatacctgtggtctgaccggccctagcgaaggaaacccggcactttccaaactttggcaatttttccctatttcgttcataggtgccaaatttggatgtaaacacatgcccccgtgcctttttggtgaacatacgtgaacctaaaagcatagaacatgttatctcagggcgataatccaattaccggccataggacttcctaagcatcttaccaaatgctcgggaagtatttcttcaagcatctcccattaattgctctctaaaaacaccgtcttgaagtgtcttcatctccttcaaagtcttcaaacacttgtcgatgacgtcttcaaaattgcttctcatcaaggtcttgtaatcttcaatcgacaagtcgtcttgcttaaaataccgaagaaagccaagatttatctcaactggcaaaacgccaatttcaacaatgttttattactcgattcggcttatccattagcccgagcgtagtagagggaaggactcaacaacttaatatcataaaattcggcaaaacttctcatctccttagacataaaagaagctcctttaatgtttgaggaataccgaatctatgaacgatatgcttcgaaataaagccaattacctccgtgtaattaatattttcgaacggcatggcttcggcctacttagtgaagtaatccgttacatctagcatgaaccgatgcccgtttgatgacgaaggataaatttgaccaatgaaatccaaagcccaacttcggaacggccatattttaatgataggattcaacacagcggtaggagctaattgaacattgccgatccgctaacaagctcactccctctatagaatttgaaacaatcataaattattttcggccaatgaaaccccactctcgtaagcaaccaatttatcttacgggccgattgatgaattccacaaatcccttcatgtactactctcctagcaactttagattgatcattatctaagtaatactccatctatttttcggcgatataatatttgaacgcttgccgccgaatcttccgatcaaccttaa

SEQ ID NO: 17825 - DNA, 2604 bp, Oryza sativa
  unsure (1)..(2604): unsure at all n locations
atgcctgacccgtaaccctgacaaaatcgaagttcgaacggataagttaagacctcgagaagttcaaattcagagaaaatctaatgacagaaagaaaaggaatattccaggaatatcctatggatattaattctttaaattgaattatttttaataagaaaattatagtggggcccactgattagtggctcaggttttggtggactcggtgtatgatgggtcggctggcgtggatgcctcgtggtgacacgtgtatagagatagatgacatggcaatgacgtgggtggatctagggctgatgtgccgagggaaggagttatggtaatctgactctaaagatttaagcaaggagatcaaatggctgtatgttcctcatgtttgatacccttggaatactctaagggaaagtgctaccgcggtattctgtgcgcctcagatttatctgtgatcgtatcacataccaataattgcattatagcggaattatagctagatattactgttatattcatataaatttagcctaaattaattcactttcactaaattatggatagttaaaaagagataatgaatatagatttcgacttgtcacgatgtgttaaaacatattagaaattcaatataataatactttaagagatattgtggccgggagatttgctaagaagcaaacggagactggagaccatactgaaggacgcacatttcgttgaggtgattttctcatggaactgaacccccatatacctgaaatgctatattctattttgggtttttttttccttatatataccatttacccaaaatacaatattctattttggggttttttccttactagcaatagtgtctgtgcgttgcaacgggaaaaacaccgtttgatagtgtgacaccttgaaaacctcgaatctgtaaaaatcttgatatattaatcaattcgacggcccgcaagctgagcagttgagcgcggcccacatatgcggggacggtccgatgcacttccgcagcccattgggcgcagcgtaatcaacggcggcgacagcccgacgctaggcgaatctgagccgtccgatctaatggacggctccaatcgtacccgcgctggatgaagcgccgatcggggagaggggcaaaaccctggctcccaaatccctctctcctgataccatttatctccggagacgagcgagcaaaacgatggcggtccggcaagctggtgcgcgcgtgcagcgacgaccgccgagcggctcctgcttcgccggctgggggccgcacccgagggcagcgcaaagccatgccacgacgtcggcggtccggttaggtggtcgtgcaaacggcgacgagcgctgagcggcttggacctcgtcggtggtaggggcgacaccaagccgacacttcccgtcttcggcaaaggacggtggaggggtgctccaggacagcgtgcgcaggaaacccgacacgactgcgagaaggtgaaggtgcggtggtgccgcttcccagaaagctccagtgagctcaggggcttcaagtctggtaagtaacccgaacccttagcttaattgatttggatttgactcttatggttcttacccgaaattagggttgttcgaatttagagaattttgtcgggaaatttcaatctattttattccctcttttcgagttaggggtgtttcaatatcgtttattctcttttaatttcgggaacttcaatctagtttatccctttgctcaattttgtttttttagcttgcgtttcatcgcgcaagcggggatggagggcgccgctcgtccccacggaaagattgaatcggactttcttttatttgttttaatgtttttttggtcctttttttcgttattacggacaacagaaacatttttaattttttaagcagtagagatagagaagatagagatatatagtaccgtgtcaaatataataggattcgatttttttaccgcgtcacgtataattcttttttttttggaatcggacatatttgttttttttattttttttttctcctttctttttacagcgtccacacggattcttttttttttggccggtcttttttttcacctgttttttttttcgcctgtttttttagaatcggacagattcctttttttttctttttgccctttttttttactgcggaatcggattcagttttcttttccctttttccgcccgtttttttattcttttttcgtccggttttttttgcccgttttgttttggatataggattgcatcggttatagtcggtttcgatggtagggattaatgtagggacaaacctacttttaaagcagattgcttttctcatattcaaccttttccacatgtggtaggtgttgtgtaattgtcttgagagatggacccctaattggttgctgcaattattgtctgtgcatgtactatttatcatatttatacaaaagatattgtacggcttgattcatactgctttcgtttttttaatagatgacgccgttgattttcttctcacatgtttgaccattnnnnnnnnnnnnnnnnnnnnnnnnnnnnnnnnnnnnnnnnnnnnnnnnnnnnnnnnnnnnnnnnnnnn

SEQ ID NO: 17826 - DNA, 1606 bp, Oryza sativa
aaacatgtgagaaaaaattaacggcgtcatctattaaaaaacggaggtagtatgattcaattttaacttatcgcacatcaatcttattactgtaattttacattatcatactcacgtattttcctcatcgtctcatatttataatgcagcccctcgcaacgaagtagacggtgttaataagcagtagcagcccaaggatgatatatgtaagattcttgtcttgtgttgtcacctcaataacctgaaacattgtaagggctcggtttgggaaaactggtagaaatgacgcttgacgggttgaggtagccttaggccccgtttagaccctcgggactaaacagttttaagtccgtgtcacatcggatgtttgaaaattaattataaatattaaacgtagactattaataaaacccatccataatcttggactaattcgcgagacgaatctattgagcctaattaatccataattagcctatgtgatgctatagtaaacattctctaattatagattaattaggcttaaaaaatttgtcacgcgaattagctttcatttatgtaattagttttgtaagtactctatatttaatactctaaattagtgtctaaatagagggactaaagttaagtccatggatccaaacaccaccttagttcccaattttttttccaaaaaacatcacatcaaatctttagacacatgcatggaacattaaatatagataaaataaaaaactaattgcacagttgggaggaaatcgcgaggcaaatcttttgagcctaattagtctatgattagccataagtgctacagtaacccacatgtgctaatgacggattaattaggctcaaaagattcgtctcgcgatttccaggcgagttatgaaattaattttttcattcgtgttcgaaaaccccttccgacatttggtcaaacgtccgatgtgacatccaaaaattttcatttcacaaactaaacatgcccttagctgatcacctgctggcttatggaccaaactgacccgaacacattttttaataaaatcataatttaattgtgtaggatagggaatctataagatatactcgatcagtctgaagtccctcactttaattactactccgtattttccttagcaagcataccattaattcaatataagatctatctttcttagagttatgcctatgtataaagagggaagctatatagcgcacgcgcgccaggaaaataagttgtgcacaggccttatccactaccaaccgattcccccctccctgcattcgcatggatgagacgtctagcgctgccgctattcctcctcttcgtcgtgagcgtgcacctccatctccaacctctccatcgagacatcatcaagcccagaatcggttcctctttctttcacactgggggagacaccatctttgatcggtcgcccaaaatccacaatagtcccggttcgaataaaaaccaggactaaagatgatttttagtcccggttaaaaactttttgacctaccaaccgggactaaagatcatttttagtcccggtttaaaaagttgtcgggtcgagttaggccccaactcatttttagtcccggttgg

SEQ ID NO: 17827 - DNA, 3301 bp, Oryza sativa
  unsure (1)..(3301): unsure at all n locations
ggcgcccgatctctgtgatgtagtttttttccctgatccgtgtgatatgtgcggtcgatctgtgggatgtcgattttttttcgatctgtgtgatgtgtgatgtgtaaatgaatatgtggagatgttttttgaatgatctgcgatgtatttggagataaaaatgcagcttgatgtatttggggatttttgtgaatgatacgtgatgtatttgggtttaaaaatgtagctggatgtatagggggattttgggaaggatatgtggcgttaaaatgatttgtgaataatatgaatggtggtgcctcgaaatcatgaaaagcatgaaaaaaaaaagaaagaacattagtcccggtgttaactctaaccgggactaaatctttagtcccggtttttaacactaaccgggacaaaagatggatcttttgtcccggttatttcaaccgggactaaaaataggcatctttagtcccggattcgtagtcccgtttgtataaccgggactatagggggttgcgaaccggtattaaaaagggtttgtccaccagtgtcatctccctgccagctgcttcccctacctctcttcccccaccccttctcccgcccctccccctcatgatgggttcccctttatctctccttcagcatttgttcccctaccatttgttcccctaccccgattcctcatgttgttgagacatcagcgacttccaccacttctctatagatttatccaggttttgcgttgaattttttttggaatttgaagaaggttgattgaaagtttaggctttcactgcttcgatgaaagttctatgatttttgagatgaaagttttgtgattttgagatgaaagttcaagttttcaatcaaaaatattttcagatgaaagtttcagatttttaattaaaagttttgtgattttgggataaaagtttcaattaaaagtttcttttttgagatgaaagttttgggtttctaatttaaatttttataattttcagacaaaagtttcatttgagtcgtttttttcaattttgatatggaagttttagattttgagttaaaagctttttaaatttgtgataaaagttttagcattcttgtggtcaggtggcatcaaggaagaagaacaagctctcgcctttgaatcaatggggagtggggctgaaacatgcgcacgacagcgggcctcatgggcatgcttgtgcacctgcagcggagctgcgccaaagcgctaagcgctagcggtgtcttgacatatactctgtatgttgtcatcatccaaacacccccggtggtacttggatcatggactaaactgtccctgtcctatcggatgtttgaaaattaatttagagtaataaacatagactacatacaaaactaattacataaatgagagctaattcgcgagacaatttttttaagcctaattaatttataattagagaatgtttactgtagcatcacgcgggctaatcatggattaattatgctcaatagattcatcttgcgaattagtccagagttatgaaataggttttgtcagtagactatatttaatacttctaattagtatcaaacatccgatatgacgtgtactgaaaaatttttagccccatccaaacacccccgatatgcgtcactgtattgtgccagatagatgaatatatctgtttaaaaatttcagtcccttaacaactgacaaaaggacatttcaattaattatacaaaaggacatttcaactgttaagtgtgcatggatatgcgaagggacgaacagtagctagtactacactagagattttttttttaagtacagtaaaggtctagatctttgaaagacatacaccacaccataaatagagcacggtaccaagctaatgagtactgagcagtcgagctagtgcccagccttgcgttgaacatcacattacgtacgtttcagcaagcaggtgctcgatcgatcggccatggcaccggccacggtgctcaactccggcgagcccgacgcccgacgccgcgagcggccgcacgtcgtcttcatcccgagcgccggcatgggccacctcctcccgttcttccgcttcatcggcgcgctgtcctcccacgaagtagacatctcagtcgtcaccgtcctccccaccgtgtcggccgccgaggccgaccacttcgcccgcctcttccacgacttccccagcatccgccgcgtcgacttcaacctgctgccgctcgacgcctccgagttccccggcgccgacccgttcctgctccggtgggaggccctgcgccgctccatgcacctcctcgccccggccatcgccggcgtcgccccgcgcgccacggccgtcgtcaccgacgtcacgctggtgtcccacgtgaaccccatcgccaaggaccttcgcctccagtgccacgtgctgttcatctcatccgtgaccatgcactggtggagaaaccatctttcgtcggtcggccgatttccacagtagtcccggatgcaataaaaaccggggctaaagatgttctttagtcccggttcaaaagggtaacgggcatatttgatctttagtcccgggttgtgttaccaaccgggactaaagatgatctttagtcccggttcgaatgctgtcagggtctgtcaggccctcccggtatctttagtcccggttgataacaccaaccgggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaannnnnnnnnnnnnnnnnnnnnnnnnnnnnnnnnnnnnnnnn

SEQ ID NO: 17828 - DNA, 1120 bp, Oryza sativa
  unsure (1)..(1120): unsure at all n locations
agagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtacgagaacctagaagcatgccctgtttgcaaagcactacgatacaannnnnnnnnnnnnnnnnnnnnnnnnnnnnnnnnnnnnnnnnnnnnnnnnnnnnnnnnnnn

SEQ ID NO: 17829 - DNA, 3173 bp, Oryza sativa
  unsure (1)..(3173): unsure at all n locations
nnnnnnnnnnnnnnnnnnnnnnnnnnnnnnnnnnnnnnnnnnnnnnnnnnnnnnnnntatacacatataccttggacggtgattcaaaacaatttttctcttaaattacttatccaatctacaatccgatcacaccgttgtattcgttgtaattaaatctttacaacaagatgtcacatgattatattctaattaaaaataatcatatgtttcaatccattaacactctttgtttcatacgcgatagtaatatgtttcaatatgtctcttcagcatgtttcacaaatttcgtggaactacatctcactactctctctcctctctccacctcatgcatgcatgcattttagcgggcttcaaaacaacttttctcataaactaattatccaatctatgatccgaacacatcggtgtattcgttgtaattaaatctttacaacaagatatcacatgattatattttgatgaaagaaaaacatatgttttaatccgttaacactagttgtttcatatgtgatagcgatatgtttcaacgtgtatctttatcatgtttcataaaatttttaaatgtttcagttgctgattttttgtttcaccatatataatttgatgtttcactcattggtcaactagaacatttgaccaaccaattttctttgggacataggacgttagatgggaagcttcctcatgattgaggagtgaagaatgaagtacagcaatatacacatacacatacgctcgctgcttggctggacgtccgatatttggtgagatatcggacgtccgagccgtagcgctctccgaaacttttgacacgtaagaaattttttattttccatttcagacaaatgctttttgttttattgaaaccgacatttcagacaaatggtactacaggcgtacagctgctataaaaagacacatatgccaacgctcttatcagtcgagcattcacccagcattagccggtttcacaacagcatcataaagcagctgctcggccatggcaccaccgcctgcggtgctcagctccggtgagctcggcgcgcgagggcacacacggccgcacgtcgtgttcgtcccgagcgccggcatgggccacctcctccagttcttccgcttcatcggcgcgctgtccgcccacgacgtcgacatctccgtcgtcaccgtcttcccgaccgtgtccgccgccgaggccgaccacttcgccgccctcttcagggactatcccagcgtccgccgcctcgacttcgacctgctgccgttcgacgcgtccgagttccccggcggcgacccgttcctgctccggtgggaggccctgcgccgctccttgcacctcctcggcccggtcatcgccggcgtcaccccgcgcgtcacggccaccgtcaccgacgtcacgctggtgtcccacgtcaaccccatcgccaaggacctgggcgtccagtgccacgtgctgtacgtctcctccgcggccatgatgtccctctgctcctacttccctatctacctcgacaacaaggatgccggggccgacgtcggcgacgtcgacatccccggtgtgcgtcgcctcaagaggtcctggctgccgcagccattgctcgacctgaacaagctcttcacgaagcagttcatcgagaacggccgggagatggtcaagaccgacggcgttctgatcaacacgttcgacgcgctggagccggtggcgctcgccgccctccgcgacggcaaggtcgtccgcgggttcccgccggtgttcgccgtcggcccgcacagctccctggcgagcgaggcgacgaagggcgccgccgccgacgcagaggggtcgccgatggcatggctccgccagcagccggcgcggtcggtggtgtacgtcgccttcggcagccggtgcgccgtgagccacgagcagatccgggagatcgcggcggggctggaggcgagcggctcccgcttcctgtggatcctcaagaccacggtggtggaccgcgacgacgacgccggcatccgcgacgtgctcggcgacgggttcctggagcgcgtgcgggggcgcggcgtggtgaccaaggcgtgggtggaccaggacgcggtgctcagggacccggcggtgggcctgttcctgagccacagcgggtggaactcggtgatcgaggcggcgacggccggcgtgccgctgctggcgtggccgcggggcggcgaccaccgcgtggcggcgacggtggtggcgagcagcggcgtcggggtgtggatggagcagtggagctgggacggggaggagtgggtggtgagcggggaggagataggggggaaggtgaaggagatgatggccgacgccggcgtgcgggagaaggcggccaaggtcggcgaggaggtggccaaggcggtggccgtcggcggcacgagccacacgggcatcctggatttcgtcgccaagctcaaggctgcaacttaagcattctctctcgtgttcgtctgagaataaatatctactgctacataattcctccttcaatgtcacgtataagtgtacaagtgaaaggagggagtgtgataaataaaagcactctcgtgtgtgcggctatgcgtagtttgggattgaaaaaggccaatttccaattggcaccaccaaagctcctccttgttcccggttaggaacaaatttggttgttttcatttttcagtttgtttcagttgtgttgcaaatctattgtcttggattctcccccatcttctttcttttcacatgttcttttaggccattcacaatgcaacacgctggcattcgccctgagcggtccacgttggcgagtagcccaaattcaccgtcacgttatagcatgggcccacaaaactcaaacgcgtgtgaccaaagttggtcacccgttcttcggcacaatcgggactaggtggcatggggaaacgaggtcgcggcgcattgcggaggcatggcttcgccacaccgttcctcccgatgagatttctctccctctatccccaaattgtgtgacggcgcggcgcggcagcatgaaggcggtggaagagagaacggagagcggcggcgacagcaagaagggagaacgagagtggtggagaagaagaggagcctaccggcgacctgggagcaccacatcggnnnnnnnnnnnnnnnnnnnnnnnnnnnnnnnnnnnnnnnn

SEQ ID NO: 17830 - DNA, 758 bp, Oryza sativa
tatatatatgtatatatatatatatatatatatatatatatatatatatatatgtatatatatatatatatatatgtatatacacatatatatatatgtatatatgtacatatatatatgtatatatatatatatacatatatatataccactttattattaactttattattcagaaatatatatgtgctgaattcactactattcactactattcttagtgctgaattcactgttatgagtacagaattactgtttacaggttactgttcactcgaaaattttctttaaatttttaggatctttgcagggtggcgaatccaaaaacagccggcgcttgatttagaaattttaaagtcctactcggtactagccgtatgcctcacttatctgcctatttaagcaaccaacttcaggtatccctagtcatatttgaactagctaagcgtttaccgtctccccaggcagttccacccgaggggaacacttctctacggatactggttctccagacgcctatgcaagatgcaggctaaaaacgagaacaaccgagaggtttctcctatagggtccctagcataaacgcttatctagagcaaacaaacggggaaacttaaagaaaattacttcatattaagcaaataggcttacatacggttttcctttcgggaaccccgaaggtagatacaaacaagtttttctcaccttacaaacctttatattacaactccttgcttcaatatatattatgcaaggta

SEQ ID NO: 17831 - DNA, 631 bp, Oryza sativa
tcagaattgggtcacagcccatgggcagtaaaaaagggtcttctttatgggagaacccccgccggtagaagctcggcgactggattggcggcaaccgcccgccgccgccttgagaggccttctccccctccgattctgcttcctcctctccctccccgtcgcgatcctccgttgctgtcccgatccctgtccgcgagcgcatacgctccgtccttcccatccagatcgcgccacccagtccgccggcgcgtcgtacgcctccaccagctgtcggtcctccgcctcccggtcaagatccggcaccgcgccgccgtcctccgtcgcctccgcctcctgttcgagatccacagcaccgtgcaaccctttctctgcaagtcggtttctgcaaccaaggtttgttttctttgctacaggcattgctatttttgttcttggtttcggtgcagcagattagattgctctgctaacatctgaatgaagcaaatctttatcacatgttgaaattgttgatccagctagggattgcttatttgtttgccgattccagtacaaacttgtaaaaagctattaggattagattagacattgaatataatgtataagcttgtatagagagatcataggattctct

SEQ ID NO: 17832 - DNA, 737 bp, Oryza sativa
  unsure (1)..(737): unsure at all n locations
tnnnnnnnnnnnnnnnnnnnnnnnnnnnnnnnnnnntatttggaggaacaaaagaagaaatgggggatacaagtttctagtaacacagaaaggaggaggaggaggaagaagagaagtagatcgacaagggatgcccaccggccgcccaggtcgccgtcgtcgccgtgagcctcagctcgccaaattgatcaatcgatgcccccatgttttctgttgctgctcatatatgctggtagtgctgcttgcttaggcctaggctggaacatgactaaccgagcccatggtgcagcccagtagaggcccgacacttgggcacgtagtacatcggcaatgagcagcaccttgcgcaacttgatgttgtaatgcatgatccagtgctggaactcctcgtgcaggtacctcactggccttgcacaccatgccaccgccgctgccatgctcgaacatgacgcagtcaagcgagccgttctcgaggtacttgtaaacaagtgccttggtggtggtgccttgatgtggtaatatagctgctcctcggtgcggcggtccagtgtgcggtgcagggtcttgacagccacctgtacaccgttggaaaacttgccgtagtacaccatgccgaagccgctccaccaagctactacgctccgcgtagcccccggtgaacttgcgcagattctccggcgtgaaccaggcgggcttctcccggagtatgtcatccaggaagggttccacccagggtt

SEQ ID NO: 17833 - DNA, 408 bp, Oryza sativa
cctttcagatttatgcagatattgacagcgtgaatttggtatttaatagccgtcaacagacgccaacttcacgctgtcgacccggagcaacagatccggccatggggggaggaccaaatccgtgcttctcggcgttggagttggacgccaccgatggcttttcctcggcgtcggcgccttgccatgcatgagctttctcttgctggcacctcgaccgccttgaccatgagcgagagagagagagagccccatcaaggtcgttctcgtagctgcctgtttttgctggcagcgactcgggcggcggcgaggcgaggcgggggaggggaggagaggggggaggggggcggcacagcttgtttcaccacccgtgtcgtccccggggcagagcgaccgggcattggtatcgct

SEQ ID NO: 17834 - DNA, 195 bp, Oryza sativa
cctcaccctcctccgtcctcccctcccccttcccctccccggcgctctctctcgtctaactccctccccggctcagatttagcgtgagggggcgggaggcattgggtggcggaggcggtagccggcgatggcagctgcggaggaggaggtggctaccggcggtggcagctgcggcgcaccacggatgttcatatg

SEQ ID NO: 17835 - DNA, 2069 bp, Oryza sativa
gagtattccaagggtatcaaacatgaggaacatacagccatttgatctccttgcttaaatctttagagtcagattaccataactccttccctcggcacatcagccctagatccacccacgtcattgccatgtcatctatctctatacacgtgtcaccacgaggcatccacgccagccgacccatcatacaccgagtccaccaaaacctgagccactaatcagtgggccccactataattttcttattaaaaataattcaatttaaagaattaatatccataggatattcctggaatattccttttctttctgtcattagattttctctgaatttgaacttctcgaggtcttaacttatccgttcgaacttcgattttgtcagggttacgggtcaggcataccctctacccctcgacatacgtcacgtattgacaaggcctattcacatgtgcacggataaatcctttggcgtctaaggaaactcttcgtaaagtcaatggacgaagagagacctcctcggacaagaattgggttacctacgtatcgtgccaggtctggtatgttcgagtcctactcggagagcacccaacctacggtataaaagggaccccccggggagggcatagatcatcgaatctcagagccaacacaacccacacagcctacgaagtcggagcctgcaaggagccaagtcgacgagagctagtcgaatcatctcgactacaatctcgccaaatcccctgagttccgtcttttcctttgtaatctgtgttttccaccatataatcccatatcaactagattagggctattacctatcaaggagcctgaaccagtataattcttgtcttttgattgctcgatgtcgtactacgtagatccttataccagcgtaccccaataccctctatatccggtctacgggtatcccccgtcgacagatttgacatgctcttctttctaaattctaggggtaaaaacatatcagatattatctggtcctatccgcttcgaatccatctgaaacgatgatatggtatgagtttttagaaatccgatggatatggatgcagatgcggacaagatatctctaaaatacaacagatgcggactatccgataggctatttgccgcataatccgaaattatcaacttatgtaaccattcaatctgttgcatataacatgagttggcacatctaatggcccaattcatcaattaacctagattcgttagtccagggctttcaccgtctaactaacacttgcttagttgttttttatattgtggatatcatgtattcatgttatttagtacttaagtacataattattacgatggtccgttcattgattattgcgttgttgtcctttgcattgctaactcaatggtgtattgcttgcatacacacatagcatctgacaaatttaatcagtttccgaactgagtccacaccaattccgacatccaaaacaatccgttctacatccgcatccactctgaatccgcttaaaataccactatccatccgaatccgctccatttttacccctactaaattcttgtaaaatcgagctcaaattcctggttcattggtttattttatttgatgttatttagttagtcttttcttttgtttatttgtttttcgtttgtgattgtgtagacgttggagtacaggagtggttcgctgcagaaggcacaatgcaggaatgatacttggaggaaggcaagtgaacatattggacccaatttataaatatttttttgaacacatgcattcttttatttatatgctatcgatgggtagggtgacctaattgctattataccttgccttttataattattgattacctatgataccttgtcatcctagtttttctgagttgaacattgggctcatttcaaggtagagtagttatgtttagctctgctcaaggttgttttgaagcaaaatataattttgattaatcatatatttataattatttgtatatgaaccgtgtgactgtgaactatcttttcgatagcacgtgttgttgtgtaataaacaacgggcggataaa

SEQ ID NO: 17836 - DNA, 2324 bp, Oryza sativa
attattggtatatgaaccgtgtgactgtgtactatcttttcgatagcacgtgttgttgtgtaataaacaacgggcggataaaacgttttggatcagggtgatgggtggttatgtgtgaacctgggttcggtggtaatgtacctatgtgatcattaccgggtatggtatatgtgtgagcctactgtcaagctgtgtgctatttagttgctcaaagtgacaactgtgtgtccttaattataaatatatgatactaccaatgtcgtgtgctattgtagtttggtaagttgccctatcaattgaggacttcacttcataagccatttatgtgagcctaccatacaaccatttgttcttatgagaataacctgaactagtatgattccgagtcttggcactactactggcagtaactagatgataggtgtgaaggttacccataggtagtttcttgtctgctgtgtgagggaaagctgtctcattgggggaaagcagtgttggggcggagtgtctaaagagcctccttacatattccttggctgcacataacctcaagtgtgacacttgcgcattgccgttaaaaggatgatgtatcttatgggtcaagctgtacaatatctgttgagtgttaaactaatctattcgaatagctgcgtcagtggtcatggacatgcttggtgatttctcatgaggggcagtttgtgaaaaccaggaatgagctgtgtgctggttaatgaatatagctatatggtcttgtgcagatagatcatgtgtcgatgaatggttggtagcacctgttatttataaatgttgttttaaatctattcataatttgtttataactaaaaattgttgtttatgcgaaatagccattgccttctttgttagccatgcatatgcatatttctgtgtacttgttgagtattctagaatatactcaccttgtaatgcccccaattatagaacaaatgtttttattgtttcctgaagagtttgctgctgaagacgaggaataggttgtgtgtcacaattgactacatgtggcaagttgaatggagcttctacgtatttatcttattttcactgctactttattatattcctaggtccttcgtagcagaataaatttaaactgtagacataatcttatcgtagtcattttattaataaccgttaggtttcttttgtgatgttggctgtgatattatctgtgtctacgtgtgctagcctgattctggagtagcacttaagtggtcctattttgggtcttcataaagttggtattatattagagccgcatcgactgtaggccgtacccttatttagactggtcttactatagccagcgacgaggacgatggcagctcggtgcacaagaagttgctcctctccaaggagcagtccacgtcggtggagagagacatagatagatagatagatagatagatagatagatagagatggatgcagcgacgatggcagtgcggatggatgcggtgctccgcgtcgggctcggggcacctgggtggagagagagatgggtgcagcggtggcggcagtgcggatggatgtcatgctccacgttgggcttggggcacctaggtggtgagagagagatggatgcagtgggagtggcagtgccgatggatgcggcagtgttgatagtgcggacgaatgtggcgctctaggtcgggctcagggcacctgggtggcagcgcagatgaaagcggtactctagttcgacctcagggcagagagagagagagagagcgcggtggagtggaggggaagagcagtgctgacagcagcgtccattcacgcgacggcgacagagtggagattatggaaactggggagcttgacggctcgaccgagacggaagcggcggattggagaggatgtgaacaaagcggcggcgagtctacatggcagcggctatgctactggccagcgtggcttcgacccctctctctgcacatccctaacggtgcagatatcggagttttcttgcgacggtgccgtgcggctcacaaaatgcagcagatgggaggagtagtggaggcccacgacgtcactgattcggaaccggtacagcccacggaacatggcggcgatcagctcgtacgttttgctggtctcgatgatgtgatatccaccggctctgctgtggcggcgtgacggccagcatccatgtcaaacggggtgaactcgaattaggctgctgtgggaagcacgtagagtatagatggtttcctccagcggtgatgtgcactctaggttgatgccgatggcacactcagaggcgaggtagtccgtgccgagcacca

SEQ ID NO: 17837 - DNA, 1305 bp, Oryza sativa
  unsure (1)..(1305): unsure at all n locations
nnnnnnnnnnnnnnnnnnnnnnnnnnnnnnnnnnnnnnnnnnnnnnnnnnnnnnnnnnnnnnnnnnnnnnnnnncataaaatgcagcagatgggaggagtagtggaggcccacgacgtcactgattcggaaccggtacagcccacggaacatggcggcgatcagctcgtacgttttgctggtctcgatgatgtgatatccaccggctctgctgtggcggcgtgacggccagcatccatgtcaaacggggtgaactcgaattaggctgctgtgggaagcacgtagagtatagatggtttcctccagcggtgatgtgcactctaggttgatgccgatggcacactcagaggcgaggtagtccgtgccgagcaccagcaaggcctcgccgacgaagtgcttgatcaccaggaagtcgatcgcagagctgccgccacttggagcgatagaggcgcacaacacgcaccagggtggctgcgtacggcgtgcgaatgcagataacggtgtcccacgaatttttttttattttttagacctttttttaaattttattaatataccttttcaatatttccaaaaattaaaccttttgatagcgttgtcctgccatgccagatgcgcgtgacgccatgccagatgcgcgtgacgtgatagagttatttggccatgccagatgggctggcgtggccaaaagttcagatttagaaataccttttagaatggtctattaataaaattttaaaaataaaaagtataaaaaataaaaaaatttcgtgtcccaccggccaagcccgcagaggaggtggtaatacctttgctccttcgccgcctcctctccccactccaccatgctttcgccttttctcagcaagttctcgccagtgaccaccactgatgccaacagaaatgtattggactgaaatgccccgacatgtgggtctaactcagttgccatgttagctaaaatctggttcgtaacttaacaaaaagggggacctcaggtaaactttttccaatgttggagacataaattgactttcctcctagactagaaaattaataagcacgccgtatgacgcgctttatttataggctgtctatttctggatatgtttatattgtacatttaactctattttttatgtttgcgtttaaatctgcatttgatcgttaatcttgttaaaaaaatatattgttataatttattttttttatttatattgttactaatgttattttgaatatgactatatgtttatatatttgcataaaaatcttaaataagatgaatggtcagacatatattcaa

SEQ ID NO: 17838 - DNA, 3548 bp, Oryza sativa
  unsure (1)..(3548): unsure at all n locations
attcaaatatcaacggtgtctaactcaaggaataaaataattaatttatgctaatcttgtttatgacaatttattgtacttttcaataacatttttaaaattgatggtttcaaaagtaatactacaaaataagcatatttttattgcctatatgcattaaagagagaagttagtgtatatgagtttgaaagacgactgtattcgttctttctggttcctagctccccgcctcgtttttcacgtgcacgcttcccaaactgctaaacggtgtgttttttataaaaagtttctacacaaaaattgcttaaaaatcatattgacctatttttgaaaaaaaattagctaatacttaggtccggttcttttctccaacaagagttggatgaagattaagattttcgttgcacgcttttcaaactggtaaacggtacatttcgtgcaaaaactttctatatgaaagttgctctaaaatatcatactccctcagtcccataatataagggattttgagtttttgtttgtattgtttgaccactcgtcttattcaaaaaatttgtgcaaatatacaagacgaaaagttgtgcttaaagtactttgggtaataaagtaaatcaaaaaaaataataattccaaaattttttgaataagncgagtggtcaaacagtacaaacataaattcaaaatctcttatattatgggacggagtgagtattaatctatttttcaagtttgtaataattaaaacacaatcaatcatatgttagtaccgtaaaaaacttaatcttcatcttcaggagaaaagaacaccaccttaattaatcatgtgctaatagatcgtttcgttttctgtgcacacggttccagatggaacctccagcaacaaacagatcgttaagtggctaaaaagagtgctaactcaggggtgtttggatccagggactaaactcatatcggatgaatttggagtattaaatatagactacttataaaactaattacataaatgagagctatttcacgtgacaaattttttaagcctaattaatccataattagcgcatgtttactgtagcatcatataggctaatcatggattaattaggttcaataggttcgtcttgggaattagtccagggttataaaatgggttttattaatagtctatatttaatatttataattagtgtccaaacatccgatgtgggttttagtccgatctaaacagggtctagtgctatggctccttcatgcattccacgtttcattgctctctttctatcgttaccctctctacccagtgaccaactcaccatagctctctatatcgcctatcgtttgggaagtttccacactcccagccatagtgatagcggcatacacggatgcatctagcgcagccgccgctccctcatctcgatcgcccgacggagacctggaccgaggaggtgatcgttggcggcgcatccccgcacgagtgccgactgcgcccgtgcatctcccgactcggctgtattctcctgtccctccacggatccactcccgaagatgcttgcttgctgttgctgaagatacatgctggttggtgctgctaatgcattcttgatgttcttgtgtacctgtatagtgtgtcgtccgtggatccggaagagggaagcattgatgccgttttattttacttttgcaatcactatttttttgttcccctggccttttccttataaactattctgcatttatatttttattcaactgaaattgaaaactaaagaatgtaaattctttgattataaagacgacagatagtttgaagtttttgaatctggatgtggtgcttaaagctctttttttccctctgcatttacctttttctttctttctttaccaggtttatcttcacactttgatctgtccccccggtgaactttttctttttctaaaaaaacaaacttgcctgggagggaagtattttggatttgttgaaccaaaatgtctaggacggatatggtttttttaaaattgcatgtcacactctatttatctggattcatctagtaccacgtacttctttttcctttgtattcgtatgtgcttggccactaacggtactagcagtccgccggcacaagttcaggcagatcaggccgtgtagatcgagccgccatcgccccctcctccttctcatcgcccaaagcaggtgtcaccatgccggtggcagcctacggcactatgagtaggcagatggagatagtaatctattttttcttgcgattgttttctgggatttttttctccaatacttcggacttttctagatgagatcgtacgtttgtaaaaaaccccctatcgaaacttgtaatttccatttaggtccacaggacgggttttcaccgtcgatacgtcatctaacggggctgtggataggtgcgtacacgtggcactttctacagccaagaatcaggaggagagctccacacgagatgctacgtcgctcaattggaagcctgggatcggaccctgaaatcagtttataagatctggcccaacagaataggtggagggtaacggaagggagatgggttgggcttggctagaggtttgagcccgagaaggagatttagacttaagtttatgttttttaatttaggggtattcctttatgggttgagagaattgataatttgattatatttgtaatttaatttattgacgtctctttagccttatggtctccactcagattaaggtggcaattattttctagagttaaataatatttgttgtaattaaatgatatttgttgtattgacaattaatttaactcatggtctcttagtgtcaaattatatgcttgttcaattgtgggcattatatttggattagaagttaaattggcaactaatttctccttatttatactgtataagctctatataattttgtaaattaattcatttcatccccttggtatgattatgggatttagttattcatagctttgttttaagttgaacttccacccaactccagcaaagatcactgcgcatgatccaaaagttctaaaaaaattcaaatttttactgattttttaactgaataggagtattattcagggtgttacagtcaaccggactcttggatcagcgttcgctctgcacaggctcctatgtaccggggggactcaagaccacaatcaacgtcgtgatgcgtgagctgatggcttttgatgggctcggctgatatttttcatcagtgaatctatggggttgtttggtttaattctttcatccatactttagaccgccaaacctccataactatgtttttgctaattatcatagttgtaaattaacacattttttaagcaccttgctttacatatcatagatttaatcttttacctaactttaccacaaatacaacttacaatctataggaaaaaaaaatatgacaagccacacttttctaaaataagttataacaatgttagttgagaactaannnnnnnnnnnnnnnnnnnnnnnnnnnnnnnnnnnnnnnnnnnnnnnnnn

SEQ ID NO: 17839 - DNA, 686 bp, Oryza sativa
  unsure (1)..(686): unsure at all n locations
cnnnnnnnnnnnnnnnnnnnnnnnnnnnnnnnnnnnnnnnnnnnnnnnnnnntacctgctggaggccattcggtgctggtaatagtcatcttacgtacttcttcttcagttcgcatcggtgcttttctcttctgagtcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctattaaaccaaaggaaggggcttctttggcatatacccatggacaattcagggcatagtgtccttgttctctacaatcgtgacaaaaggggacatcttcttctggcattggaagctcattgacctgggtggcaaacgctcgatcaaacacatactgattttggtcttgacttccaactaatggtagctgtgaactaagcagcatgcttggaatggaccgagggtgtgcccttgttaactctcttgaggccagtggcggattgagttgaaaacttgagttactggaggcatacccgctgacattctttcctttttctctgttaaacatctgttacagggattgaggtgagagaggaaaccaaccaggaaagaatagacc

SEQ ID NO: 17840 - DNA, 901 bp, Oryza sativa
  unsure (1)..(901): unsure at all n locations
nnnnnnnnnnnnnnnnnnnnnnnnnnnnnnnnnnnnnnnnnnnnnnnnnnnnnnnnnnnctcgtcccaagccaacccaggccaaccattgcacattttagttgttgagcaaattttaagaattagaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccatagacaagagtaccgacccaatcctgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaaattataaaaccacctaatgttgcctaattaatcagcgaagcatctacctaaattcatactagtggaaccataaatagagtgtccactagatggggttttgtttattctagggtgaacaaggtaataataacaata

SEQ ID NO: 17841 - DNA, 887 bp, Oryza sativa
  unsure (1)..(887): unsure at all n locations
gcgatgttggtgaaggtggtggtgcagcggggcgacgagccgacgaggaggaaggagaggccggcgcggagacgatggcgttccggcgaaattcgggcgacgccgtggcctggccgggagagaggacggcactccggtgccgggggaggtggtggcgacgtcggccggcgcaccggggacgcggcagaggcggccggaggtggaacagtggcggcaacgccactgttttgccggcgagaacgcgtctccggtgttttccccgcgaaacggagggctgaccgagggagagggggtggctgcgaggccgagggagaagacggcgcggccggacggcgcacgggcgaggcgggagaggcggctggaggcggccggcgcggagaaaagaggagggcgacggcgggaaggcagctccgggggtcacctcgcgaaacggagggcaagccggggtggaggaggtggcggcgacgctggaggaggcgacggcgcggccggccggcgcacggtcgaggcggcaccggcggctggaggcggccggcggcgtgggagagagagggcgacggtggggagggagctagggaccacggggaggctcgggatggggctaaaacgagagaacgggggatgaggatcccattttataggatgggggagggagccggccacgggaggagcgggaacggcggcgggaaccatggccggcggcaatggttggtggccggacttggcgcgtccattcccggggattgaaggcaccattcaaggggaaattaagggggaaagagagaggagggaaaggggattaattcccctcaatcaatttgggaatcccannnnnnnnnnnnnnnnnnnnnnnnnnnnnnnnnnnnnnnnnnnnnnnnnnnnnnnnn

SEQ ID NO: 17842 - DNA, 1907 bp, Oryza sativa
ttgtcatcataagaatgtcatgcttatcatttacttctaacttgccactgaatgctttggagtatgatgtcacgcttatccagcataccatgtttgacaacttgtcactaactgcatcatattagctttcctagcctccgggtgctagatactactgctattcgatgcaagggtcgataacttttgcctttgaattacgtttctcaaaagaaccaacttatcacacttgacatgctttgacatcttcctaaataactttactactgaacttgttattgtctgaccgttttcctgccaaatctgaagctttgttgttagatgcgattttaatctgacctcggtaaactatcttcgaacatatcacttggttcataactgggaatagctcccacgaacagacaactcggattcactttccactcctcagttagcattcaacgtattcctttacacctttaaccttgatgtgttctttccagatttctcttatcaatcacctttcgacctacttctttgcctgatcataaacacctttgctggtatcttctgagagagtcctcatagaacttgtctgtattacacatttctccctcattacatgaatactaagcattgtctaaaaggaaaggtgcttagcaatggtacattgcatcctcaacatgaatcttccataaacataacgaactcattgtttataatcatgaatatatttatttattacatgattgctacaaactttctattacacaatgataagtagcgaactgaaaaccacaaacggggctgctcactttgattcgggggagatatagctggcattgtcctagtgactgcatccttgattggttctgtgatgatgtggtaggactgcgtattgctatcattcacaggagaagcttccttctgattgctgtttgaagcggatgacggttttctgcttggtatcgccctcctgaggttgattgccctttgcttggcctggagtaggtcggggagagacacaacttcttccatcaacgacaattctttgctgaggctgtcggtgcagagaatggttggtgctgaaggtattattgctatgatttattgcagagtcaggtgcagcaggaggagcattggtgctgtggatgatatcgtcgatattgccgttggagctgactagctgatgagacaatcgtagggttgttcgttggatttctgcggtcttggtcgacaacacactgagttggcaatccttgggcacatggtttgtaccttcgcatagaaaacatgtgaccttgcaggtgggacactcccctggtggatggtcttcttcacaataagcgcagagtgtgagacacatgctagcaacgtgtccaatttctccacaacgggtgcatgcctttgattccatctcttcctcgccgagatgtcggggagactcatcttcatcatccgaggagacttgatctgacccttcactatcagatactctgccaccgtggcttaggaggtgctgggtcaactgtcgtgcacctcggaaggtatttcctctttgacgtctaggaatagttatccctgctggaggccattcggtgctggtaatagtcatcttacgtacttcttcttcagttcgcatcggtgcttttctcttctgagtcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctattaaaccaaaggaaggggcttctttggcatatacccatggacaattcagggcatagtgtccttgttctctacaatcgtgacaaaaggggacatct

SEQ ID NO: 17843 - DNA, 2377 bp, Oryza sativa
  unsure (1)..(2377): unsure at all n locations
nnnnnnnnnnnnnnnnnnnnnnnnnnnnnnnnnnnnnnnnnnnnnnnnntatagccgaaccaagcgatgggtcggattgtgttaatgatttatgcaatgatgccatagcaattatagccgaaccaaatgttggttcagattgtcttgctagcttggataataatgcaacaaccattatagccgaaccaagtgttggttcggattgtgttactagtttagacaatgatggaatagccaattcaagtgatgattcggattgtgttgctagcttagacaatagcatcatcgaagatatagccgaactaaatgacagtttggattgtattacaagcgaaagtgaaatagcattgtcacctaagaccaattcacaaatcggtcatgtggatgttggaaaagatgatgataatgtcttgcgggatagtaatgagatagaatctaaaatagttatgcatacatatcaaaggccgtatcctgaacacatagattcggtcccatacccgcaaggatttgaggtgcccaacttcacgaaattcacagatgaggatgctagaacaacaatggagcatatcggccgatttattgatcaatgtggtaaggccagtagcgatgatttgcttaagttaaagttgtttcccctttctttgtcaaactttgcatctacatggtatagtttgcttgctcctaattcaatttctacatggtcacaaatggagcataagtttcaagattatttcaaagatgcaagcttgatggagcaaagaccgattgatacttcatcggtcacttgtgaaacgatttcagttacatctatgcctaagaccggaattgatagtaatcctctccctattagtcctattgatgttaacaaaaagaaaaggaaaaatgttattattggggatcctcggcccaagactagaatcaataatgcgaaggccaaagatcataaagttgcaaatgatgagtcatctagtttccaaaagaccaaaaagccgaagctcacttttgagatgcttatggctaaatacaagagaggattagccggtcaacgatttgataaccaaactagtgattcgaaaagaccaagatcatctcgtaggaagagatttggtcaaacatcaaagcaatcggagccatcaaccataccaactgtcgcaccgggaaaattgccttttcccgaacgctagtgtattaatccccgtcccaggaaaagccggggtacaccatacaaacatgatataaaagacacatctttattacatcgataatatttacattattacaaaggcgcttcaggcctgacaatcaaaaataaacagcagcggactagcgggcctacggctcaatcttcacaggcgctcaactggggtataagccaggactccacctaagacatattctccaaagcttctcttactgaagaggggaaagattgagcaagaatgagtacaaccacagtactcagcaagccacaccggagatgcataattaatgcaagggggggtacaaggagataataatataggggttaagttttgcaataaacggcatttaaaagtcacttagttgcccaaaaccatttataaagacgatcctagagctacacagtattattaaacaaggccgtgaaccctcacgaacctgccctaacccaaggcctacgatgattcagaccgaactggtaacccgaccctgggtcccagctcgtcccaagccaacccaggccaaccattgcacattttagttgttgagcaaattttaagaattagaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccatagacaagagtaccgacccaatcctgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtnnnnnnnnnnnnnnnnnnnnnnnnnnnnnnnnnnn

SEQ ID NO: 17844 - DNA, 1247 bp, Oryza sativa
  unsure (1)..(1247): unsure at all n locations
tgagaagtgtgaaactaatcacgaaagccaatgttagacccgcccataacggcgggcatggctattcgaaatagtttactctgatcagaggtgtaccactgtacccacaagacacaaccccacatcatgtcaccatgtgcttcaataccacccacggtatttcggaaaggagttgtgacaatacccctcgcataacacaatccactgcagcgcaccttcntggatcataatcacccccttataancaaggcatggactccccagcgacccccgtgggcttatctccgccacttctcagtctggtgcccccaatgaaccatgctatacaaaagataaagccgttgcccatactggcttgtggttggcacgataaatgtttcacaaccgaaactcgtgaaccggtccttaattgtcatgagcacgaccatcaaaaccatgtgctcacaacccaccattatcaggttttagttggcacattaattaattaactaatcacgatcgaccatcgtgaactatcattaagccatcatgaaataatagtgaatcattagttatcccataaatgtgctaatgtttctaagcagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttatatcggtttaattgaattatgacgcaataatgaattatttttgaaaaggaaaagagggtttattgcgtcagcgggctagggtttggtggaccgggcgcacgggcggcggttcacacgaacggacggccgagannnnnnnnnnnnnnnnnnnnnnnnnnnnnnnnnnnnnnnnnnnnnnnnnn

SEQ ID NO: 17845 - DNA, 627 bp, Oryza sativa
  unsure (1)..(627): unsure at all n locations
nnnnnnnnnnnnnnnnnnnnnnnnnnnnnnnnnnnnnnnnnnnnnnnnnntgtgtagcgccagctacatataccaaagttagatttagtttaaataaaagggagtcaggtgtacataccgtgaagtaccaagacccgtatctgtttgttttttttcttatctctgtcaaaagctcaaatcaagaatttgttggcatggcctcaggccgcacgttgcacctaccccagtatctctagtactagctttcttttccatcttaaaactagtagttggatcctgcttcattgtgacttctttgggtccagatcttttttccaacaaaaagttgtataaaaatttgaatattcgtggtactcttttcaaacggctaaatggtgcatttcatatgaaaacattctatatgaaagttactataaaatatcagataaatattttttgagtttgtaataattaaaactcaattaatcatacattaataccacctcattttgcataaaacactaaatcttcatcttcacctacatgaatttcaaacaccaccttaatactacctccatcatataaagcatgtcgtgttacagataaaaaatatcccacagaagctgtcgttttaacatcttcacagga

SEQ ID NO: 17846 - DNA, 1224 bp, Oryza sativa
cttaacggcggccggtccggtgctagccttctcctaggtctatgtattgggcgttgtcggtgcgtgggcgggggtaaattttttcgttttcccggttacgaccttccagagttgtaatcatgtatttttttttctgctctatcagtttgaacttcgctgtctttggtgctagtcgttaaaaaaattctattaggtctcgctctgatcgattcgctgagattgcacttagggcccctttttcaaaggaaattcataggaattttagaggatttcatttctataggaatttttcctatataaccctttgaatcaaaggaatggattctatggaatcctatgaaattcctatagaatgcatcttcccatacaagttttggaggaaatttaacatgaggtagaaccctatggaaagaattatttgagtctttatctctccttaaattcctgtgtttttcctgcggcccaatcaaacagttattcctatgtttttcctgtgttctgtaatcatctattttacactagcattttttgtctgaattctatgtttttcccattctcctattttcttcgttcttgtgattcaaagatcccttaacaaattattgcatgcgagtgagtccgtgcagttcccgtgatttgttgatcttttcctctcgtaacagtaggagcctgtgtaacatcaacagacaattttgccagcgaacattgaccaacgtacagtggtcgaggcggtggtaggtagaatttgtgattcaaaatgaagctgagagtggggaccagagtttctctatttctttgttcgtactgtagtacgtacggaggtaccattcgcatgatagagaccactactgtgacataataaaaatttttagattagatacgtgtattaaaaattagtgaaattaaatgagaaaaagttataattgaataagaaaaaaagataagttggaaatttaaatagtgcaataaataaaaaaaataaaatgaaccgagtagggagtaccttagaaagttagaatgaatattaggacccagtgatgaaaggtagttttctcgtaattagttttgattatctgaaagcaaaaggttctttagccatgcagatttgggaatttggacgctttatgtgcgaatgctaattggcgaacgcgcgttgccattgcgtatttccggcccacaaggcctacacacgcgcgcttcttctctcttttttctttttttttt

SEQ ID NO: 17847 - DNA, 4075 bp, Oryza sativa
  unsure (1)..(4075): unsure at all n locations
nnnnnnnnnnnnnnnnnnnnnnnnnnnnnnnnnnnnnnnnnnnnnnnnnnnnnnnnnnaaatccacatgtcaagcatatataaaaaataaaattaaaaaccatattttctcctattaggtaaacataaaaaagacaaaaaaaaatctaaggtagagaggagaaaatatgattttttttaattttattttttctatatgactgacacgtggcacgtaggtgctatcgtggcatgccacatcagcgcatggagggggttagagctcctctggacctagatgacacctcaagacaagttcgaggacttgaaaatgcattttgagagtttagggacctagataatacgcccactcttttttttctatgagttctgctgacacgtgggccaccagtctatcataaaagaaagggtaacatagtaaatttgagataaaggtagagagtagccgagtgtctccccattccctcccgtctcgtctccgctcattgcgccatctcgcgcatgaacaggggaggggcgccgatctccatctggcgagcagagaagggggaggggatcctggtgagcaaccacatcctctttctgattcatctctctctcccaccttctttcgtgtggaatttgcttgcgctaaccatagcttctctccaagatctggaaggaagaaactttttctcttaatttcagagccttaaccttaatacaagaaacagtttgtttgttcctcaaaaagggagaaatgccgttaatctgcggggctgtgcttgcttgcgttcatcctccatttcctgcttgcaatgtggctgcaagaaaagattaaaagggcctctctcgtttaggtcggggtgctaggaagtagggaaacacctttctctcttcttttggtaggaaaaagatggcgcctttgatgggacaagccatctttgctgatccctagcacttgtttattccaaagtggggggagtgatggtcgatagatctgtagagacagtagagttgtatgattgcggttagtgggcggttggacaggttcagtgttttcgacattagcttttgtgatgatgcctttcttttgagcgagttagatggataaaatcagtgggtggcttcggttgtgacttgtgaggagtgagtctcgttgtagtggacctgtgggaggttgatggatctgcgtgtgcaggttggttcttgattattttgtttttttttttgtttgggattgttgggggatgatctcttgttcatcgaattggtggatttctgtatttttttgtgcagttcttttgtatctaggcatgttctaatcaattgaaattcttttgctgccctttgcagattctgaaggcaagtgtcaacaccaagcttataaatctttgattggtcagtagttctttctgcaatctggtctgatatatatacgtatcagttgtgggagcaatggcttcaaaggcaatgcctcgagcgccccctgcagctcccaacttacagtcactgaaactgtgttctcagaatgattcttctttggagacaaccagtccgagtaaacgaagtgcattggtgccaggaaggtcagctgaatcaagcaaaccgaatcccgaagtggtgcaaaaggagcagaaatcaactcagcatcaaaatgagtccattgatcttacgggtagcaatgatcctgcagaagtaaaggctgagggtaacctggttccaaagcgtcttgcagatgaggaaaagggtgttgtggaggatggaattgcgaacggaagcttgaaatcatcttcagctttaggaaaggagcatggtatagcaagtgcaagtggaagtgccaggttggttgggagatctgagactggagaaagaggtttcagtagcagcagatgcaggccaagcacaagcagtgatgtcagtgatgaaagcgcttgcagcagcattagtagcgtcaccaagcctcacaaggcgaatgattcacgatgggaggcaatccagatgatcaggactagggatggaatccttggcctgagtcattttaagctattgaagaagctaggttgtggtgatatcggcagtgtgtacctttcagaactgagtggaacgaagagctattttgcgatgaaggttatggacaaggcatcacttgcaagccgcaagaaattgcttcgagcccagactgagaaggaaatcttgcagtgcctggatcatccttttcttccaacgttatatacccattttgagactgataagttctcatgcctggttatggagttttgccctggtggagacctgcatactcttcgacaaaggcagcgtggcaagtattttccagaacaagctgtcaagtacgtatgatttactcaatgcacatgatacacattaataccttggtactcttgtagggttcactatctttttcatttgttgtttttctgttccgataaatttcgaaaacgtggatacacaattcagaaaaggttatggtttgctttaagttagtgtaactgcgtaattggatggattatattaagtatgtaagctgattgtgatgataattttgtgcaagttgtcaatgtgaagtcaatacatgcaaaattaatttctacacaatgatatttcattttatcaatgtagtttttttaagaattaataaaaactgcagcttacatccacattcaagagctaaaactcctcaaatagcatgaactaagcaacagcatgaaaagtggtatgcatatctttggaatatttgttttgttccatgtacttcttgaattcacttatttgcaagatagcatagtaaactgatattgcactttcttcttggtcgcagattctatgtggcagaaatactccttgctatggagtacttgcacatgcttggtatcatatatcgtgatctgaagccggaaaatgtccttgtccgtgaggatggacacatcatgctatctgactttgacctctccctgcgctgtgcagtgagcccaacactgatcagatcatctaaccctgatgcagaagcacttcggaagaacaaccaggcctattgtgttcaacctgcttgtgtggagccatcctgcatgattcagccatcgtgtgccactcccacaacatgctttggtccccgatttttctccaagtcaaagaaggatcgaaaaccaaagcctgaagttgtcaatcaggtcagcccatggcctgagctcatagcggaacctagtgatgcacgctcaatgtcatttgttggtacacatgagtacttggcccctgagattatcaaaggcgagggtcatggtagtgccgttgactggtggacctttggcatattcttgtatgagcttctgtttggaaaaacacctttcaaagggtcaggaaaccgtgcaacactgttcaacgtcattggccagccgctgcgcttccctgaatacccggttgtgagcttctcggcaagagatctaattaggggcctgctcgtcaaggagccccaacaaagattgggttgtaagcgtggtgccactgagataaaacagcatccattttttgagggtgtgaactgggcattgatacgctgcgcaagccctccagaggttcccaggcctgttgagattgagaggcctccaaagcaacctgtttcaacatcggagcctgctgctgccccttctgatgctgcccagaaaagcagtgatagctatctagaattcgatttcttttaggactcaataatttttttttccatttgtttgcatcatcttgagtagggttttcacatgtagtgtcttgcagattagtatgtagattttttttgtttctgtcaacatgtcctgtttttcttgaagtaaacttattggcattcagatttatatttctcagcaaagatctgaaatggttaatcttcaagtgagtcaaagaaaggccgccactttttggcttgtgcagtgctagctcagttttgtgtaccctatatttctcatagtaattagtactcagcagttgttctgttacagtgttacttctgtctgatggagcatttcaagtttaacagtattgtccttaccagattgtcactgcaattgctgaatagttatgtgcatgag

SEQ ID NO: 17848 - DNA, 5182 bp, Oryza sativa
cagtgctagctcagttttgtgtaccctatatttctcatagtaattagtactcagcagttgttctgttacagtgttacttctgtctgatggagcatttcaagtttaacagtattgtccttaccagattgtcactgcaattgctgaatagttatgtgcatgagctgaaacacattcagtgagaagtttcactgaataatgcttgatccagaaaaaagaatgttgatcaatattgactcattgactgcaacagcagtttttgtatctcagtataactaaatgctataccatagatactaatcaattattttgttaatgcatgattggctgacaacttgacatagccatgtgttcctatgccctatccctgtctgctatgaggttttgatttacgcatctaggacaaattctttttggagtaataaattgtcacatgcatatgctgtaatctatgatcaatgataagtgctccatgtcaggattgccaggttgccaactggaggtctgcctagcatgttttattgttcggtcttctggctatacatgaaaaattgaggatataatagagtgccagattttctgtcctttggctgcatttttcatgtggttctagacattatattataatcaagcacaactcttcaccatacaacaatgcagaaaaaatgctggaaatatcccatataacaaccatcatctcctgtacaaatgaatcaagaaattcaagatcacaacattggtgaaagtgtttttttacaagcttttgttgtctgaagatgctatgcgtgcagtgttctatatctgcaaaagtgactgaagcagcaaccataaaagtataagatcaaaatgagaagcatttcaaatattttgtgattttattcctttcattgggattaggctcctttttgtcatcatcagccacagcgcgattgttatgatctggtgcaggtgatagtggcgttgggctgatagaattactcttgttatttacaggagaaggtgaaattggtggtgttggatcagcagttggcacagttgtaacctccttgccatcacagacaatcttgacttcacagtatagaggtgcgttcttctgaacctgtcctgctattgtgtttcctctcttgaacttcctgtgctcattcagacaaattcagaatgtatttctgaaatgccagcaaattattttggtagttctgttaattggaacttgcaaggtatataaaccttaccgcaatttggattttgaaacccccagaactagctgttgtacatgaaagaccggaataagttcgaggatcgcattggtaacatgatcgctctcgatgaggtacacatcaacattaacctgaagatatgacaggaattataattggatttctatatgtgccttgcagatacatctcaagctgttgtatgagcacagaaatgtgaagatctgatgtaaccagttcacctgaaagttgcggcaatggtctaaatatttttgtagcatcacacgcctctttgatctctcttggttcatgtaagtttctacctgctctgggcttgcttggctcttgggcatcattcctactatttcagatatccaaggagacatacgtcaagttcatcagaagatatgcatcaacttaatctgtttagacttaaaaaagttcaggcgcacagtcattattcagaaaaaaaaaatacaatcagaaattttgtctattcagacggtgagagcagagcttcagaatatatgatttgtttcgtcagaaccaattgaaaattttaaaaatacaaattatcttgacaagaaagctactattccaatttttggttgtagacatcatgtgtgggagtagtataagggcctgtttggatcccctgccagaatttttcaccctatcacattgaatgtattgagacatgcatgaagtattaaatataagcgaaaaaataactaattacataaattgcatgtaaattgcgagatgtccatgatttgacaatgtggtgctatagtaaatatatttgctaatgatggaataattaggcttaataaattcatctcgcagtttatctgtaatttgttttgttattagtctacgtttaatacttcaaatgtgtgtctgtatatctgatgtgacacgccaaaacttttcacccctggatttaaacgcagcctaatatttaacaacgactcaagctagaaggaaacataaatcctagactcaaccatgactatgatgtccaaatgaaaagactttaaatatagatcctgcgcgccctatccctccagaaaaaccgaacggtttcttcagagttatgtactgatgatttgctcttaacattttttactgtatggtgagttatctatattgctcagctagcctaaaatgagagttatacaacagtatatatctctgcatataccagaaagccctgggttttcctaagctctaggcagtcgtccttctcagctcccctatctggccatgccaaagaatggcctgtctgcatcattcagcaatcaacgatgaattgctgtgcgagtgtcaaagaaaaaaaaaaaagctacgagaacggaatctcactgtactggtctgttcacatttcagtggaagtgtaacaaagtactcgccctgctcacgccggcatctcagagacctataacactcgaactactagtctactctactgtttgccatccaatatactccacgtatatggagttgagaacagagaataaaattaatgcggaatcacatgaagcaaaattcgtgatgggatgtacttttgtacctgaccgagcaaattataattggttttgtcaaatcgaaaaattaaacgtgggttttagaaatataccactgatgggccattatcccttaactgtagatgcatcgacaaaaacaaatatagttctttctcgcataagggtcgtgttctttccagcttacagattgtagatgatacggcacacttcgtaagcttcaaaaccatactttatttgtaaaaactttaattatgggcatttcttagaaaactttttgaaaaccaacaattcaatattttaatatttaattcattcatttatattctcgaataatttccatacacttaattctatacatcacccataaagaacaagcccttacattatctagagaaattttacggtccttgatgagaaagtagccataggtactaaatttcatactaaaatatctaatagctgaaggtaacgggttttatactagaaaatatattacctcccggtattttcttatggatggtaaaattacccatatagagaaggaactaggtgtaactcctctgaatcaactagaattgtaggctcgctttcactacccttgttctggaaaagggttattctgtctatccgaacatggtacacacaagtgtcccgtgcacactaactaataaatatcaccgaaaattctaaaaaaaaatgtacatgcacttccaatagtatcacacctaacttcaaattcattatacttagagagagagaaaaaaggacaaatttctgacacatttatactcttaaatatataatatttttccttttctattatggctaaaatatactctctctatttcatattataagtcgctttgattttttagtcaaacctttttatgtttgactaagtttatagaaaaatttagcaatatatataactccaaatcattttcattaaatataacattgaatatattttgataatatgcttatttttattagaatgttgttatattttaaatatatttcgtattagaaagaaaaattctaagcgacttataatattataaaacggagggagtaatgaatttgaagttgatactttatatatacgtgcaatactattggaagtacatgttcaatttttttcctagaattttttgtaacatctgttaacgtgaaacttttgtggacatgatatatatatctcttcctattcatacatgccttggttggtgatcattctagaatttttggaaagttgatcactctagaattagcatggacacctaaaccaaacaccacatgggtggtattgtttctatctccaattctccatgcagtcaacatcagctctagagcttttttgctgcaaggtttgcgatggggcaaaatatgcctaacgtaggacggcaggatgccaacaaagctagaatggaactacagcttgtgacaatgccagctttgaaaaattcagtcaaagacaaatcaccccctaagctagtccaagaacttgaccttgatttcaacaatgctgcaggccaatctccaaccaaagattgctgggacccaattgtgatcttaccaactgaaacacaagaacagtccttcgaattaaccgttttaatttactctttgatcaatagtctctaattttccatatgcaatactaaaacacccttgttctaatccagctagctcaagaagacgatcaaagcagcttcataatcacagtcaacaagtgtatgagctaggccttagacaaatataccatacatgtataggaagtttgtatttctaattaatgatccaataaattaagtagtaatcactagttccatctcagaaacacatgtgccagattttcttgaggcaaatgtataaatggaaacatgtttcaattagctgttggtcaaattaagagtatggacagagaggggtgtgtgcttacatccggtggggatgctgatgacgacggggaagacgtgcacgaggtagacgaagctccgcggcgaggccagccgccgcagcgcccacgacagcgcctccatgcttgacccgcccttccccaccgccacgtacacgtcggcggcggcggcggcggcaggaggagccagcgacgccggccctgcctcatcctccatctcctcgatctcccacgtgctgatgccattgttcccatctctccccctgccggcgccgccgctgccgccgtccttccccggccgtccaccggcttcgtcgccgtcctccacgacgccgccgccgccgccttcttcccgagactcctcggccatgtggaggagcgagcgagacgacgtacggcgacgcagcaaatgaagacgaagggaggggaggagaggaggtgttgggttatgtatgaattatgatatgacactgcatgctgtggcgaaggtgtagaggatgtgtttg

SEQ ID NO: 17849 - DNA, 772 bp, Oryza sativa
aggtacctgcacgaggagttccagcactggatcatgcattacaacatcaagttgcgcaaggtgctgctcattgccgatgtactacgtgcccaagtgtcgggcctctactgggctgcaccatgggctcggttagtcatgttccagcctaggcctaagcaagcagcactaccagcatatatgagcagcaacagaaaacatgggggcatcgattgatcaatttggcgagctgaggctcacggcgacgacggcgacctgggcggccggtgggcatcccttgtcgatctacttctcttcttcctcctcctcctcctttctgtgttactagaaacttgtatcccccatttcttcttttgttcctccaaatatttgagtgttgaagcatatatggttgctatttgaattggagcaaagggtgctaacaatttggtatcagagctgtcgattcatgggatttctagcatggagttgatgggagagtactgcagcaacgccccatgcaagtggttgttagatttgggcaagggtgctgctcatgacaccgacacccacaacctgttcgatggaatgcctagccaatctgagatgcccaaggaaaatcagaggatatctaagcctgtccccatcaattctaccgtgaacaaaaaggagaaatggctagacaaagctctagatcggatattggagaagtttgaacaaatggaggccatgcgcatgcaagaggagaagatcaattagatatttcaaaagttggagaagataaaggtttgtagga

SEQ ID NO: 17850 - DNA, 1539 bp, Oryza sativa
ccgggacagtcaggcaagactagagcccaagcaacagggcaccaaccctctgccatgacatcttgactaccgggcagcagctcgtgtagccttcatttgccctgtagaatgtccatcgacccccgacttcatccatctccaatccgtgtacttttgtttatgactagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaaattataaaaccacctaatgttgcctaattaatcagcgaagcatctacctaaattcatactagtggaaccataaatagagtgtccactagatggggttttgtttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcagagagaacggccttccgaaccttcggcgacgaccgcgaaccacgcttcgggaacctccggaacgacgaaagctacgcgaagcacacaagcaaagctacaagcctataaagaagcaataacaacacataaaaagaaagcacacagttctttaggttgtaacaaacattaggagacttgaacgggtcgattcggagctcgtatgaccaggatatgatcatccgaagtttaatgctgttatatggagatttgcggattattataattaagctttgcaattataaaacaggtgtaagcgctagcctggaaaagacaggaaggctgcgccgttgacatgcggaccccacatgtcaacctaaaggaccgcggtagaccgagtacacagagtcggtccacgggtcgacggaagcggatcccgtgtgtcaaccgaggcgagtggccgacaaacggactccactagacaccacacggactgcacacgtggaaaccatgcggctaccgagcggacacactaacacggtcaccacgcgcacaagcgaacgactgccgacgccgatacacgggtaccggggccgacaaccgcacaacgggcacgggcgacaccgaaaggacgaggacagggcagcgagggagagggaaccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgaggacgggggctgcagcgaccttgacgaag

SEQ ID NO: 17851 - DNA, 523 bp, Oryza sativa
gaaagcagcggtgaattcaagccaagtgatagttcagcagtagtcctgttaaggcggaagtgatcccaccattcagaggcagggccatgcaactgatgtgatgcaaatgagaccttctcctgatcagtacactgaagtaaatccaacttcttctctatggcatgcagccaatcactagcttcaacaggattagtggtactagagaaaacaggcggcctcacacgaagaaattctgctaacttgttctgtggaggtgcatgattatttccttggttttgctgattctgaaattgctgcatcatcatgttcataagctgtgtctgttgagcaagaacttgagcaagagtgggattctctccattgttgttgttattggggttgttgggaccattcccattgctgcgagtgttcaccatctggcatgggcagggcacaagaagagaaaccggggaaactacttaggacagagaattactttaacttttattgatcttaactgagtttcattattacaaactaaaga

SEQ ID NO: 17852 - DNA, 658 bp, Oryza sativa
  unsure (1)..(658): unsure at all n locations
cggcggtgcttctcccttcatgcggctaattcgttctccaaacgatccacgtggtcttctaacttgcaaatcttaccacgattccggtcttcacgatcttgagcggctaacacagtctccgcacgactttcatccatagcccacaacatctcaaaccaaatgcttcgtggtagcatcattctcaattccttcagtgtcaaggtaactgccacggtcacttccctggggttggcgaggatggtagcgatactcagtgtcggccaattgatcactgtagcgatcacggagctctcctatggcgatccttgccacctcctgacatgcatggatgtagtttcttcctccagcttcaaacatcactgaggggatatcttcactattactgttcaaggtgactttgactcggcacttctcttcatgacgatcatgaggaatctgggcataaaaaggggcagtcccaaatccaatgacaaaggacatcgtacgcaactcctggacaaaaccctcaacaccaaacaggtactcaggcttgtaacgcggcatctaaagacaagtgaaaggaggtagttaaaacctttatccaatctcatagcacaagtttttggattannnnnnnnnnnnnnnnnnnnnnnnnnnnnnnnnnnnnnnnnnnnnnnnn

SEQ ID NO: 17853 - DNA, 622 bp, Oryza sativa
  unsure (1)..(622): unsure at all n locations
tagcagactaggtgctgagtgctgtccatttttgcagactgaagagagaagatatacgagactgtccattgttagtcagatttgtaaaaatagactctgatgtagtttacttttgcccctattttatttttaacaatacaaatatataacagatcctaagagcttatcttaatttaggagaagttgctcgtttcattaaattaaactgtgaagtaaaaatgtgtgctcgagtctgtcaatgcaatcctgtgttcttgtttgaagatatggtgtagggcaggctaggatcgaacactgaatggtaagactgcttctgccttcatttgtgcacttggtgctgccacgccgattaagcagtagaacaaagtaattttgtcgtgcacaaatgagttatatttcattgaaaatcgaagtgaaaatgaaccaaaagaaatagaaagaaaaaaaaggggngggaaaaaaaaaccttttttggggggtttaaaaaaattttttaaatttactccaaaattattggtaagatttgatattagacgctcgattacttggcttaagttaaggatatcaaatttggggaagcaccaaaggaattattgtgaaggagttgtgggtgcataacgtt

SEQ ID NO: 17854 - DNA, 334 bp, Oryza sativa
tcctattaaatcaacacaagtgttagtaacatccttaggtttgtacaagtatcaaagtaattgtaatagcatcatatcaggacactgagaattgcttgtcatattttgttgtgttttttgcatgtgctcacctatatggaatttggatagcagtcatgagacctgatttctcatacaggtcggtgtaagctgagaggtcttcttcggtgaaccactgaggcatcggtgttgattcatctgcaaggtccatgatctcttgtccttgcttggcaactggaatctcactcctggagaagaggatgtagattgtgcgcaagatcctcctcgtgtcgaa

SEQ ID NO: 17855 - DNA, 439 bp, Oryza sativa
cttgttcatctttttttacatttgttgaccaatgtggtgtgttcagtgattagaccaattctattagagcctcattaagaaaaaaatgtaacaaggtgttattaaggcatgcaagaaattatgaggtattataagctaataagtagctttgatgcaaatattataattgaccttgactttatctgtagttcttattggctagttctgtcgatgggttgcatgttgctctatgacaaatttgatactttagacacccctttggtggcatgcatgcaggacttagctgtccttgaagccttcatttcttcatattatgtcataagttttaaccggaagtttatttacattaggcagaaatacaaaccgagagacagaggatacttcttttggatacatctaaggcccctgttgagtcaatcagatctgggggtagatatga

SEQ ID NO: 17856 - DNA, 581 bp, Oryza sativa
ggccaattcgagctcggtacccattttgcttcttgcagacccatttgcttaatatgagtagaaaattgaacgcgaagcgctccttgctttcttttgttggtgtcattatcaatactattgagttattatcaggtatttttcttaataatacaatgtgttcgctaacacaataaaatgttaaacatccagtatgttaaagttgcagtctgacgcctattttgttttgctgcagctctttcaatacttcagaattcttctgttgtttccagctctacatatccgaaatcgtctaaagtctctcaacagagttactctggtaataacaaacaccaattttgtttgatcagttgatctcgttggcttttctatgcactgtctcaatatagtttggtcgccattcaagtctcactacagatgttgaacttggcctgacaccaaatatttataaaatgctacctgatattttttttaaaaattaaattttttccaaattggggttttttttccccccttttgaaaaccccaccatatcttgttggtcctcgtataagtttaattagtgacattcttgaagctttgtt

SEQ ID NO: 17857 - DNA, 7645 bp, Oryza sativa
tatatgggcagaattttggagccacttgataattttcagtttcagaccatgggaaaaagtggtggtttcaccctgacaaacagatcattagcaaaagtagtttatatcctctcaaaaaaaaaagacaaagtagcttataaacaaattggcatagtaaacatatagtatgaacgtaccacaagagcagcttccaaagattctgaagaaatacccacttcagatgctacatcaccaacactaacctttccttgatcaattagctaaaatacagtacagaaattaatgtttctttccttggcatgggttacgtagtaaatatcagagtcctaactgagctttgccagagtagaaattacctttctaagaacaagagcaacatcagcagagtttctcataaggttcccaccaaccgagagattgtcagtatccacttccatcccttggattgctagggaatctgaacttctaacagtgtggggtaaagaggcttgctctatggtctctactttgataaggttactagagttaaagctagtggcttcatagttcatgaatttatccttgttcttgcgcgtgaatcttagttttggtacctttccagtgataaggtttgcatcttttagccttgcttctgtaggactctggtgagatgcacagttacttctctctagagaattggcatatccaatagtagaatgctttgagcaaaatgctctcagctcgacctacatggaaaacaaacaagttgaacaacagcgacctaaataaggctaatggcaaacacctgaagaaaatgatctcacattaggatacccaaattttccccatatctccatttgatgcttggactctcgtgcacatataggatgaaaaggtgttcggcatgttcctgaaaaccacatggataactagttaaaggacttaaaaaaatgtgatgctagttttaagtgccaccaaaactgacagaaaatatcaaagataattcaaatcatagaatgcttctatcctacaaaatattatatatgaacaatagtttaatatataattcactgcttactccatcttcacagctaagacttaatatgtcaactcacatgtacttagtgtcttaaaatacataattttgtaattatattgtgaactaaactttaaagcctgggttctcagtattacttattacattgttcttagcagcctttttttgaagtctgtggatatggcataagtcaattaagggtgaaattatgattaaaagcatattatgcttcctgcaatgttttttgacaaagggtcaaatacttggcaccatcacaaaaatcagagagttggaaaatattatcatatgtggcaataatatatataggcccatgccctatgtgtcattctcacatgtgatggtattttgctatttgcatatctttacgatggcgttttccaatttctcttcaaaaatggatattatggatgttcgcatacattgagaaatgtatggttttatgtatctgttcgcaaaaaatacataatgtaaaccacacttatcagaaccagaccggcctggcagtccaaaaaggaaaaaaagggaccagatcccagccagtctggcacgctgttggatcattcaagcagttagcctgacttgaacaagtaaaaccctggccaaagtggacagtttttcagtgaaccagccacaaaatgtgtgtggccccaaaagttggttcagttattaattgcaaaaaagttatacaagggtataggtataactaactaatatgcagttatccatcattaacagcagcatagtaactggttggactagaacccagttatcattttgatatgctgtcatgtaaaatgcagttacaacttacaagataacctggcatgtagagaactaaaatggatatctgtatacacatttctttttactatatatacgaaaaatatttaaataaagccaacaaaggtaacaatgtaaacccattatttattgcatgaaaaagtaccattctaccaaattcccgcatgccaaacatagaattatctttgccagcaatattccatcattgtatggtgtagcaatacttctgccacaaactacgttgagttaatgagttgagcaaagtcatccattcagatgaggattacttcctttggaaagttatcaccagaaatgagataaatggcatgtttggtagctttgctcatccttatctagcaaggtcagtggacaaggaaactgggttgccttgcttggtttggtaatggacacacaagtcagtgttccccattttttgatgaaaagacaattcagctctcctctcctagcaatgatttcattgtgcattagcaagggtagccaaggaaccaaacacacctactgcccagctattttagcaagaattttgtgctaccgtgcaacacctgatttagaattacctcctcaggtaaacctgagtgacagcatatttgcggtttttcattgaatagaccgataaagttgctacatatcttccagttcaaaggcaaatttaaaggttgcttttgaaggcccacattgaagaaaggaaaaaaaaataagcaatgactcggtcttaagaaactcgagaccgcagtagaagcatgatgcagggaaattctatgcggtggtacaaaatggaagtgtgcaagaaaaattatctgcaaaacactgattctaaataacttaaatgtatatatacatatagttcatctaactaaaatagtaaaatggagacatagggtaaaatacataccatgactacatcggacacatacaccatgcttaaccttgcaaatgctgcacaccaatttccactgattctcctggacacttccaacattagtaacaggttccattgattccatgtcttccacaagagctcccggtgtccaaaggctacaaaacaagtgcacaaatttaaggttccccccatgcgctgtttgaccaggctcccctttgacaggttttagagcgcctttctcttttgggcatagaacacaaggcatcgacaaggtgttgtccgcatctttcttcaacgactgcagtgactccaaatccttacaccaagtgcacaaccactggccatcaggcacaacatgcaaaccataacacttctggtgcacagttaccttacagcggttgcaattgagcatgctattggacaccgtactactctcccccaaacaacaaacatcacatacagaactagcctcagctcccgagcgcggtagcagaacaagctgctctaaccctgcatccacacctaaaagcttcctcttcttgttgggccgttctgaagtgagcacaaaccgttcctttgatcctagcaaccaattcagtgatgattctccctcttcttcacattttgatgatacaatgccagcactgctagtagcttgctccacttccaatggccaattctcctgttgcacaaccacctcatgtatgccctgctctacactctgctcaccgcgttccttgttaccaacgaactgtcgcacaatcacctcatgtatgccttgctcaacactttgctcacttcgctcactccgttcgctatgctccttgttactgactctttcttcaccacccagacccaagtacgagcttgtttcagccacagccacatcaaatgtctcagctgtgtccatcaattccttgccactgcccacaaatggtatgaggatgcacgaatcgagcccgccatagccgaacggaaactttggcattaacatatcaatatcatccaaattcaccggccggaaatacgcctcgaactgctcccacacgccagtcttcgcagagggctccgtggctggctgcggcgggagctccacatcagccacgtcctggggctgaatcttcttgtgcttcttccgcgcgtcgctctgccccgaccagttcacgagccgcgcgggcagcgtgggaaccctaggcgccgtcccctcgccctcgaacggcgtccgcaccgacagggccttcctggcctgcgcgtacaggtccaccccgacgcccggggcggccccctccggcaagccctcggcgcgggccatctccccgcggcggccgccgctcataaagcctcggccagggaagggggcatcgccgccgaggcccccgcggaacacggcgggggtcgggggtagggcctccggcgaggagggacggcggcggaggaccggggggcggagctagggctagggctagggcgctagggcttcgttccgcgagcccgagtattgaagagtgtctccttcgcgtctgttcttccttcgactcctttccggcccgatttttccgcgtcagtctcgctcggatccgatgggagagaggggcggggctgggagaggctcgcggcgtcaggacacgggttcggttttgcacgggaggcacgcagcatatgctctgctgctcttctcgttgggtttgttatactactactaccggcaggcacctttactcaccgtcctcttcacgctagcaataacgtgaggtatcgaagtaacttcgaaatagagtgcggtgcaagtaaaatgaaatttacattgtggtgatatttggtttaaaaacagtaataaatacgttgcggtaatgaatgagtttcaagaatctacagagtttttttagcggagaagtttcaatgaagttgacggtttaatgaactatgcatggttaagataacgattttataagggagttggtaaaggatgaagatgattgggttaggtaacatttaatttggaatatagtttcttttccacttgaccgtatatagttttgacaaaaaaaatagatgaaactttgcgagtcaattataactttttaaatggacaccttcacaaatatgccaaaataaacatgacatgtatttttatccgatctttatcaaatttatcatataacattacgagataagctccaaaatcactcacactctcttgcatgccattttgttttccagcgtgcaagcatacatgcatgcaacatagcgtttatcgtaccagtcttagtaaacgacaataattcacgtactacatttactggatatttggacattcttgtcgtttctacctttcctgctatgctcactaaggagattgtttgtcgatacaatagagcatagacaaatatttctgcatttaccggatattattgacctacagctgtaggtgtatataccaacttcatattatggtaaatattataatgttaccatattgtaaagttatgggcccatggttataagtgaatttgaccttaggtcacaaaaataatggcattaagcttgatgctaaggcccactaagttccattcactttcacctaaaaaaacacaaagataacccaacatggcatagacatgccttggctatggaccatataagggtttgctttttcacccacgataattgatgtgtttttctcatttatccctgatttatgtggcattgtaatttgaagaaaatcaagtgtcctaagtaagaaaacatttataaaacacgtaatttgataagtttgcacttgataaaacatattgtaacttgaataaaatcaagtgtcctagtaagaaaaccttacctttataaaactagtttctaagtgtcctagtgtgggcaaataggatccgaaaaacttggtgttcggagatggggtcaaaagctatgatcgcatattttagcactaaacaagctcatacacacttgatttacccaggttttcgcgcctctcgagagatgatagttatattcttgctttcttgattaatatctggacaactttttgcaccggaggtgtgttagaactggctaagtccagagctcgtacaacttctacgtgttgtgttcttgtgtatctaggagagttgaacctttcactcggtgatctatctggtgcttataagttatatactctcccacaatctacctaatcaccatgggataactgacaaaggtactatagtcatacatcattacctacaccgtacccgctatcataccatccaccacttataattcttccatgctacaagatgccaccttccacaggtctaccatagaagtgactaggcctccccctgacggtatagcttggtcagatggagagaaaggagacatgaggggtgaggcgtgatacaccaaatccctacattaaatacctttgacttgcggtgagcatgcctaattaatgtggaatgatgggagcgagctattgcacgcttcatttgtacctgttgttagagcgtggtcatgtgatcccccaccgagggcgcccacgcgaccaaccattcgcgtcctcgagcaatcctcccgcgaatgaccatgagatggacgcattggcccctgaactgtcgcctccgagcaatcttcccgtgaatggtctcgagctaggcgcgttgccacatactagacccgagcaaccttcccatggctagcctctagcgggtcgacaaccacacgtcatttcctagccagtccaacctaccaactagttttctagtcaccctttcacgcagtgttatccgtacgctatcttgtgacctgaggaaaattgtaccgatatcttagcttccagcctagtcgtagggatatcaaggaaaattatactcattactttctaaaatcaagtgttctagtagtagtatagatgatgagaggtataaagtcatgtgtataccagattcacttcctccaatgtatctagccttttcaatgtactaatgcacacctaacagaaatggtgaaatatacacaccattcaccattacaaagaggatggagattggagaataaagaggcccaagctacaaactacacagtgctgtcaaatagtttttagggtgcgtttagttctttaggcgtaaagtttttgaagtatacggatgcacatttaaagtattaaacgtagactaataacaaaacaaattacagattccgcctgtaaaatgtgagacaaatttattaagcctaattaatctatcattagcaaatgtttactgtagcaccacattgtcaaatcatgacgtaattagacttaaaagatttgtctcgcaatttacatgtaaaccgtacaattggtttttttatacatttaatgcctcatatatgtggccaaatatttaatgtgacgttttttgctaatttttttttatctatgcaaggccttatttcaaaaggacagccagcagaaaaagcgactcacagcacggcgaatatactagtagatgcagatcagatcatcagagacgacggccacggccaaatcgggttgacgcgcacggcgcacacacactctcccccgaaggcctgaaaaccatcaggcatccgtatacagagcgcacagtgtgcagccagatcgagcattccaatttccaagctctctccccacagaggccgaggccgcaagcgcatccagagcgcacccacgccacgccgcgccgcaccgtgccgtgccgcgccgcgccgcgcggatgccatccaagcggccgtcccagagcgccatggacgcgggcgccgcgcccgcctcgccatcccctcccaggtcgtcgaagaagcgctcgtcccgccccaagccccgcgcgggcgacgccgcgcgccacccggcccccaaccctagcccgccccccgccgcc

SEQ ID NO: 17858 - DNA, 3011 bp, Oryza sativa
  unsure (1)..(3011): unsure at all n locations
catgggcgcgctctttgactccaatcaggggctccctctccccgcacatcgaccaggccaaggtgtactacaagctgaagcggctcaagggcaagtacctgcacgcggcgcccggcgcgtccgcgggaccgcacgaacgccgcgtgcgcgacctctgcgcgagcgtctggggcgccgacctcgagccccttgctgagggcgacgacgaaagggccgccgccgccgccgccgccgccgccgccgaccagccgcgcactgtcccggacgccgccgccatgctgcctgtgctgactgagatgcttgatgagtactggaagacggatgggcgagcgctgtccagtgtgtccctggcgaaggggttgtcactgctagggacagaggaagcaagattcatcgagggcaagtggaggaggcagcttgattcagagatacaaacgcagatgcggcgacatgatctggccaaggaggtctacgccttgctcatggacgccatcaaggccctcgggccttagctcgggtatgactgtcatctacacgagtaatttatccaaactctgccatttccttccctagtccaacttctcgctggagaattcgttaacgcattgctcgttcgttcaattacagtagaacttatacaatctattactcggcaattgattgttcttgctgactgttggggtattttaccaaaaaggataacacgattgtgtggtctgtcgtctgttcacaaagtagcaaagaagctatttttctccatcagcacaccacagatcgaagtattaagcaattatgcttcccatagcatgatggaagtaacagtcttataatcaggaagcaagcaatatcagcttgattttggtttctgtggtcaaaaaagcctagagaatttcatgtttcatacttgctttacatattctttgcatcaaccttgagcaaagccagaaatcaaccatgccaatcctaaatggctgcaacaccccagtttttatgcactactagtatgtatattgtgtctctgactggatagtttggattttggagatggaatagtagcgtgaaaggagaatttggagatgacacacaataaattatgcataacttcatacacatctaataaccaaatacagcacatgctataagccatatgatgatgatgatctcaattaagttgtcaaaaccaacaaccaagccaacagagtatctttgctaatacttttttccttgaggtgtatcagaaaatgaatttgtgagaggtcacaaacccaggtttttaagctacttcaaataaaactgtttgaatttagaaaaaacttctccaataaagtatgtgattgccaaatcaagtccatggcatagagaattctgccatgtattttcttatgttggtctcttggctttggcaggagtaaacacataagccgtacagttgtccaaaaaaaaaagggtaaaaagagagaagaagaaatgaccccactaagatatggactagcaataattgaccccacagggccacaggatatattttctggctctgctacttggctatctcatgggcacctgaaagaccagatatagatatgtgcacctgaaattttgaattctgcttggttagggaaacaaaattatcagagagatacatctacgaaatattagacacgagctattacatatgagattgatgactaagagataacatatttgaagtaacctatagtgatcgagaattagatgaggaaggtcatatactaattagtggagtagtacataacagggtgttgaaaggaacatttaagtactgagcaccaaggtcctttaataggcatgctgcatgcagctgaatgcttcgtttgacacctatagcaaagttgattattatttcgtctcttcagagcgttagagcactacctcagttttctttttaatggaagaaccggctattgatttttgccagcctcattgccaaactttattaacgatctgatcagctttgtttaacatcatggagacgtgatgcattatatctatatgactatatctacatatatcttcattcataggatgtactgtgtttcccttttttgctgaatttttgttcttatttgatagaattatagaatgtttgatgtttaggcatatctgttgggtatcttttatatagcgaagtacctggtgcttgctgggtataagggtattactgcggtagtcaaatttgttgagctcagcagctcaatgcagcttttctatgtttggtgcactaccgttgaaaagaatcttatcaaacttcattgctctcaggatctcaatttaccttatttgcagtcagtcacattgttcacaaactgaactgacacttaccttgcagtcagtcacattgttcacaaactgaactgacacttaccaacgtccgttttgcaggtacaagatggtggtttagatagagctgggtctgggtacatatatctgcaatgccttttgtattggctggtcgaagcattgtactcggttgatgattgacgaggccagggtacatatatctgcaatgccttttgtattggctggtcgaagcattgtactcggttgatgattgacgaggccagggtacatatatctgcaatgccttttgtattggctggtcgaagcattgtactcggttgatgattgacgaggccaagaatcaagtggaactcattttcgactgtatcaaataatttaggttcataacggttgctttggccgttctcccgtcagatttagatgtgaaaatgatttagtggcttaacctgtttgtaaatcgtatgctaacttctgtatctgtcatattagtgcattttcaagtgtaaggggtcagcatttcgatatttactacatggtgtggtaaaaaacaattaggccatcttggttaatgattacaatgttgaaactatatttgcttatcattcaacttctaaactgattgttcactttgtannnnnnnnnnnnnnnnnnnnnnnnnnnnnnnnnnnnnnnnn

SEQ ID NO: 17859 - DNA, 1732 bp, Oryza sativa
aagtgtgaactttgcgaagatatttcaccagaagacacttgtgttggtgatcaatcagattgcaatggcacaaacctgtccttagtgcagtgtgatctgtgccatggcacatcaggtgcatttagaaagactgcagatggacagtggattcatgctttctgtgctgaggtatttaaatgagtattatatttggttttcatgtgactcatcttgtgatatctaatatttctaatgctttcttagtggttgttggagactgagtatgtgaggggacaagatagtccagtcaaaggaatggtagtcttctatacccaacattacatttatccctttttcaattttaggaactcataggatcgtctcaactgcgtttattgtttgcacaattagaagctgaggttgtttgtcagtgttggcatatcatcttatattgcatcatcttgatgcttggctatttgatgcatttatcaggaaagtcttgtaaaggacaaagatacttgctgtgtctgccttcatactgttggcgcatgtctaaaggtacatcataatctttgctctttcttctagttcaatgcatgatgaaaccaaccatttggaatcttgataagtttgtctttttctaccattcagtgcaataatggggactgccaaaccacttttcatccttattgtgctagacatgctggtttctacatgaacacaaaaggatctggtggtattttgcaacacaaggcatattgtagcaaacacagcatagagcaaaaggaggtgagtgtattagtttaacatagaaactgttctggaatgatgagcctcttctttcctacctaagatcaggattctctactaatgctgtagataatctttcattatgataggaaatgaaattagtcaattgccttctcattttagcattgtgacacttaaacaaaagaaaggggggtggatgagggttctataatcctatatccggtttgaaggctttggttgcatattctcattttccttccgatataatcggaaagggagcatgtgatgcatgagtagatggaaatcctgtgttggtacaattattttctgtaatcttattttgttattcgaaattgatgcacgctgatatgcaacagtatggacttgaggagttcaacaacatgaaaagaatgagggttcgtatatatgatgcatttcacttttcctattttgatctgtgatacaatatttttgttcagttactatctaaggtttctaacttccagtgcatcaaatcctgtgttccctcacttcctctttcttctagaggccctgttaatttttttttgtatttctataagtaatatttgtttttgtatttcttttttgtacttcaaacaatccttgaggaaatgtctgaaggatgtccattctcattgaacattgattaaatgatccctcaatccctgatgaaatatttacattacaattttgcaggttgagttggaaaaattgcgactcttgtgcgagaggataattaagagagaaaaggtgaaggtatgtgtggcccctacttatactttttgctttgtttcttaaaattgaactatatgaggaagctactttaagccctgtttggagaaactacctttgaccttgtgttttttcctctttgtgaatcaccttttgtttccttcatattaataggtgaaaatcttgcttgagttactcatttagtactccttccgtttcataatgtaag

SEQ ID NO: 17860 - DNA, 12449 bp, Oryza sativa
cctaccttacacatggagcaagttcagaatctgccactacttctgttaacaacaaatcatacagtggaaccatgcaaaggtctgatgatgtcacagtggacagtactatttctgggaaaaaggcgatcaggttttctctgaataacagggatgctgagataaacacagctgatagctcaaggacactgatatcgttcaaacggaagtttagtgaaagaggatcacttgctggtaagcagctcccgcgaagaccagttacctcacagaaattggaagctggagaaaagaagacgaaggataagaaggtttgtacttctgttttcaggttttttacttcttttctgtaccttgctaatgtgtagaccacatggtttttcagaatagggaaacatttcaaaaggagctttttatgacatctgatcaagcttctacacagaaccaacgtcttccgaaggggtatgcatatgttcctcgtgactctctttctaaagacaagttgcggaatcgaaatacacaggcccatgaaccacaagagcctggtggataggagcagctgagatcaagatggttaatcttgtctcaagaaaggccagaagacgtttgtttccttggtcttcacagccagaaagtacaagcgtcaagtggggctggccagtcttttgctgctacaaagggttccaagcaaacgatgatccaattgggctgaagttgtagaacggtgcaaactgagttaatgtgaacgagagaacgaaacagatgaatgtatggtgtgggatctttaccagaaatcttgctccgcctcaggtcgctcgggtgaacggcaacatgggtggatttacctgtttgaggatatacaaagatgcctttctcgcctgtacatataaattctctgtaatttctttgtacattcttgcctttgcgtgtgatagtttagcgttgcagaagtgatagtttagctttgcagaagacaaaaaaagaaataaccactctttgttgggattacaagaaaagaaatggtccattggtgcgagtcagggccaccgcggggctgataatcgctcaagggattggagacaggcaattggtaatggctaatgaggtctgattcattgctgcctgttgggatggagacggcgaaagcagttgaaatggaactgttggtttacagcagccattttaatggtgaagtggtgatagctggtatagttttagatacagcagtacagtctgaccctgttcttttttatgttgattggttgcgggtgacttgctcggagcttgttaacaaccatttaatatttcagcaaacaagaggtttttgttttaatgactagtaataacttagtctggtgtggtagtcagcttttttatatgttagatgcagataattttttagtctgagacaggtgttttcctcttgccgtccagatttgtaacttgggttaataatctttcctaccattgggagccacacagacgatgtaaaaaaacattttctaaagattttagtggtacttatgttcatttgttgtatgcttggaccggaccccaagtacctggtgtatatttccaaatattgatttgtcattaattgtacgcatttgcatttttgttttttagtcgtcggaaagctgagcttaaggctgccgatatagtaaaccgttgtatgacgtactgcacgtaataatgctgctgtccagtactcatgttactgtattgcaatattggtatgcgttcagtattgcgtttgcttatgtcacccactcctatttcggtacgccagtgtcctgcctacttgtcataggcttgtttagactcaattttttcttcgaacttctaatttttccgtcacgtcaaatgtttggacatatgtatgaagcactaaatatagacgaacaaaactaatcgcacagtttgtatgtaaatcgcgagatgaatcttttgagcctaattacgctatgatttgataatgtgatgctacagtaaacatttgttaatgacggattaattaggattaatagattcgtctcgcagtttacgggcggaatctgtaatttgttttattattagtttacgtttaatatttcaaatgtgtgtccgtatacttaaaaaatttttagcacaggaactaaacacatactgatgtactacatgagggttcatacaagatttaacttgtaaatttttggggatttaactcgaatgatttagctggtcattactactacctccgtctcaatttaagtgcaattatggatttttgtgttcgttatttcaaaaatttatgagcaaacttttttaaaaaatagtcacacctaaagtactatttatgttttatcatctgataacaataaaaatattaatcataatttctttaaataagacatatggtcaaacgttaataataaccaagacaaacctatactcttttttggatgaatgtagggctataatttgcggccgttctttaaatttttggagtcatcgtagcaataacagtttttttcctctacggcgttgatgtttagacgcgtcccagcagatatgggcacgtcgcaaaaatcactgtcataggaccttacacttactttttagagtacagttccctttcccaatgtgtaccttgtccccttatatacagaatacagtactgctactactatttctccctcgattaaccgttcttccacggttaattatcacttggatggaaccaccgattagtacatgctcgagaaacgcaatgcacagtaacatgtaagcatgatacgctcgtagtcatagagcattcaggtggtgtttaaaatagattaagatgaagacaaagtcagtgtatacaaaataaaaaaactatttgcacataattaattgagttttatttattaaaacatgtaaaaaaatatttgatattttaaagcaacttctatatagaaagaagcataccgtttaaccgtttaaaaatgtgctaatgaaaatcatgaaaaaaatttacattttaatagaaaataaatggggagagatatattgataaataagaattagatgctcctctactattgttgacaggtgatacccgtagacctattatgagggtatcagggtacgctggagtaggatctacacaatacgatatcaaacacacagaatacaaagattatactggttcagacccctcgtaaggtgataggcttaatccagtttatatgagattatgaagaaaaccacagaaattaagagaacaatagaaccgacgagtaccgattagacctttgtcgagattaactcgacgagattaaccggcggcttggctccgagtcctccgaattgattctgctatgcccggttgtgagattatgattcgatgatcccgtatccttgagagctttgtatttatacccctaagtgtcttggccttcaaatagaacttggagaataccttacgcgtacgagatcacagagtccgcaactccttcgaatatgactataacaccttatatttggaaagacagttttcttatatatctgctgaattccttaggactaagataactttcccgtatattcgagggtatatcatatctgtacactgcacaaccccaaggatactgaggtatgtcttattcataccctgataactactagataataatcattgtgaaactagtaaaaaagtagcactgagtaatatgcttgctgattacacaaatatgaacaaataaataaagctatttacagagtcgacagaaaagaactacttcctccgtccttaaaaaaaacctaattctaaatttgaaccaggttcaaatctagaattgtgtttgtttttggactgagggagtaggttggaatcatctggctcgtagtcgtaggagggtgaggactaaccaacattttattgataggcttcacgttaatttctctactctgttcagccttgctgtacagatcagtacccgtgcaggggcgtgaaaaaccgccgcgagatatactagcaggcaataaacagagccacaatgtcagctagcgaaggcaacgacgactcgttgcaggcttgcagccatccggccacgacacgacagtatacggcacgaagccgagccgaccagcaaaaatatcgatcgggacgaatgagcatccgtgatacggtggtagtactgtgacaggccatgtcggtgtggtgcgcggcgcacgcgatgcgaccccccaactccaacttgaccgacccttcgaaaagccaccaccgccgcatctccaaccgatcgaccgaatcctgttgttgcagccgcgcgaggcgccgtcttttgcagggaaaatcgcacgcacacacacacgcactgatatctccaggcttctctgcttctagacggtcgcgtcgactcctgtttttctgtcccttttcgccggggagatttcgagccgcccgtctcacgggagcctctcttctcctctcttgcattgcatatttgcctgtacggccctacgttgcgtctcgtcgttccctaccagcactgggtcaaaagcgcaacaaaaggccagtaccctcattcaggcagcttgggtcggcagctactagcttggaccaatgaacagtgctgattgctgaccaatcatccagcgaattgttgcttttggaaaaagaaccggaaggaggaggaggaatatttgctcctgtacatgtgctatctccctcgacgatgtacgtgccaggagcagggcggcgagggagagcgattcgatccgcgagtggctcgggctcggcgtgtggctgggctccgataccccacgttgctttcacctccaaagcgcggattattcggtgccctgctgctgcatgcggttgttcgattgatcgatcgatcgatcgatctgcttcgatcgttctgatgatcctgcagggtctcggtgaccacgacattgcgatcattgcaatctagttgttgttgttgttgttgtgcggttcgagatgatggatgggacgggagccgtgccctgcaccggggggaagtggagatcgatcgaagccggtagcttagctttctttcgcttgcaagctagtatagcacgcaggagaggaagagaagagaaaagaagaggatggagatagatcatagatgcccacgcgctagctcgagattttcttgttgacctcttgaccccggccatcctcgaatggcccggcactttctgccggctttgtgttttgcatggagtttgctgctttactcgtacggcactttgctttgtgcgcttggcgcctaatcatgagcgtatcgatcttattgctgtcccctggagttaatcacgccagttgtgctaatccaagtgtgtcttgatctctcctcgctttgttagttgtaggataattaacaataactactaaaatgaactggagtttctagctaggatatcatgtacgtcctgattggttactctaaagggtagctatctgaaggggacgaagttgattgcaggcccttcccacttaccatggtaggtcactttttttttttcatgtgtggtgatcgagcgagccaaacaagtaccaaagcaggtgtactccgtcacctcgtgacaaactcgcaaagctccattttgtgcacttttcctttacgaaattattattatacactatcttgtgagcactgataaaaagtcgatcgagcatcgtactatcgatcaccaacgtacagcggatatctgctcgcaatgccatcgccatcctcctcctttgttagtttagctttttctcctttttttttcttcgaagaatttagttgagcctttcgtcgttgtaccgacaaagccaacgtggcaagaggctgcggggccggcatgcacgggcgaaatcgaatgatgggtgcctccacgtccaccgatcgacgcgtcttgagcggttgagccccgtacggcttccgcaccgcacaggaggggatcgatcgatcgatcgcgcgtgcactcccgttcctatcaacgacaacgggagccgggcgggagcaaaggcgaaacaccgtgtggcgcccgccccgggagcggagcgcgcaccaccaccaccaccacctatacctcgctgtcagcttgccaacggagagagggggctcgcgctcgcgacggccacacgcgcgatcccgcgtccatccacccatccatcatccaccatccccaccgtggtgccgtgccatcgcctccgccttatcgtctccgcgcgcgagcgcgcgatcacgttacgtagtactacgtcgctcgctcgcgtgggggcggctgcggcgttgcgttgagttgcggcgaggcgaggcgaggcgtggtggaatcacgcaaccgttcggtacacccatcgggcgtttcgcggacggggggagcagacgttgggtctgtttagagagcttctagcagctgcagcttcttctagaatctccagttaccagaagctctcccaaacagtatagttttttttacctagattatgagaatatgtgcttgtagaatctggaaaataaactagaagccagaagctaagtttttcagtttcttcagattttcaccagctagtttctcagcagttgtttctcaaaatcttaagctcactaaacaggcccgttctcgtagaccgtggtggtggtggggggaggaggattacaatggatgatgccgcgccagatgccaagcgcaatagggcacgtatgcggggtggccaccggacaggtgagatggcttggtggtgacgcgaccgtggccatgttcgtgggtcgggtggcgtttggctgttcgggtgcacaacggccgggatttttctcccctgttggtttgcccttttttctcggggggcctgcagagcttgatagaccctagatagctgtttgtgaatagcgaaagtggcaacaaaaggagaataaaagaggatatgtatacagtcttgtgctggtgcatgtttgatttgcatgctaattttagttattgatgtagtagtaatattgaggccaattaatcagggttgtatagtgtacatagctttgtgtgggaaatcatttatttgaagtaaaatgtactccctccatcaaaaagtttaagatatattttattttctggttttttaaatgagataaacatatttgtagtttctatgtgctaaactaaattatcgaccaatacctgaaaagctatcttaatagtcattggttgcatgcgtataatttctttcgttttgtcacatggtgtatgagttaatttctatttagtttttagtgacaaaagaaaaatatgtcttatggctggtttggcaacttgaggaaaaatgattggaagtttagatgagggaattgatggtgagattaacatgtgaatttgatttttagtcacaattttatttttgatagaggtggtgggaattgacaaggagtttagttggtgactagattttaaatgaaaatggatggctaagatttatttaggcaacgtaaaggagaaatttcctatcaattactagcccctacccaaatattaaaaaggagggagatcttccctcaattccccatcccatcccacgaaaactcatttgtctctcaaccaaatagaatagttaataacctcatccttttaaacttctaatctctcataaaaactcaccccaaccaaatacacccttagacttttggatgaagggattacataactacaaccattttaactaaacgatcgtaaaattacaaatttaaggtattttatcacaaaactatagatttagtaccaaatttataataaaactacaaatttaatgttgagtatcataaaagtatagatttaatatcgaagaagtcatcaaaaaattataacctttattagagtttaaatccataacactacatttatgttggagctataaatggcgtagttttgtggttaacttggtactaaatttatagttttatgataatttagctacttaatgtatagttttataatacaacactttaaatatgtagttttatgatagtttggtcgaaatatttgtagtgtgaataagctattttttcaaagaggatgcccccttgtttttacatgtcacgaaaacgccataaaaattgaaaaaaaattgatagatatatgatatatatcactctacaaatctaaattcgacctatacaagcaggaaaaaaacaaatacgattgttgatagtgcacattgttaaattcaccgtgggtttttgtgtagcatactcttacatgcccaccatgaagatccaacattagcatctatagcatgagtcgacaagagaagtccatactcatattggaagatatactttcaatttttctttttttacaaaagtatacttttttaaagagaaacgtatatactagtactaaacttgctgttatcaccaatcatatattcgaagttttgccatcaaaaccacagttagccgtggttttacagtaagcatgcaaggcgtgcatgcatgccttcttgtattttaatcgattgcttcattatttatcttctaaagttgataccagtaaaaaaaggtacacgttacttttgtagctaaaggttagtttaacatatatagaccagtatcctcatgaaagggagctgatacgaaaaccatgtattgcattataaagtttatgttctgaaaaggggccaactaaaaaaaaagaatcaacacgtttgcatcgatgacctataatttatcatgttaactttagaaaaagaaatatgtacgcagtatattgtgatggtctagactatataacattataaattaattagtgaataaattatagtctggaccacttatatttttcaagttttttattttgaaccaccatttataccatattttcactttaaactagtaattttatctttgttgtgattttgttaacagtgaaatttggtaatcggcaacgacgtcatcgggttagaatcattatcggctgcagcatctcgccgatgggagttatcaagtcgccaatagtcggattcctgctatattcggttaaggaaatcaatctactaaaggaagcttatccctaagtgaccgagtttaaagaggatgcggcatgacagtttatctattaattaggaatagtttgttagtttccttttatctttaggaaagtgtgtttagtgtctgataaggactttatattttccttttatctttaggttagtttctttcttgtccgacaaggacttgtatcaacccatgggtataaatatgtacacccggggtctatgtaatctatctccacgattaatacaattcggcgcatcgccaccccttttaccttttctaccttattttatcatccggcgggacttggcacccgacgcggggctgcatcggtgttcgatctccagcgaaggggtaagtccaatgtttcgccggtccgagcaattgtatcgtctacgtcggcgtcgttcaaggctgcatcagtacattcgacctcttggattgctctgatttggatgatatatttgcctacctatttatcatatgtctctgttaatctagtcttagcatatcaatttacctctatcggctgcttctcgctttagggtttctgccggtatcggctaaatcgtgttgctagattagattagcttagatatctaccaccctaaaaatcagttaacggcttgattggctagatattatgtttcttttcatacttagtgctgcatcagttaagtttgatctactaagtcgtgtttagaaccataatctctagcttgcttcttgattgccaataagggtttcatcggggtttcagccgatgagttatgtggacgttgcatcggcttacaaggattgcatacatattggatttagtcgatcgtaacaaaggtttcattgtttaatccaatcttgtggattttatgacattggacctccagccgatgtatgctttaaccttcggatcaatgcttattctatcatattgtattgatagccgattggtttataccggattatattgttgtcgtattttattatcatcagtcgattgccgttatatcattatctacatttgacatatagcccattgcttaaaccctatcactatcggctggtatcggcatcggctattatcggctatttgctggaactactccatcggcttgtcagtcgattggctattttgatatactatttgcatatcttgtcagttgcaggatcaaactgactggcacgctcgcatctcatcatatttggacccgcactggagctaagcagatctcctaggctgcaggcccagtttatttgcaaggaggtgtctttccaaattatcggcctttgatcactgatgcccagccatctatttaggcagtttcccccatcgcaccatcagctcagctgacggcgccggcatcgactcccttacctgctccgtcagcattggcactaggccagctggtgaactctcggttgttaatgagagagcaaccacagcatgtgggcaggttgcgaatcggctgacgcaagatcaggttgctgccatgtttctgccgcctcaacctgctgttgatccaatacaacagcaaccgattcaacagacactcccaatttagcaggttgtacaaccaatccagcaacaagttgtgcaatcagtttagcaaacgttaccaaggcaacagcctccgcggccgattcagcagacgccattaagacagcaaatcggtcagccgattcagcaccaaggctcaatgagcgcatcggccgggcttgtgacgcctggtggacagcctatacaacaatttttaaatcaagtcgtcacagaacacttggttcaccacgtatagccagatgacacagtaatgcctcaagttgttcccgagcatttggcacgtaatattcaaccgatccttcataattaccagggggggcaacttgaattatcaatatcagtctccttccccgcaagcccaatatcagccagggggactggctcaacctcagtttgcatctcagtatggtcagttcgagcccatgcaacaacagtcacagggaacagctcagcaacgaccgtgggccaatgtgattgctgatgtaatgagggaacggtttgggcttaaaccaaaagagactggaagcttgtaccggcagccttacactgagtggtttgagagagttcctctccccaatcggttcaaagttccggacttctctaaattttcgagacaagatggtgtgtcaacttatgagcacattagccgatttttagctcagtgtggtgaagcatcggctgtggacgctctgagggttaggttgttccagttatctttatctggatcggcttttacttggttttcttctctgccgtatgggtcgatcaatagttgggccgatttggagaagcaattccacagctatttctacagtggggttcatgagatgaagttatctgacttgacggcgattaagcagcggcatgatgaacctgtgcacgagtatattcagagattcagggagatgaggaacaaatgctttagcttgagtttaactgacgctcagttagccgatttggcctttcagggtatgattgctccgattagggagaaattctcgtctgaagactttgatagcttgtcacatctgatacaaaaggtaaccttgcacgagcataggtctgcggaggctagaaaaagctctaagaaggttaatcatgtttgtccttacatgtatgggtcggatgacgatgaggatgattctgaaatagctgcagccaaatgggtgagaagtaaaaaggtcataccgtgccaatgggtaaagagttctggaaagaaagagaagtatgattttgatattactaaagctgacaagatttttgatctgctactccgagagaagcaaattcaactccctgttggtcatacgattccatcggctgaggaattaggcaaaaagagatattgcaaatggcataattctaggtcccattctactaacgattgcaaggtttttagacaacagattcaggtggacattgagggaggcaagattaagtttgatggttccaaaaagccgatgagggtcgatggtaacccatttcccgttaacatggtacacacagctgaccgaacagctgatacggggcgcatgagggattatcaagtaagttcagctagaattataaacaaatatcaaagaaaatacgacaagcaacaggaaaggcatcatgaagaagataatggtggctttgatccttattggggctgtgagttcttcaggttctgttggaatgaaggtatgagactaccatctatcgaggattgtcctggatgcagtgatgttgcagggggttcaagccgattgtacgatagaggcaatcgaccaaaacagacaagagtacctgttcatcaaagattgggcccagtaaaccaacgtggtgattcggaagatgatgaaaataggaagactcaatggtgtccttctggtatttttacg

SEQ ID NO: 17861 - DNA, 2237 bp, Oryza sativa
ccagtgccgatttagctctttgggagatggatggccttgattgtttatctggaaaagtttgggatggagattttctaaaagtgtccgattctgatatacagccagttgaagatggagaacccaagctattattttgagggtgtcgtggagggttcaaatgtctacactaaggatacggtagatgatctcgatgacaagcaaggtcaaggttttatgtcggccgatgatttggaagaaatagatatacgtccaggtgatcggccaaggccgacatttattagtaagaatttgtatccagaatttagaaccaagctgatagagctcttaaaagagtttagagattgcttcgcttgggagtattatgagatgcctggactcagccgatcaattgtagaacatcggctacctatcaaaccaggggttaggccgcaccagcagcctccgaggagatgcaaagccgatatgcttgaacctatcaaggctgagattaagcgtttatatgatgctggttttattcgtccttgccgatatgctgagtgggtttctagcatagttcctgtcatcaagaagaacggcaaggtgagggtatgcattgattttagagatctgaataaagctacaccgaaagatgaatatccaatgccagtagccgatcagctggttgatgctgcgtcagggaacaaaattttgagttttatggatggaaacgcagggtataatcaaagttttatggctgatgaagatatccataagacagattttagatgtcctggtgcaatcggcttatttgaatgggttgttatgactttcggcttgaagagtgctggagctacatatcaacgggccatgaattatatttatcatgatctaatcggctggctggttgaggtctatattgatgatatggttgttaaatctaaggaaataaaagaaaaacaacccacaccacatagccgatttaagaaaagtttttgagaggaccaggaaatatggcttgaagatgaatccgataaagtgtgcttttggtgtatcggctagccagttcctgggatttcttgtccatgagaggggaattgagataactcaaagaagtatcaatgcgatcaaaaagattaagcccccgggaaacaagaccgaattgcaggagatgatcggcaagattaatattgttcgaaggtttatttctaatttgtccggaaaattagaaccttttacaccattgttgagattgaaggccgatcaacaatttatttggggggcagagcagtaaaaggctttggataatattaaaggatacctgagttcccctcctgttttgattcctccacagaaagggataccttttagattgtatctgtcagccggtgagaagccaatcggctcagtcttgattcaggagttggatggaaaagaacgagttgtattttatctcagtcgtcggctcttggatgcagagactagatattctcctgtggagaagttatgcttgtgtttatatttttcatgcacgaggttaaggcattatttactatccaatgaatgtactattatatgcaaggccgacgttgttagatacatgttatcggctccaatattgaaaggaagggttttgggggaaaaaaaatggatattttccttaactgagtttgatcttcggtatgagtcaccgaaggcgattaagggacaagctatagccgattttatcgtggaacatcgtgatgattcaatcggctcagttgaaatggtgccatggactttattctttgatggatcggtgtgtactcatggttgtggtatcggcctagttataatttcccctagggggcatgtttcaagtttgcttatactattaaaccttatgcgactaataatcaagctgagtatgaagcagtgcttaaagggttgcaattgctcaaggaagttgaagctgatgctattgaaatcatgggggattctttgctggtaatcagtcaattggcaggggactatgaatgcaagaatgatacattaatggtttataatgagaagtgccaagaactgatgaagaaatttcggctggttactttaaagcatgtatctcgagaacaaaatattgaagctaatgatttggcccaaggggcatcggggtataagccgatgatcaaagatgttaaggttgaaattgcagcaataacagccgatgattggagatatgatgtgcatcaatatttacataatccatctcaatcggcttctag

SEQ ID NO: 17862 - DNA, 14269 bp, Oryza sativa
gtatgataaacccaccatcaagtaaaaggcataagtttatattggtggcgactgattatttcaccaagtgggcggaggccattcctttgaagaaagttgattctagggatgcaattcaatttgttcaagaacatataatctaccgatttggtattcctcaaactattacatctgatcaaggttcaatcttcgtgtccgatgagtttgttcagtttgccgatagcgtgggtatcaaattgttgaattcttcaccatattatgcacaagctaatgggcaggccgaggcatctaacaagagcttgatcaaattaattaagcggaagatttctgattatcctcggtaatggcatacccggttggccgaagcattgtggttttatcggatggcttgccatggatcaattcaagttcctccttataagcttgtttttggacatgaagctgttttgccatgggaagttagaatcggctctagaaggatagaattgcaagacagtttgacagctgatgagtattataaccttatggccgatgagagggaggacttggttcaatcgcgtttatgagcccttgctaaggttaccaaagataaggaacgagttgctaggcattataacaagaaagtagtgccaaggatttttcgaaaggtgaacttgtatggaagttgattttgccgattggaactcgggataacaagttcggcaagtggtcaccaaattgggaaggactgtttcaaatctataaggttgtgtctaaaggggcatatatgttgcaagggcttgatggtgaggtttatggacgagcgctcaatggcaaatacttgaagaagtattacccaagtgtttgggttgacgcatgatcggctagtgttgctgatgcatgacagccgatgtgttttacatcgtcttgagatggccgatattgttatatcgcccttagtcgtttttctaattgtaatcggttatggtttgccgatatataacggccgatattgttatatcgcccttagtcgtttttccaattgtcatcggttatggtttgccgatatataacgaccgatattgttatatcgcccttagttgtttttctaattttatcaatgctgttgacattataaaattggggggcacatatatacaaaaaatgaaagtgaaaattagaagttatgttattcggcacaaaggattgttaaaacagcagggtattaaggtatcttagccgattacaggaatttctaagtcctattacacaaaagttattgagacaagtactgctggatagccaaaatagctctttgcctaatgtgttcgacttcttcaatggcttgggcatcttgagcatcagttccagaaatgaccttcagggacttggttaggtcagcaacattcttgatagccgatttgagccttgctttttgctcttcgacagattttgagagatcggctagcttttgtgctccatatccaattcagcattgcattcttcaagctgtgctaagagatcgatcttgcgggcttcaagccaatcggtattggatttgatcggaccttcggataggtgatcgagtttgactttttcttcatgcacaagctgccgattgacctggattgtggcttcaatctccttgcgttcacggcgttcggctaatcttagcttggctttttctagtttaaattgatgttgctcaagataagcggctggagttaggacatcggccagttcttcaggaattagagcttgaacttcgtgcaatcgtgtcctaatcgatctacaatcgaccactaagctatccagagaagaggcctctagccgacgcgagatatcttcaagtgttttctttgcattgttagataagagagctagagcttttgcttgaagtatcttcttctgcctcatcaagataatctttgatatcaaaagagaagagatcggctagaacctgcaggtataagttcagacagtttgagagctaagccaatatagccgatctaaattcttgcatcaaaggaaaacttactgggatagcaggagcagctggttgttcttcttccacaatatgatgactccccacggccgatggagttcggtcactcgatgattgttgtacaggggaagaaggaggaggaggaggaggctgtaaaaagacaagtgttagacaatatcggctggaatcaactagtaaaattgagagtatcttactggtggagctggtttgagaattgctgctgccgatttcttctttatagcagttttcttcttatgcaattacaaagcttatgagtagtcggctgaaaaataatgattataaaagggtttgcagggaaagacgttttactctgaaggagtgggggcagaaggagttggaggtatatgcttaggcgaagccgatggtgttttttcagtatcacttacttcggctgcagcctgatcaacatcatcctcaatatcttcttcatccagagcttgttcaatggatggatccaaagcaggcaggtcatcggttggcttggttttcttagacttggcctttttctttggagctagagtcaaggtgctcacagccaatgatctagttcttcttttcttggttacatcggttggttccctgatggcgccttggaggagggttgagacctaagggggcatgatagccgatgacagggggagacaatctgcctccattaggaatcagacctagggcatattcaatgttcctaccactattgctctgatgtggaggggaggattctgttgtctgcaaaacaagaacaaaagattagtcaagtaatgaattggctaaccgttatgaaatttagtgatgacaaagtttacctggggtatgacgtcagggaatagatctgtcatatacattgtggccgattgatgaaatagatgcaacttccattcaccccaccatctgtcaaagttcctactcctaaatcctgctaactcaatattgtcgatactgcctaaggaaggtccttggaggttaagcagtcgatccatcattagagttgaagaaatttctcctcggcattggatcttgtcagcaaagaataagccgattgggagttggtctaatccaagttgtctagctgaacttatagggtgatagaattcgtaggagacttggatatttcttcctggtgaataccgacatgtaggatgcatgggctgattgcagctgtaaagacttccctggacgtttgatatctttcatgattgatgtcttcaaatctgaagtctaatgggagctcaaggtctgctaagtcttcataaagaaaccaaacccgggcatctttctggaagccttcataaaagctgcagaaccaatctttgagcagctcagccaatagttttaccccagcatcggctagtgtggatgcatattctccatatgacatgcatctgcgatgggtgcgttcttctccatcgtcttctacaattggctccaaccttgggaattcagcttctgttacatatggccgattgacaactttcatgactaccaggtttagccaggtctgcagtagccaccatggtccacctgctccaactattgagccgacggctatcttagccgatgcattgttcaacatttggtatagatagccgagaaggattttgcccaaggggaattgtttctttgatcctaaggctccggctacaaattgccaattggttgtgagaccacagctggatccacaaaagagaaacttttctagccacattagcaagaaagctacgtgctctcgaggagtgacaggccttttgcccatgtatgccgctgcataaccagaccaccctcctatgcttttggtcttgaagtcaaattggttcttggtgttcatactcatagggttagccgatgaagttacatcaatccagtaatcatgatgatgtcgatcaagttggagtcatcggcccttggttaaataagaaggcattgatggtgttggaccaaaaataggtagcggcagccattagaggttcatccttagcagaattggctatggtgagagaaagcgcttggccgatcccaatctcatcccagtggactttcttactagccgatatgcgatggtaccaggtggtccagctcttatcaggggtaggcctttcgagagatggccaagacttgaaggtattcttccagtgacccaggttagggttagctagtctaaaggggattatgttggtttcaccaatgatgaaatcagtggggtcaagattgccgattgggccaagaaaataatggtttttgtgcgataggctgggaatcgcaactaggttggaaaggtgctgcaaatccaaaggaatcgggaagcagaaaacataatgagaaaaggagaaatcgatttcatgcgaggaaaagggatctagccggtgagaacttacctcagcgtactcggctgatggcgcagtagacgggctagtggaagacgacatcaccgcaggcggagatctgatcagaagcgaaatcgcctggggatcgcttttgcgtcggaggaatcgccggagagagaaaggacaaagttttgcttgagcggtgaaaacggaagtcacggcgtgagatttctcgagggcaacggttggtatttaaagcgatagaataacggtcaaaaaacggcagagtgcgaaacttgctcggagtcggtacacggcaaatccggaacattatcaaatatcccggacttggggggcatgtgttaacgaccaaatttggtaatatcagcatcagaaaaggagattagatcgaagtggagtcgaaggcggagattgatccgagaacagagcaagaatcggctgaagtccagatcggctacgattaggatcggctgggtctgagtcggactaggtaagccgatgcagccgattccgacagtataatttggtgtatgacatcgggttgaattgaggtgcttcaagatgatttccgcacatggatagagtcccaagaaggcaattgtatctattaattaggatgttttatgtaacttccttagagatatgtttgggcaaaagtctgccgcaaagacttatggtatcttagtgtttgttaaagatagtggtcatgtccggtatggacatatcttgtaattctcgagtataaatagaccccgagccctatgtaatttttaacacacacattcaatacaatttcggcgcatcgccacctttttgctttagttttgtttcgacgagttcttgctttcgggttgagctgcatcggtttcgatcttcaacaagaggtaaaacttgttatgacgacttgtgttctcgagattagtgcttccatctttatgacactctaatcttgtctatataattcgtcgagttattatatatcttacataatctttggcaatatcgtcatctaacctacaatcggctaacatctgttaatagaaggcagccgattaggttaaatagcgacgttgtcctagattatataagatatctaccactttatgaaacatccagcggctttgttgtctagatattgttcttcttttcatacttaatgctgtattagttgagtttgatctattaagtcgtgcttagaatatcaatctctagcatgtcctctggttaccgattagggtaatatcggagtttcagccgatcttatctgatttaaccatattcaatctatatgcttcagtgacatgttaaatatgccctttatatcaagatcttattgcatttaagtatattaagcttttgtttggtatattatacttgttttgatatctttatatagagtagtatcggagtattaaccgatacatgctagatctatctgatcggctatgctataaacatatataatcctattattaatatatatttcgatttaagtgatttatactgtctcggcatggtgaccgatctatcccaatcatttgattgaagtatatattaatataagaactatatatcgttaatatctacagcctatcgaatagatttagttccttactatctatttataaccactgatcgattcataaatgacatcggctcaaagataaatgatatgtcatcggcacttagccgatcggctatcatttatagatttaaccacaaattctttgtctctatttcttgttgattacaggattaaatcaactggcacgctcatacattcgaagacgagctttggacctgcactggagttaagcagatctcccaggcctcgtgttttctgtcaacagatttaaaccacccaaaccacttttttaagcacatcaataaccaatattggttccaatacactgataaactccctccccaagctatatctttgtcggaggcgtagttagatatgggtatataagagaattggggtggtccagagtgagagagagagagtaaatttaagtatttaactaatgcaaagcgaaaggattagtcaaaagatagtataaattgaaacattggcaatagaaagtagtctaagctacaattcactcaattaatatacatattaatttgtcgaaacacaacgaaattgtatagcagatgcaattctacttgtaaatgaaccttaacctgcgatttgcgtagaattacgtgaaaattttgggtagttttattagtacaactttacaagcatacaacacatcttgtgaccacaaagttggctgacataaccaataatcatgacatacatgtagataagcaatccagcagtccaagatgtcggtctactcatcgtgatatgatatctatcctttcgagaaagacaaccattaggcgcgtgcatctgttaaaatttaaaaagaaaactcgtaggtaggagtagttgcgtattttatccaaattactagtagaagagtagtagtacgagatatctgtgtgcatggtgctctcactcgtgcaaagaaacaaattagtaaaacattgtggccctagctgcctggaataatcctggatcgctaatccatcacaccccctgacaaagcacctgtcatttggtttggagctagaatgatgtgagatttcccctgtgacaacttccctgtctaccagtaagactaacctcagaataactattgaggacgacaacagagatatttcaacagagataaagattgacgagaagaactgaatcaatagcactgcatgcaaccacacagattattgtggcgtatgtatgtgtatcatcctcgatcaaattaaaggaacgcccatatctgcagtcatgtcgatcgatcgcacaccatagatgagattgggttaatcacgcatcccccaccatcactggaaaagataaccgaaacagctagaagcagaagcacaaagaacaaaatccaatagtgattagtactcaacaacagcagcagcagcagcaacaacaatctgacgaaccattccgtcatgatctgcatgccaatccccaccatctctcgtggggcagcacacactgcacgaacacacgctattccctcccccacttggccggatcagttccaccacaagctattgccaccccactcgatcccccggtgggcgccaccgcccgggtcatcggcgattcgtgtaggcgccaaacaggctcacatgttatattttggatttttttttagacttgtgtacttttttccttctaaattctatgcaaatagttatgaaaaagatttaaagaaaataacaatatagactacagtgaaatctagcgcttaaccgaaaatcaacatcaaattcgacctacgtattaaagaagaaaaagagacaaatttggatataaatatatagtgccactactatttaccaactgaaactttttatatcttagtaatatatatgatgagttttaacgacctaagattttgtggagcgatatatatatacgctgcataaatatcatctatttttttcagaattttttgtaactgattgaattgtttttagatggaggaggagacaactgagggagggttcaaaacagtttcccgtttttgagcataacaatctctctctcgttcactgcagcggttcacctgaaccctgatattccccgaggcccgcgtgtcagcgacacgggagccggaaggaacgcgagcacgccatgacagtggcggccggcttccgtagcaaaggacgtacgtacgccactgccactagctaagctaaagccaaactcctcgcccgcacgggccgcgtcctataaaagacacaccacgcgtggcagagcacaccacgccccaattcgagatcgatcagctccagctcgtggagtgtgcgtagcttgattgcacttgcgcagcgaggttaatcagctgcaacggcggcgaggtcgtcgtcgcggaggagaggacggcgtctgtttcggtggttggtgcttccgccatgctgcagggggaggagaagaaggccgggaaggtgaagaaagggtggctggcggtgagggtcggggtggagggcgccgacggcggcgacggcggcgggttccggcggttcgtcatcccgatcgcctacctctaccaccccttgttccgccgcctgcttgaggcggcgcgcgacgcctacggctacgactcggccggcccgctccggctcccctgctccgtcgacgagttcctccgcctccgctcgctcgtggagcgggagacccacgcggccggcggcggcggcggcggctcgtcgtcgccgcaccgcgtccacgccggcggcggatcgcaccaccaccaccactactccttctccccgtgcacccgcgccaaagtcagctcctgatcgatcgagctcgcttccgtgcgccatggcggagtcgatctgccggcgaggacgccccgcgtacgtgtacagtagcgattagctatagctagcagagacagtacacgacgagaggagagtggagtggcatacagtagctaggtgattagtgatttgctccgggttttcgatctcatgattttggtctcttgatttccccttcttcttcttgatctttttgatcgatcttgtatagacgcatgtatgatagaattgacaggtcgacttatgtatgtataattatcagttgaactcacagttcatagctattatattctcttcacacattttatagctcgatttgcttctctgtccattgctaagccagacgaattaattagccgctgattgatcaagacggattaggcatgagctcgaggtcgaggcgattgcttctgccgcctgccggcgaggcccacctctcaccaacgccggcacggcgaggagtcgcggcagcggcggcggtagctcaccgtgaaagccgccgttgactgcgggtcagcgagtgagcccacctgtcagagagaggagttgagggggtggaggtatatttacacaggaaaccctcgttttcgtcgaattatctttcacaacccctgagaattgggtcgcgattaatggtagcgatctgactagaatacctcttcgccgttcgatcaaactctgcagttcagattggttggactcgagtgcaggtaggacgttttcgttgagaatactcccgagagtttggatcgcgaccatcttggatcactcttcatcgtccgattatcatctgacggtcgatatcaatcccattggagagagtaggacttgtttttcataaaaccctcctctttgttcgtattagagcagatacaatagcgggctataagctagttataaatatattttaaaaagataaagtaagagagagaagagcaaaagataaagtaagagagagaagagcagcaaactacagatatgtagccagctgcagaatggactccaagacgtaatttgtctatgacaagtgagaccagatattaatagtatagtaagcaactattgtatgaattagctattacattggctatagatgatttggagctagtagtgggctatactattaaacttgctcttatcagttaggccggcgactctcttccttctggtgccgaatgcccgaactcgccggagctccggcgatctcctggaacccaatcgatcggttagtttctatatgttctttgttgcaaaatagtttgattagtatgtataagatctactttgactgttgtttccaggctcttgaatcttgattgactaataagtgtcttgagaaaagttatcttttgactgtcgatgggtttcaattaagggcatgtatgatctcaaatgagggttaatttttgttggttttctcggtgcggcgtttcttttcctctggacgactcatccatgtcgtgtccatcaggaatcactgaatcaggataggttcagcattgaggcaatttgcgaagaggtgacagcactcgtctcaggacctgatcttcagtgcatcttgtctctcgatctctttctcttccttttcttttccttcttttctttgcactatacatcaaatcaaattgacaaccaaaatctccactacttcatttttaacgtgaatttataggtggtacttgaggctaagcctaggcaagagacgcagttgtgtacctccccatattatggcaaaaacagttttaacccgaaaaggctttcagcagttcatcgttttccttcttcttcttaggctctgggcacattgccaaacctacaccctgcccacccaacagccacggaagaatggtgttcttgagttaacaaagtcaacaaaaagtggtggtctttatgacaggcttacttgtgagtcttttacccctatgccattaaaaaagttggaggttacgtgtgtgctacaaaaaaaattttgagtcacctgtatgacatgacacaaactttcgtttacctgtgcgccactttggatggaattagcactaacaaagactaacagaggtttgaaagatctattttgcccttctatttcatccacttttgcggcggcggtggtggcgctgcggcgtgccggcgaggcaaggcggcgacagcggcgtgccggcgacggcgacgaccggcggcggcggcggcggcgtgccagcgacggaaaacgaggcgaggcagcagcgtgccggcgacagcgacaaacggcggcagcggcggctagggttcaaggcgcactggaggagaggagtagtggagatgaaaatgctttaggggcaatttagttattttcatacgtgggtcccacatgtcagagctcattctctaacagaaggtggatggaatggcacacaggtaaacgaaaatttgtgtcatggtatacatgtaactcaaaacttttttgtggcacacgcgtaacctccaactttcttaataatggcataaaggtaaaagactcattacttataccatgagtgtacatccaaattataaatttatacactaaaagtggtggtctttatgacaggcttacttgtacattagtgtacatccaaattataaatttatacactagaattagtcaaaatttgacatttcttttagctgaaaattaacaccgtaagattacattcattttagactgccattatttctgtgaccggagggaatacagtaaagttgtccttgcaactcagtggatataagtcatgactcgtattcttgccaccaagacttctaatgtatttaagatgtaaagctataagtcaatttggactttgtatagtaggattaatgatctggtggaacaatgggaaataccataatagtaatgtacagtgactacttatctttgagcaatacacagatatcatatcaccatgcaagttgattttaatcaattaaagttttcaggtagaaagtacaaattgaagtgaacactagatgcctaatgatatattaaccttacaaaagcttgtacatccattaccatagcccaagaaagaaactcatctggaaagctgaaacaagctagacaaatagttgcaatttgataagtacatggttcttgccccttgccgtatcaacttctcttctctccattagcacatttccagcatattccccatgtataactgcgtagacacaagaattattatatcatataaaacgtactttcatttttcaactattttatctcgatcaataatgatatagcttcgtggctcagttcaataataataataataataataaatgcctgcaatcttcaccgatcgcaaaactgaacactgatttttttcaaaaagaacaaaactgatcactgtgaacgaacagaagcactagatgtaactgtatatattgacaatactgtcaacttgtactagttgccgtactaatccagctgcaaggctagcagaggcgcgtgatctcactccatttgtgcagttgatctgctttgttcagagtaaacaaatatcagatcagatatactactgccgtaaaaatcacccaaagtgcagttcagctcattcgatgcatgcatgagtggtctcaagtttaatcttttttaacttcaactatcatctcctacagaagtcagaaccaatcctcagctcgctcatttgttctttccacttccttttgcgctttaacctgagcttgtcttagcctttaattaaccaagagataatggcagcaactaatctggctgccactagattgttctgatccatgttccagataacgatattcacgaagaattgcagggcaaagtaatggacagagatgacaacataagcagcttgtttatttggatgtgctgcccaagtggagatcggaatttcagagctcgtgccagcgtaacgagttgccattggatggctcgtcttattctcgcaataaaagtgcttctgttagtactagttattagtgcaaagaacacttttccaaatgagattttcgcaaatattttagtaccattaacagaaaagaacagattggatcgctctgaagttttccctgcctgtcaatggaagtagtagtaaaagctagtttacaacggcgacgaaaaatgaccgtgaatgtgatcctctagtaactctgaagtttctgagatctgcgtcatgagcagtgtttcatatgatgcctagcatctctgaaaacaagtccacaaatcttctcgcggaatccttcagtttgagacaaatgtatagtatgctttgtcaattgatcagttgagcacgtaattgctacctctcgatcgctctctctttcaacgaaaagggagagcacgaattgctacttctgcagcaacaggccatcagctagacagatactcctcgtaaattgtccaagaggccagccaatcggcctcgacacgtctatctgcatttctgtcgcttcttcgtcgtgtcaaaccggctattgttcattggtttggaaattttggattagacgtcgccggcggccatggtacgtccgtacgtacgtgtttggaggtgatgtgtgcagttggtgaacacagattattctttgggattatctttgagagtttgaggcccgtggcagctcgcttcaggaccggtggccgtcttctagggcctgattacttgaacatcttcgtgtcggcttcgactctctggtccttctggtctcttagtagctgtgaaaggagcggaattttagggttttcaactcggtgctctcctcggtctccgtggttttcgagtccatcctctcagaggattgtctgtggtcttccactggcgttgctgcttttgtgttttttttagtgtagtgtggctccacctctaccctctcgctgattggagtagcttttatttttcgagaatgcgcaaaagagttgcgcatcttttgtattaagattggggagaaattgtgacagctttacagtgcaactgaaagagaaaccgaaaaagaaaggcaagaaaaggaggctaagctataatctcatgacatcaactttgcaaccacgacagccatgatctactcggggagtagacctgctagcctccatagggcggcctcctctgctgctgccctagcaacctcctctcacgctcactgcttctggttaaaaaccctattgttcctctctttccatatgaaccaagcggctaggaccacaactgtatcgaaaccacgacggagctgcttcgtcactcccttcctggctgccgaccaccaagagatggagttctgagaggcagggaagagatccggacgcccaatggcattcatcacaatccaccagaattgtgcggattccgggcagtggattgcgttgtgttacaattttttttttcctttcaatatattaacgtgcaattttttttgcgtgttcacgtgaaaaagagtttagctttgtgaacttcttttgaatctggcctgattggactggttgaaaaatactcgatccttcgtcggtagagaaaaccttaga

SEQ ID NO: 17863 - DNA, 7303 bp, Oryza sativa
aagatcagacttttgtgtgtttatgaggtgtgtacagcggggttattgaattgctatggtaccaaagtgaaatgagtgaaatgaccggtgacttatatttggtagtatttgaatatgacgataagtacaatagctgaaatagagagatgctacggtagctaaatgaactgtgacacattaaagaaaatgttattttgtaaatatgaaattatgctgatctgaaaataaatggtaggacgatggaacttgcctgctctacgcttcatctaagttaccaggcacaatttatgcatgtttgtggtgttattgatcaatttttgtgctgtaaatcacatgatcaacataaaaaaaaacagctattctcatgtgagataaatccaagtaactagtgaacaaaaactaatcctgaactccgtaccatcatagatttggttggttggtcaggaatctacaaaaggaaaatgtgaaaggcactgctctccttcttgattaaagaagataagctgctagtttgctacattaccgaaagtggataatcaccacgtgaggttggcatcttaagccgataaaagcacttgctaaagcgtgcgtatcactcttaacttgacagtatttacacggagcaaatggcgagagctaccagcttatagcatcagcaatagcagcagcagaactatattcttcagaaagcctggcgccgttggatattcctgcatttcttggatttttattccgatttgcagcgccaattgatccttccacgggccatgactcatggagctattcactgtcctttcggcacaggagcagacacttgttgcaacctgcagagatgcttctgaaaggcgaaatgttatctggagctgagcatctgaattcatttcagagagaagagcaatggcatttcacttctgcctgatacagtggcatggtcctgctggtcctatgcgttggttggttgggatatgaggtgtgcatcgtgttagtggactggcttccctactttggtcagggaattcagcattggaaatgtgcagaactgcatatcaaacagtgtggtgcgttaggcaagaagctactcctacatgatgaaaatgagtttcaactgaaagactgaaagcgaaagtaccattgcgcggacggaaaggtaccaaagatgaggccaaagtccaaagagaattagaagaaaaggagagagcgtgaaagctaacttcacatggctcaaaactgctttgtagaccacagatcagcaacgagatctgattccaagcagttaaaaaaatttacccgtaacactctagcgagatctttttcgacgccggcagatgaggggtcgaagaaaaagagcttgtccgtggctccccagtaaagaaaagccaaccaatggtcatgtatgataacatggacagaattgacagtcgtcagagaagagagtacttgaaacctctcctttcatgcaaagattgcaaagctatatagggtgtgtttagttcacgccaaaatttaaagtttgattgaaattggaacgatgtgacggaaaagttggaagtttgtgtgtgtaggaaagttttgatgtaatggaaaagttggaagtttgaagaaaaagtttggaactaaactcggccatattcagagatgcgaccgagtacgacgacagctggaagatgtcatgaaagaaagccacaattcatggcatgaattgatacccatagaaagaagctccaaaaacatcgccgatatgatactgtccacctccccttgcctaaatgaggcttcaagtttacaattactacagaattggtccttgactacacattgcaattcacatctgcgagtagagaagtagtagacacaagatgaaacttgacaggatctgatgcggcttgttcatccaaggagcctctgaaacgcttccggcagggccatttgcagtggatactttgggcagtgtgaaagaccctccttgcactgatggtgagcctgagttcggagggggaatggcgccgccggcttctgcaggtccaggtgccgataatggcgggagaaacgttgaatcatggttcaccgtggtagggggttcagtgagttcagggaactgatgtggtcctgcgtgcagaagaagaataaaaaacagtggacatgtatcaaagtaaaagtggcaatgctgactaaaagagccgagttaaagaacttgtaatcatagaacgaacaattgctgctcagccaaagcgaaggtatgaatgtattcattcgcaaagtatgatgcaggttgctctggaattcaaagtgacaaagtgcaatttttgcaactattcaggtgggatgttaattctgttgatgcaacttactactgttttttttaataaaaaaggatgcatgcttttccagttcaaaaacctgaaaaatactaacatctgaggcagattgaaattcaaatgcacgatattgctgcattgtaagccagttgcaggccacaagctcacagcaacagtaattacctggacatctggattgaagacctgtgctcagcctgcaaaggaaggtagaatgtaacaacttgatagtagaagtagaaaaaacagagactctgagcaacatgttacttacaatgtggtaatggttccattaacaaaacctccgtagctacaagaagaaacattgcagcctgcactggtggaacgagcgcttacattacctagcagaacattgctgttactgcactgcatgcttggacatgaccctgtcaatgaagctggtgtgcaatataaactgagacagaagagaagacagacattacgacccaaataatggttccatataatatcgtgttaaacagaaaaggtacaatctgaaaattacttgagattccctggcccgcaactacactgcacacagtttccagcagtaagtgcataagtcccatttgccacaattagtccatggtctgaagcagatttgggaaatgcagatgtacatgctaagatacagaaacaagcaacaattgtcactggaagaactagggagaaaatgctgatatttagaaaagataaatgatgcagcccaactgttgtcacagaaggcagaacagaagaattagcaatcaacaaaagatagagtccataaacgcagaggctcatcataatatgatgcttatgttttcttacaggatacacaatctgaaactcactgaatgaatagaaaggaaaactgaacagttcgtgcataactctccaatagtatcttcctaattcctattgaagagtaatcgattgcctaaacaaagttctatttatctgactccgatgttagcgaattgaaacatcgcatatactccttccgtttcataatataagactttctagcattggccacattcatatagatgttaatgaatctagacacacatatatgtttaaattgataaacatctatatgaatgtgtgtaatgctaaaaagacttatattatgaaacggaggaagtaccaaacatcaaactgcagctagtaattgggctactgtaatgacgacagattcataatttcaaatgttcagttcggaccaacatgaggaagactaaaatcgagcaagatggtgaagcccgacattaaactgatgtgattttctttactgtactaatcaattaaaccctagaatataagcagcctatgaagcaatcaaatattaaagctaaggcaccaatgcaatgtccactagcatgcatactgtttatatccccaatgatgcattgtctgattattatttattcagaacaaaaacatactgacgaaccaatttgcctgcagaaaatatgctcgtttgcaaagttttagctcaaaacagttagctcaatgcaataaaccatacggctcatctgcgatatcgtttgcaaagtttgagatgaacatgtacctggcaatgggatggcgagaatgtcgcccggcgcggcgatcgggcttcccatggcgttcacattcatgacatccgtgacggtggtctcgtagctggcggcgatggcgggcacggtgtccccgacctgcacgacgtaggagaggtacacggcgggcaggttgttgtcggaggagttgaagcagacgcagggcagcgggacgacgagcttctggccggggtcaagcggcgcgtcggggtccgcggatgcgacggcgttggcgttgcggatctggtcggcgaaggcgagccccgcgaagacgccgtcggcgacggtggcgagcgtgtcggcggggcgcgcggcgtagcgcacggagaccgacttgcggacgccgtcggtgcaggagcagcgggtggggacgcggacgaagaggcccatcgggaggatgcggtgcgccgcccccggcgccccaaagtccagcgcgttggcggccagcagcgccgccgggtccgtgccgaacagcgcggccacctccgacaccttcatgtcggcgtagagcgtgtagcccagcagcgccgagcacgagtccgaccccgtgcacggctcgatcgtcgtcttcgcctccacgccgcccggcaacgacgacaccatcacaaccacgaccatcgccgccgccgccgcgacggagccacacacccccgccattccactccactccactccacactccaccaacttcaactgtgcagtgcgtgactctgcggaagcgctggtatacaagctgagaggaggagggtgggggggatggcccaccggtcagcggcggaaagggaggagcgagtcggttgctgggtgagtaatggcgggaggacgctggaggcgtccgcttttggcagcgatgggggaatctgtgccaagcgaggggaggagggaaaggtatcatcagagcaggtacaatagcataatataagtcagctgcaaatatattttaaaaagataaataaggagagaaaagagcagcggtctacagatttatagctagctgtagcacggactccaagacgcagtatgtgtatgacaggtgggaccatatattaatagtgtagtatataactattgtatggatgagttattagattggctatagatgaattggagctagtagtgagttaaactattaaacttgctctcagagacaccatatctttgcctctgccacgcgttggtttcgaggctgagtcactgcctggtgggtccgaggataccatggagcccacatgtcatggagtggttttggttaaccgcgaggttgacggggtgcggtgcgtctttgcctttcgaaaagagggcgaaccggcgcaacggtcgacgtgagctgaactgggccgcgtggcagagaacggacgggacggcctcgcctgccgtgcgggctgtgacccggtcacgatctcttggcgcttgcggccttgcgggctgtcgctgacttggtggcagagtcgcgaactgtgtttcggattgggctgcaatgagtcaggcagcggtgtggcccaagggacggtgtggcatagcccatgaacagacgacctcacaagttgggccaggtagaactctccaccggcctgttacgtgtgcggcagcgaagtaggatggcccttttatatgttgagggacaggaaaaagtacaaccgaaggtccgtcaacttgtcatcgaattacaaaattgtcattcaaccataaaatatataacatctctcaatttaaaaaaccgttcactttagatccttcggtagttttgacatcaattttatctgacatggctactaagtcaatatctttcccctcttctacactgtgaaactgtgtaatattggttgctaaagagagaagaagaagaagaagcagacatgcagaattctactagtaccattgaaaaatgtacgtacgtcgacgtcgtcgctgtactgaccgatctacgagtacgagcagctagcagagggtgtttgactcgtagcctttccggcagtgcatgcatgttaccggccgggggcaggcgtggctctggtgcatggatgggagcacgaaccatatgatactcgtagctagtactcctccgatccaagttccggcgcctgtggcgcgcgacaagaccagacgaaggcaggagggatgcgatgatcgacgcgaccacatattataacgttctctccgtattcgcaaacagttgaccggtgttataatattccacgggaggattcatacgtttgccgtttgcgtaaactcaagagatgccagattgcctgtccacgatattggattggatgtttctcagtactgcactctgcctctctctctctctctctggcttccatctcgacgaataacttaaagatatcaatagtactccagtactatctttgattattaccgtcgatgtaaaattagtccgggtcagatagctgcagcatgcatgcatgtaatggccggccaattagcacactgttactccggcctgaaagagggttcagagacagtttgggtggacaaacgagtaaggctgtgtttagttcaacgcaaagtttagattttggttgaaattagagatgatgtgactgaaaagttgtatgtgtatatatgacatgttaatgtgatggaaaaggaatgaagtttggactttggatctaaacacagcctaagctggctagcaagcatgtatgcatgggatggggcacacatgggtgcgaggcgagcgtcccatcggagaggcagcatcctgatcaaatcacgccgactggtctgcgtgccttacgggacgggccactgtgcctgatgctacgttgtttttggatcgcctgctcgtgaatactcctttcttaagcagtagtccacttttctcgtcaatggctgtgtttagttccttctaaaattaaaagtttgggttgaaattggtacgatgtgactgaaaagttgtatgtgtatgacaggttgatgtgatggaaaaattaaagttggaagtttggattgaaagtttggatctaaacacagccaatatattgtttgtgatagtgtgatccccactgcttaattccaagtcattccttatttgctggttgatgatggtgaaccatatatatgcatgcatcgagaaatatattcacctttcaagggccatgtacatgcttggatgttgattcgatggcttaaattaaattcatcagattaatttgaattgtaaaatttgtcaaagcagctattttgtggttcaccggatgtggttcaattggattttgcgctagctattaaattgcagaccccagttgggagcactacaagtaatcaaacctacgtatacaaagtggtcaacctcaaaatggcagtcatatatagtactagcctactaggcctgagtatattgcagaa

SEQ ID NO: 17864 - DNA, 8945 bp, Oryza sativa
acccctgagtcattacattcagagtctcagagacttgataatgcagtagtgtcctggtatgcgggaaggagacatgcagtgtagtactgaaatcagtgatacacaagctcacccacgtacgtccgcacgcacggccccaggaaaaacggggcacaagctagcagctgcataacgtggccagtatacaacgtccagtacagcagtagcatggactagtacagtagtagtactgtactgcaacaatctgactatttttttttggaactgaaatcatctgactgcgtcctccttttcatttcctttttctttaagccagaaagatctctgactgcctcttcgacaagaatgcaatgacgctattttctttgtgtgtttatttagctggtcaagtcgccgtcacacaaatgtaaaatactccctccgtccaaaaaaaaaaacaaaccctgattttcgtgtgtaatgtttgaccgtccgtcttatttaaaaaattataaaaaaattaaaaagataagtcacgtataaagtattaatcatgttttatcatctaacaataataaaaataccaaatataaaaaaatttcatataagacgaacggtcaaacgttgacacggaaatccagggtttgcttttttttttggacgaagggagtatacagtaacgtacgtacaagcgtcacacaaaggtaaaacatactgtaacgtacaagcaatatatgccccctacaagtgtccaaactgcagagaatctgcaaaactaattaattggtgcccagttcgccaatgtgccactgatcatgatttatatattgatgtaggagtactaaatgtgcatgctgtatcgggaaggaatcctatcgaaaaagataaaacaaaacatgccaagacactcgttatttggagtgtataattagggacaagctgggtgcatgaacgatttgtctcatccatgcatacgcgatcatatcagtatcatagtatcatgtggaacagggtcatgcatggcagagtgtgagcatgcacgtacgtacctctcactgcaacagtattcagcagagatcactgcgacaggggcccatgatgtgctccatcacagacacaggtggcccacacatagtactcggcgttgtgtgcccatactgccattgccattaacgccagctacgtacgcaagagataccatgctccccaaagccccccccccccccccctctattgttttcttgttgccctcctcctcctgagcttgtaaaccctagctaacacatctaatgctatagcagggtgacaatttatgagggttgttacacacacatagctgctatattctcagtgatgcaaattttcccaaaccatacctatatacttcatccgttttatattataaatagtttgattttttttcttagtcaaagtgctttaggtttgaccaagtttataggaaaaaaaagtagtaacatttacaatactaaattggtgccaaatctgtagttttgcaacattgtgttttgattctgaagtatataggccgagtttagttccaaactttttcttcaaacttccaactttttcatcacatcaaaactttactacacatacaaacttccaacttttccgttacatcattccaatttcaaccaaactttcaattttggcgtgaactaaacacacccataattttgtgatactctattttagatattaactggcgagagtttggttaaagtatttatactcatgtggaatttactatattcacaatgactacaactacacacactggtatatctctttctattcaccatgacacccatgagctagctagctactctgaggggttgtttagatggggctaaaactttttaatcattttcacatcggatgtttggacgctaatttggagtattaaacatagactaataaaaaactaatttcataaatgagagttaatccgcgagacgaattttttaagcctaaataatccataattattaaaagtttactgtagcatcacattgtcaaatcatggcgtaattaggctcaaaagattcatctcgcgaattagtctaaggttatgaaatgtgtgtaattagtctagtaataagtcccagttgagctctatggctggttagcgtatttaaggagggcagaggtgccatgtcgtcagggctactcccctcttttctctcctgtcacactcaagaagacttgtacgtcctggattatcagtggcctactgttgttgaaaagacatggggaaagaaatttgtcaccgcatgcagctgtgtgcgcttggatgcttgcatatgccacttgcccacaattatgcgcgcatcattccgcctagaagctcgaatgattgcatgataatgcgtattgtagaataacacttctcctctagctaggtactccttcccctcatatctagtaatctctcttcgttgccgatcaagaaaccatgcagggagatcaaagaatgacgaaacatacatttttgcaggtaagtagtaaaacccttgctagttagttaacgctgcaagaactaatgtatgcgtaattaatggatcagtagtgttagcatgttgatcaatcatcttcagactcccaagcaagttcgtgctgaattactacctgctgtctgaaactacgtactagctagctgacttgcaatctagacgaagacagatcgaagagctaactgcagagcaattgggcgtcgatctaaaactacctaataacctagcatgcggtagatcaattgtcaaacagtcaaagggatgaagccaagagaggcagagagcatatgttaagcttaccgtctgtcggcagtggattgttggacagtgtgaggtcgacgacgacgcgcggtgatcgatcgcaaagaagactagatcatcgaattgacaggacaatatgccgcatggttaaagggattgaagcctggtccgaggctccgagctcgccggaaattaggcgcctccagtaggaaaggagaaaccggagtcccggatgcctcgagccagacaacaaaccccttaacctaatccaagcaaatacacacacactacagatcgagacgccatggatgcatcggcttgcgaggaatgaagcctggtccgacgcttccacacgcccgagccggctcgatcgccggagaggaattaagatgtggatacctcgagccagccaacattccccacaagccaccatggccaatgaatttaatgaagaagagcacggacatggcgagccatgaaagagcagcagctagcagtgataccacatgctagcagcgcgttgcaatggatggatcgttgggcaagaaaggagaaggatgcgagggttttgaagaggagagggatcgatggggcagggaagcgaggacaggggcagtaatggcaatttatggtgacatgccccatttggcacagcgggtgccctaatgcccaataactgcgctactctacgtccagcccccggcctgtctttacgttgctcgagccagtgaagggctttgcagttctgctgctgcttgctagctgcgcgcatctctcactttcctcgctcagagagaggccacagctgactcactccactgctttgaattcccacaaaatgcctcgtgaagtgcaccccttctctccctagctctctctcgtctcttcagggcctggaatgtcttggacaagcttgtggtgaaaatttacttttcatctgaaattcagaattgaggaagtactcttctaaaaaaagttcagaagagatgaacggcaaaattcatattttcagaactgaggaaaagactactcttctaacaatgggctcacacgagatgaatgtcaaaattcggaaatgaaaagaaaaaaatggtatacttatatgcagtgatcaatacactttcaggacatgatcggtcggtgcttttaattctgatccgacctgagcatattcattctctttaagacagcattgaagtgcccttatatatatcaagagatgaggtatagctttacgatcttgtgtgtaatactacatatacagtactcctactgttcactgtttgtaagacagcattgaagtgcgatagcttaaaaaaagtgcattcatttacatttttttccccttaagacaagcagtgtatggagtccattttgcctcgtgaaatgaaccaatttagtgtaaattaaagtcagtggaatgtctgtgaaaggcttgtaggaagaaagccttcattaaaaccacaccaaatataacctcatctagtcacctgcgatctactagcccctcttccatgttttactgttctgcagttacctgccccaaaactaaaggtcttctacacacatacctctactagcagtagatagtagctcaaacttctaaacgttttccatcttggaaaggatggagaataggaatgagacttggatgacttgacgcaagcaagtgctacaagaatcaaaatgtcctttatgacaagctagctagctcgccagccaaaaagggcttgtaattgcatcaccgaaatgtcaacaccactccccgaaagagtattcaaaggctttctagctctgggttcttgggttcttcctgttcttgggttcttcctgtatatacacatgtatatgtctcagcttattcaaaaacatgtccatcaacacacggatacacagtgcacgcacgcatgcagtccacgcattttggaaaattcaaatttcaaaaatgaatgtgtactatatacatatacacataaactaatttgccaaatggtctgaagatcgacctggcctacattgtatattttgtatatacgtctagggctgtcaaaaaagtttgagactcacgagttgctcaagttctattcatcttaggctcgattcaagctcggctcgagctccagtcgagccgatcccaagcctctcttcaagctcacgagctttatcgagacgagctcaatcttccaacgagcatagcaatatattatttttattgtttatttaataaattatgtatcaaatatactatttgtaagtatcctataaaatgaagtattttgtattggcatcatatgtttattttattcattttctcttttattaatgtgatgaactaaaaataattaattttttaaacagattattcttgaaatatacatagttctacttacaaaccgaactcgatagtcaagctcgccccaagcctatctaaaagctggaaggtttcgtaggctcggctcgagcttaagcataggcaagcgagctcggcgccacgcctcggctcgttgacagccaatacacctaatactagcttgaaactgatcaagatgcctgtgtatatgaatgcatgtgcagttttgtaccacagtagcagttactctcagtcaaccttgcagtgttgaccaatgaccaccagcctattacacacaagtacacagtgcctttggcctcccacgtagcccgacagagcttgtgatgatcaccatcattacctgttgatttgctcagctcccactccctggcacgtgcctcgtgcgagagagccacagctacagctagggcctccacggcctgcagctagctagctagccactggctcgagcattctctgctttcctttaatatgagtgagaaacacgcgtgaatgacgctccggccccgtgccatcagcagtactcgcgcgctagcttgagactatatgcatgctacatgcaatgcttgcacgcttccgatctgcctaccttttgatctttttttgttctgaacgcttgcacatggtcaaagtgtacatgtacgctcagctggtacgacgtagctcccctattgatatcgttgctcatcacaagcaatgaaccaatcgtggctctccatgtatgtaaaaaaaaacaacgagaaaaaaacactatggcatttggcaggtgaacacgcgcgaggacaggcagagttacgttgcagatgcagacatatggaccggtgcggcggtgcgtcgttgccggctggtacgtacgtttgccttgcccgcgggaatgggcaaccgggcgcagcgcagcgctgcctccgcggattcgcaggggcgcgcggttccgtggcgcgcgcgcgcgcgtccgcgtccgcgtccgggaacgcgagagtgtgcctgcctcgcctgcgcggcgcgcggcgacacagcgggcagcgactggcattgtcggcgtggccggaggggtcggggcgcgcgcgcgcagcagcagcagcagcagcgccggggtgggccgggtcccgaggcacggcaccggccggacacgcccgttcggccgtggcatcacgcgttgcaggggcggtccagtggagagcagcagataccgtactgtgcgagataatagctgtatgtaaggtatgcctgcctgactgactgactgccttcaatccttgtaggtggtgtgacattatgtaatggactattccatttcttctcctggctagctagcttctcctcaaggaagaaaacatgcgtatgtccatcagtccatatgtctacacatgccatggaaccaacgctttctgatattagttgattagtattacaaaaacaatatccatttgaatatgttgttttcagaatttaccggtgttctttcctgcatgatgagcgcctcaaaatgtacgtagtgtagtaatattccccgtatttcgtggccaaaaagagagtgaacaaaaaatctggtgaatctggtgtgtttagttcgtgggtgtcacatcggatgtttgactgatgatggaaggggttttcgaacacaaataaaaaataactcgcctggaaactgcgagatgaatttattaagcctaattaatctatcattagtacatatgagttactgtaacactttatggctaatcatagactaattaagctccaaagatttgtctcgtgatttccatgcaaactgtgcaattagttctttttatctatatttaatgctccatgcaagtgtccaaaaatttgatgtgatgtttttggaagagattagctatataactgtcgataactttttagatgaaaaactttcaaatgtaactccactataattacaacgtagttacattgtaactagactatagttacaatgtaactggcacaaaaacgctcagaatcacgttgttgcttagttggttaacatatgcaccgtgagatcgtgggttcgatccatgccccaagtgtggatgtgatttttttaatctgcttgtgcgcatcttgatgtcgaataaggcctaactcgcaaaagaagtggacatcaatatgttagagaaaaaaaatgatgaatcaccgtccttggacggaaaatttagtccgttggacttggaggcgtccctcgcttacggagtcaacaaaaagttgatctcgagatccgcgtgcaacgtcgggtttgaacggccacgattaagtgacgatcacacgcgaccgaccggccctggcccacgcccacgcccacgcatggcgaattggcgatgcttgatgcttgcaagttggtgaaggattctcccggtcgtacgggctcttttcgcggtgaacgcgcgcgagaaaaagaaaagcaacggtttaactcttgtgcatggcttgtggaccatagaccacagtacacgtggccaacggctgttctactgctccagcatgtactagtgggtactactcctgccagtttcacatgcatgtgagcccctggtttcacccagaattttatcgagcagacggtgcacacttgttgggtgaactgatgatgaccagttgagtgtccattgtccatcaacttggacataaacatacacatgctgcataagagacaaaaaaaaggtgatcagtaaccagcttaccgagaagcgagtggttgcagcttgcaggttctgactctatcaacttgctaaaatgggggatcgattgaacgattccccttgtcatttcctgttccacgcacgcgcgcgctcgatcgttcgggccagctgctgcttgtatggttcaagccacatagccatgcaaagccaaagcaaacctctctgaactctgggtagatgtctccattatttttgctagctaggttaacagtggcgcataatgcagcaacgggacaaggaggtagccggaggagcccaagagagagacagagagggagagagttgagacagggtcatgtgcggcggtcagaagagccttggccgccgggtagactggcgctgtggcagcagcagcagctgcgcggcgcggccggtcaattatggacaaatgatggcgccggtgattaggtgaggggacgacgcgggccacaacgccagtacgtacgtcttcggcttcgatcagtcgcttcccgccgcgcgacgacgccacacggcgccagttaccagttggccgtttgggctttaggaaattaataattttatgattaagtttatttcgggcggtgtactgcttcctcttctcgcggccatcggctgctgaagtgctgatcatgtataagccccggcccgttgagaagttatgatgtacattgaatattctgggacggaaggaaaccgtggtactaaactcctcatcagtgacggaaattaaaccagcactactaaactttcggcactaccatccttaagcgtgtatataggaagacgcaaaacccctacttacttttcttcaagtccaatatacacattttgaaataattgatagaagttatcacggagcgaagatatgatatgaactcatggcgagtttacacggtgagtgcgcaaacttgtgacatgttcgcaatgttagcgcggagagaagtgaactatcgaagttagtggctcgtatatacgagaacttgaaattatcataaattttgacaatttgatcttttccgaaaactaattttacaaatgaaccgcggccaaaacttattttagaaataatcttttttatcagcaccaaatcgtatggcgctgaat

SEQ ID NO: 17865 - DNA, 11059 bp, Oryza sativa
cgttcagcgtcatacgatttggcgctgaacgttattttttaaataagttttggccgcgatttatttataaaattagtttttggaaagggtcaaattgtcaaaatttgtgtgaaattatccgaatcgaagttaacagcggttagtcacctacatcgatctagatagtcggtgttgatctacatgtgcatactgactacaactttgtctcgttggttaattagctatccatccgcaatggataagcaaaagagtacgcaaggaggaaagaagtgagaggggttattaatttcgtctgcatccggtccagctagggcaatctaagcatggagatcggccaggtgaaacaagcagccggagtacagcccgtccaccgctgctcaccggtgcccaaagggagacgggcgtttgcgatgaagcggcacatgtacgcaggattggggacccacgcccacgcttgcgacatcgtcgtgcgcaaccggttcggcgtgtggtcacggcgaaaccaaaagtacatcaggaagacgcggtatttcaagttcgtcgcgctcggttcggcgatgtccaaggtgagacggaagctccaggagtggatcaagcagcacggcttgttaacgtgggctcagtactcggcgcggcgggaggagttggaggccgctgaggcaggtctgcagaagcttttccaccgtcgcatgcccgctcggtttaggaagctgaagcggcgagtcgtgaaagagcgcgagtgggagcggcgtctcttgttgaagaagcaggcccacgcggcgcagggtgcacccataacacgcgccctattcgtgtatatgtcttcatgtctagttcaactgttttactatctgagaagacttatgcttggtagtgtcacgcccagaaatttccgaatagaatttcaagtaaaatgtgcattaaaatccccgtccaggaccggccggggtacacaaacgacaaagttgacatacagatccatgtcttacaaacattataaaagtcttacataaatgcagcggaaaataaaaagataactggagctaagccttgacttgcaccgcagcgggaacaccactccacaggcatcctcgacggcacggacgaagcctactcggagaagccaccatctgacgcatacttaaactttggggttttggggaaaatagagcaagattgagtactacccactgtactcagcaagtcataccggaataggggtatgatgcagggaattatcaagggatagctataatggttcatttgcataaagcggtcatttataaccagaagttgaaagtagtaaacagttgtaataattaatcaatattaatcatccactgtccaacgctataccacgttgcaacaggcccaaccatccacctatactattcaattccaaaagactagtctagggtgagtctaatcacggtgaatctggttgaccgcccataaccgcgggcacggctattcgaatagttttactccgatcagaggtgtacaactgtaccaacaagacacagccccacgacatgtttccatgcgccgacatgccaccacgacataccggaaagaggccgtgacaggacccttcgcataaccccctctaaccaagcacaccacacttcaggtttcacccccactcctcgcaaggcagcgggcagtcccctctcgtgcctaggcgaatccggaagccgcataggccgtcgcagggcccatccaaactccatcacgcccacccttgcctggatgcgtcggctagaggaaagctacactacaagcccagccgttgcccacgctggcttgtggtaagtacgaggaattcttccagggtttcccgcgaaccggtccttaattgccatgggcgcgaccatcaaaatcatgcacccacagcccaccatttaatatattttaattaagcaacaccagaacggtggcactaatccaatcattaacataaggacctacagtctatacattaatatgatttcccccattgtgtgctagttgaactaatcatggctaagcactccctagtccaatctctagtcatgttatatcccaagctaacaaaggaacatggtacaaaatagcatggctatgacagtaggtaaacattccacagtaatattataaaacaatgcagtatttgaagaaaaacaatagagcatttgcaatataggatcaacatgttcaagtgacaagcatgacttgccttgctctgctgctggaggaatctcgacgactatctcaaagtacaccggagcgtcgggagagccggaatctaagcgacatacaaagcaaataatacaaacaggctataagactactgaaacagagaacaaaaccatttttaatggattctacacatttttcttgatttactgagacttgaatggacttaaacggagctcggatgaattagttatgatttttagaagattctctgtgtttttactagtaaagaaaagtccttaatgaattattgcgcaataaagcatcccagggctgacgtcataggggggcaggcggcgccgacatgcgggccccacgggtcagcggctcgagagagagagggaggggcgccggcacgtgggccctactggcagtggcacaaggcgggagggggtgcggctggcaggcgggccctaccggtcgcggctccaaaaaggggggggtggcgagacgccggccgggcccgacatcaagccggccggcctgccatggcaagggcggcggagcgcgcgcgtcgccagcgacggcaaccggcggcggaagacggcggcgcgaaggcggcggcccgacccggctcggcgctaggagggagaggaaggggaaaagaggaggaggggcgcctcaccatgagttggccggcgcgggggaagacgacggcgaacggcgacggcgacgaccggggaaatgacggtgacggcggacgggctccgagacaccctaagagagaaaaagagacaggttagagggagagagggagtccatggcgagcgggaaccgtggccgacggcggcagctatggaaaggctcaccggcgcacggcggacggcggcctccgatggcggaattcgacggaggaggggtggacgaggtggagctcggccacgcgaacccgacggcggcgacggcgtggtgcggcggcgaccctagcggcggctagaggcggctggagcaatgaaaaaaaggcggcggcgggtgggagcacggtgcgggagcgatggggagcttgggagaggccgacggaaaaaaggaaaatgaggaggaggatgtggggatgaattatataggggcggagaggtcgggaacggccgggagtggctcgatttcgccggagttagtgggggaagttggaggtggggagagagagagaggcgggattcgaatttgaatcccgaccatctcgtgacgtgggcgcgagcgggagtgagggcgtggacgcggggaaggcggggcgtgtgggggtggggcgcggggaaggcggagaaggtgggcggcgcgcgcgtggcgtggctgtcgccggctcggggaggcggccggaggttggggaagggactgacaggtgggccccacctgtcagcgcccgagggagatagggggaggcggcctggacttcgggaggagaaggggaagcggaccggcccgatatgggaaggggcgcgggaggaggaggaaatgggccgacagcccatttggggaaaagaaggggaaaaaaggaaaaaggaaaagaatttccagggattaaatattgcttgtgctcaattttaattggttaaaattatttctagagctctgaaaattccactaaaaatcttgttagcgtatttcgacatgtagaactcaagaaaaattccacatgccaaatccgattattatttgcattaattcattagggttttctcttgcttttacaccgatattttctctggtggattataaattcaatttaggcttgggaaagaacttcagggtgtgacaggtagcttgtgaagttgtatttggataaagtgaagacaattaatgtgtgtatttttctatttcttggtatctccaaaaaaaattatatatggaatagtactacatgtaaaatctcatttacaactagaattgttactataagagaaactcttctttaagagaagctaatgttttttttttttccataagggactttctagaagtacagtttgttaaatgtatacaactacaatggtcgacgttccagttcgcatgcacacccagcagcccagaatgaattgaacccgtggtcggcggcggcgcatcccgccggcaagccaaaggggaaagtttcaccggagcaaacgcaagaccgattcgtcacgggctcgcggctagggcatcctctagggttcatgataccatttcaagcatcctcatggcatggcgcggcgcatctaggtggccaacggcgaattagcggcggaaccaggtgaacacgagtgtggggaaatatggcgagcaacaagacacagcggtaagctagctagctagtagcctttggaaggtgtatgagctagggaaaaaggattgggagactaccgagacgaagggcgcgtagtgaagaaatgccagcagagcggaagtaatcttccgacctcggcgcgaaccaattaaggtcggggtaagggaagacgacctcgccccagtcgccaggaacgcaccggcacctcgggcgagccacgcggtggacgagagcggagtggtggaagcgatcggcgagctctagggatggtgaaggagtggaagctaggagggagaaagagagccctggggcggctttcatagttcatagagctatcggtctggaggagaccgagccagcggtgtgtgccgagcttgttgtaaaagttagtcgatatagtggaacgacgactaaccttcccgatcgtttcagtcgttgatcgcccaagacatgccagatgacgacacaggaacacacgatatttgttaacgaggttcagccgaagcctacatccccggggctctgattatgggcgctcctccccaaccaacatagcacctagccgctacgagtccatggccacgccgccatcctctccctgcgtgtctacgctacattgtagtcgtcatggttacatcgtggtgcccccctctctatttaagagagttgccgggttacagagtccaactctaactccacccctaacacctattacaactccaagtccaactgtaaccaaataggactagtatattcgacacctattctaacaaactccaccttggaaaatatacgtcacctagaagtagtagaatcaccatgccgatccacctgtcctccagacttggattatttccttttgcagcttcaccacgagccgcccgacgagcgtacaccagactcaccgtcttcaagagactccactctccctgtaatttcttcctcttgactccacctgcaacagcgctccgccttctcatctatcatcacggtcgtcttgccaagcgaaattggattccttcctagttgtcccatcatagactccccaaagaccatgttcacctccacattccgtctttgatttgattcaatctaatccatggccagataaccaatgtcatcactaaatagacaaatcaaactcaccaggcatgaagaactgaaccctttcttccttgttgtcttatgaaccaagctaacaaatccaacatccacgcttcttgcatctgtagactgaatccatgatattttgagaaaattcaccgtcgcctcgaatcacttgaagaattaccatgatagccttcgctcttactccttcagtgacgcagatttccatatatcccatcatgccgacccgcatattctggatatatcctgtactgccaaacagtatcgttgaccccatcaacgatatttgacccgatgttgcccgggacttctcgcatagcaaaccacccgtttgccactgccgcaccggtccaaccaatctgctacacggccggtctacctccgtcctgcttctggttcggtccggccaacactctagcatactccttgttcctgagccatacctcgccaccttgctgagcaacctcgtcaccgtgagactatctctacagagttcccaaggagccttctcgccaagtcactattttgcgccgatttctgccaattttgtgccatatcgaatcttcccaagccagcttttaccattgcccaagaaagtcccagtcaaactgaattccaaacaaccgagtctgactctgatggacttatgcaatccgattgcacaacttgactctaatggccacagaaaaagatacaactcagccaccgtgtccgcctagacctctgttgcgttttcctcacgtccaacttcctctcagcaaatagcttgccacaccacgctcatacacaaattatgcacctgcttgcatctagcctcccatgcattagggcctttttctttccgcttaggatttattataatccagcttattagaagtaagctgaaagaaacaggaagattatttttacagcttattataatctagatgatgggttattgtaatctaataagctcaccaaagggagctttttctggattattagatggcaaaagacccactgcccctgattaattctaattatttacctgaattgccaccgcgtaccgcttcgtttctttttttcgttgaccgtgtgaccgcttcgtatcctgcgcgggagtcgcgagatcccctttcccctccactttctcttcttccaccgagaagatcggcaggcgagggggctgtgcgacggcatcggcctaggcgagcagagggcgtccggtgcgcggcagcagcgaactcgggggcatgctgcgtgcggcggcgaggtccatagcccattccgacggagatggatcctgcagatggtgaggactccctctcgaaagcatttcgataccgtgatgatgtggtgaataagcgatcccaatcaggaggcaaccatggcgtctctggcctacatggctccggcagcttctctgatggattttggggcgacggcgtcggcgaagatggacatataggcgatcttcatggctcacccggcgtccacggccaccatgtctcgcctgccccccatggcgccggcagttctggcggatcacccgtcttccatggagccggtgccgggcaccgcgacgccactgtgttccaagcggtggcagatgtgtctccccctggcagaggccgtggacggcgtggcgggcatggtggtggacctggacgtggtaagagatcggccacacaaccttccgcacgtggtggccgaggaaacaaggtgccatacaagccaccaaggccatccagcagtgcaactgttgtcggcgacgccgagggagcagctggtgtagacaatgacttcacagaagaaacaatggacagtgcgcctcatggaatggtacgtctacttcatttctctacttcaaaaattaaggtttaatgcatttatctactgcaaggattaggttgaatctaattgaatttaacgtgtatgtgtactacatatgaaaaattaatgtgtatgtgtctatgctaattggtcatgtatttaccatttctaatatagaaatacttgtgaatatataaacactagtggtgtaaaacaacatgtaaatctgaaccttgatgtgtttgatttatcaaatagaaggaggagcttgataaagcagattggtctagcacacacaataggatattttgtgaactatgcgtacaacaaattgaagacggcaataggcctatcgggataatgactactagatggtaccagatcatagccaaaaagtacttccaaaagacagggctaagacacaataagacacaactgaagaaccggtgggatgtgctgaaatccatgtacagcttttggcttggtctccttaacgacacagggcttggatgggatcatgcaaaaggaacagttgctgcacctgttgagtactggaaaaaagtcaccaaggtaataattcatgtctcatgtacatgattttcatgaaaatgttttaagtgcttgcaataattgaagatttgatgttttatttttagggacattctgaatggaagaagctacaacatggaccaccagaatgtttagaattgctggatgaaatgtttggtactattgctgttgatggttcttctgcttgtgcacctggagaaaatgctggaggggatgatgcaagtggtgatgtacaggaccttggcgacacaccagtagattgctcattgggtaaaaaaccagtgaagcgagggtcttccagcaccgccactagtccatacaagaaggttaagaaccccatggttaggataatgaggaatattcaaaccactatggataccaattgtgatattgccaacaaggtgatgcaaggtgaatttaggttcaattccattaaggaggtgatggatttggtggtggattgcggggcagcagaaggaagtgcggagcatttcatggctacaagattatttgtgaaagctgaacatcgtgatatgttcaagactcttaccaccaaggtgggaaggctctcttggttgcagagatggtgcgagaaggaagggcagcagtagaaaattgctaattatttatatgcatgaactagttatctctgtttttactttgtcagacaatatgtattagcaagattgctacttatttattcgcatgaacttatgtactgcctggccatgtaatatggcgccttaattttgattggatgaactactgtttagtgatccatcaacatggtctttctgtgactattgaggtgatatcatttgttgcattgtttgtagatgggcatgtatggaagtgatgatgacgatgaggaggaggatgaaactattattgttgctagcagacaactagatatgatgagaaaatttggaccggtgttgacatcatttggtatgttctacgctgaaaattatttgaacaagtccaagtatagaaaagctaatttagcgggtcatgcttgggttatgagaaaccttgaagttccacaagattgttatgacatgtttagaatgagtaggccactctttgagaggttacataatttgttggtctcatcttatggtctgaagtcaactagtaagatggattcagttgaagctttagaaatgtttttgtggaccattggggctccacaatcatttgttcaagttaagaaccgatttgagaggtcaaaaggaaaaattagtagaaaattcaatgaagtgttgcagagtatctatctcctttcaaaagatcttgtcaaacctagagacccaaacttcacaactattcacccaagactacttgatgatcggtttgagccccatttcaacaattgcataggtgcaatagatgggacacatataccagtagttgtgcccgcatcaaaggtggttcaacatgtgggtagaaataaatatccgacgcaaaatggcttggccatttgtgactttgacatgaggtttgcattaattgttgcggggtggcctggatcggcacatgatatgagggtgttcaatgatgctttgcgcaaatatgccgctatcttccctcatccaccacctggtaacttctcttatccgtttaatagtctcgtcgaactagcatcaattataaaataatgtctcatggtttatgtttatgctaacagggaaattttaccttgttgactcgggctatccaaatcgactaggatatctatctccatataaagggaccaaataccatttaccggaatttcgagagggtccacgtcctagtggcaagaaggaggtgttcaaccacttacattcatcgcttcgtaatgtgattgagcgctcttttggtgttttaaaaatgaaatggagaattctattggacttaccaagttatccaatgctcaagcaaacaaaaataatacatgcttgcatggcgctgcataattttattcgagatagcaaattgagtgatgaagagtttgatctgtgtgataatgatgaaaactacatgccgatgccttcatctcaagggaatgccagtcacatgggagacgaagatggggacgcaaatgccttccgtgatagtattgctgatgctttatttgctaggagataataatttggttttaagtctaatatatatgtggaagaaatattcatgaatgtataattataaatatttgtcaaatttttatttatctacatcaaatttatatctattgtataaagtcaccgaatgatgacaaaggcatccaaaaaaatagttgagggcattctagactttagccatgcaaactcaataatccaggtttccaataatctagagaaagaaacagctcacagcttattttcctctagcttataataatccagcttataataatctgactcaataagttggattataataatcctaagctgaaaaaaacagggccttaatctcagcactgtaacatgcagcttgtgcatatgcctgacgaccaccatgcactagccatcctatattttaatgcatgcagccatgatgattgtatacaaatcgtgccgcatgaaagtgtcttctccgatccatgcgatttgctcgactccgttcaagttgtacgcaaagaacagcatccgtactgttcgtctgtacctccgcacgcaccgcagtcgcagccctcgtgttcaccgtctacgaccccgtcatcatcggccatgcacgtccgccgcgccgcgccacgctcgccggcttcgcccttccatcactagcctccctgccgccgcggatccgcgatcgccgcgtgcgtcgggcgcgccgtccatggcgctacccctccgatctctccgaacgccttcggccacgcccggcctcgtcttccagtcacgctccgccatcgtcggtctgatcgcgagtgaggtcgtcgcctccgcaacgtcctcgttgtcgccatcgatctcatcgccatgactgacgatctcctgtcgatgcacgatcctcacctcgtgtttcctcctccacatgtcttctcgatccaatactgaaaccttctgctcgatgggt

SEQ ID NO: 17866 - DNA, 43966 bp, Oryza sativa
  unsure (1)..(43966): unsure at all n locations
aacccaaaagactagtctgatgggtgaggaccgcccccaccttttaagtcgtgctcccccaccatcaattaccgatgtgggactaaacccaacaatctcccccgtcacacatcgggcccaataatctcccccgtcacatcaacccatgtgaccccgaagacttcttacctggcctctccaccatgtgacccatggaaattattccgggtttcaaaccttgggctctgataccacatgttataaaatttagtcgatatagcggaacgacgactaaccttcccgatcgcttcagtcgttgatcacccaagacatgccagatgacgacacaggaacacacgatatttgttaacgaggttcagccgaagcctacatccccggggctctgattatggacgctcctccccaaccaacatagcacctagccgctacgagtccatggccacgccgccatcctctcactgcgtgtctacgctacattgtagtcgtcatggttacatcgtggtgcccccctctctatttaagatagttgccgggttacagagtccgactctaactccacccctaacacctattacaactccaagtccaactataaccaaataggactagtatattcgacacctattctaacagagctggcgtggtcaaggtggggcgagcgcgtcagagcggcgacgtcatcggcgtgcctgcctccgcgtctccccgagctagaggacaaggtagaggcaaggaggaaaaaggaaaagcgcgaggcgaaaaagcgaggcctccctctgcttgactgcttctggtggcgcgactggcaaggcggactgaccggcgtcgacgccttggacactagcggcggggccatggtgagacgccggctgtgacggtaaaggcaggcatggtagcttggcgcctggcggcgagcggaggcaaggcggcggccagagcggtgactcgcacgcgagggcgggaaacggcgaggttgcatggctggccgcgctggcgagcgagcgaggttgcctactctcctgcatgtgcgcggcagcacgtgatgagcagccgtggcgagtcgggctcgggcagaccggagcttcggcacgcgagcgtaagggagagggatctgctgggctgtcctgcttagataaagaagggagaaagcggcctgattggagaaataggcatgagagggatttatttggatgaagtttgagggtgatttgatttggatttgaaattggacgttacggagatttgattcaagtttgatatttgaatgtagggactactcaaggaagggaaacacggtgggactcaaatattttggagttgtaagattacttgaaacgaggattggatttgaatagttgaaaggatttactgatagacttaaggagggaggttcaaacaagcaaatttaaactccgagtctatttcgaaacggtaattttgaggagtcaattttggttttgaaggaaaggagataaatagagcactcagaatacgagattttcacggataggtatttcatcagttttgaacgccacgtaaaaaacggggcattacactagctataatctcaaaagaattgtaatttagtaacgtttggtttggctttaaatccactattcacaggatgagaatccagagctgaagctttgtcgtaaaggacagtaatcgtgccctctggtaggcagtgcacctatttgctcgaaaacttccgtaagtttttttttttccttcaaaactattagatttttaaccattggattacctcgagatttgcgcatgaaagaattttttttctagaaataattttttacacatatcacgcgtaagaacatgatgctaactaatcaaaccatacttgaatacaagttttatataagttactatatcgtagttaccatgtaattacagtacagttacaatgtaattgtgtctcaattatatactactattgttatatgtgaaagtttttcattaaaagaattgagacatttttttagatactcccgtaccaaagttactaccactatataaggaaacatgcaatttatcaaaattgtagtaaaaactttatattagactgaaatcgtcttatatccgtgtgcatgggccataactttactcagtttaaactagtttagcggccgtccatgaaatgggcctggatttagcctatataaaataggccgtacatgggccgataattggatctgaacgatactctgaatattaaattctcgcggagatgcgtcccgcccgcccgtgacgcgtacagccgtacacccattcctccacgctgtttgctccccgcgcgccacgaagtagagtactccatctcccaacgattaatgccaagtcaacaagcaacaattctttttgtcgaacaccagcaagcaacaaatcatccagtcagcccgaacacagataatgcagccgtcgcaacgatcccgccggccaccgaggttgagccgccgcaatgccatccggcagtcggcgtacgtggcccggccggcgtcacagctctcgccgccgtcggagtcggaccaacccgccttctggtattcgacggaggaatccgttctggaggaaagggttgtggaagatgaggtcggagatcatgcagaggcaggtggagccgaggcggccgcattggtggtggaggaggcgtcgacttcgagctcgtctgcggtctctgtccacgcggctatggtgatcaggaggagcatcttgaattggagtaagctggatcttatcggggccggatcgtccggcagggtgtacaaagcggtggctgagtaagtccgcttgcgatttaccgtttgccttgctcatgaactgttcgatgcaatgcttcattgtacttcgtgtctggttgtgtgttctattctttcagcagaccggcaatttcggatgagttatctctgtatttctcaatgcttcttcgtattattgccttgtcagggatgggtttgtatttgctgtcaaagaggcttcgttgattggtcccgaaagctatacgaagcaaaccgcatgtcagctaaagcaggtagttttatctcttatcaattaattaggtgaaaaattatcttgtaagtgtttaattaagcaaattgcaatttttgtcaggggtaaaatttcagagtattgatgttctccaattctaaatgattccaagtataagctaattcagtattagtaacaacatttcaggaaatcttgcttcttagtcggttggagcacaagaacatagtgcagtattttggtgccaaaatggtatgccagttctcatatgctagttgaacaagtgtcttcattatgttgctgatcgcctctgcaaactgttgcctcccaaacaccttcattttaggttatttttcttcggtttgagcttactatccctgtttggatttgcttgcagggagaaaccgtgctatgtattttccttgaatttgtgagtgaaggttctttggtatctgtatatgagaagcaacagctggaggaatcaactatatcatctttatacaagacagatcctcaatggattggcttatctgcatcatcataatgtaatgcataggtgataacacattatctccacaaaaaaattcttgctgctggcccggtcatttgaaaatgtacttgttatagtagtgatcaagttaagtacagatgtacaactctcgatcaaatgactaaatgagtgaagtacttctttgtcatattatggtaaatctgcactgtccttcccttttcaatgcagagatattaagtgtgcaaatattttggttgataaaaatggagcagtgaaggttggagattttggactggcaaaggaggttacttcatttttggtttcagtgtccttttttcccctggtttgactgacagattatgaaatgattttgtttgatattgacgatgtgaattctcaacccttttaattgatgtaatgccagataaaagtctggaagcagaaaagatcttgtaccggaagtgtatattggatggctccagaggtaattgtttgacttagtatttatacatagagttttgctcccatccagcaggtaccatcgggactgtccggtaccaaatctcagccatttaatcagcgaaatcggacggtggaaaataagtggtacctccaggtacaaatttgcccatgaggaggtgctaaaaaatttcgagtggtggaagggtaaatttgttttttcgcgtaggagtgtccagggaggcagtggcgagttgcttcgtgcttcgtcggcggcggcgagttgcttcgtcggtgacgacttgcttcgtgggaggaggcggcgtggcggcggctgatccgtttgaggctgcggcgtctgatccgtttgaggcggaggtggcggcgacggcggtggcggcaggtggttcgttgcggcgaggttgtgttgggcgcagtggtggcgggcgcggcagtggcctggtgctgctggtggcgggcgcggcggtggcctggtggtggccacggtcacgaggtagcggcggcggctggtgtgtgggcagccttggctgcgaggtggcgacgggcgcgatggtgccggccgtggtgatgaggtggtcgtcggagccggtgttgtggcggctgcagcgacgagatggtcatggagtcgtcttagcaggcgatgtggcagtgtatacatcgatttcttttcatccgatctaaatcattaggttcggttggttgcagcagtagatactttcattttctgggctgcatatactcttcttcttcattgcttataggatttgtattgtacgatttattggatgttttgatgagctcaaccattacttgttctttgtgaatgttcaaatggccaataccctcccatatcatttactgattactgcaattcgagtaagggcgtgaatgaagccgctggtgaaggagctcgctggttccgccgccgcggatggcagatgcggggcgagcaagcgagcgcacaggcgggggcatggatgcggggtgagcatgcgcgcggctcaggtgggcttcgcacgggtggggctgcgctcggagggaggaaaaaaaaggagattagatgagaaagcagcgccacacggagggaggaaacagagaaagagcgaaaaagagaaagcgagggtgcgactcctttctctgtttcccgatcgtacccttctaacatggacggatggatttatctctgtacctgccggtaccagtacctgccggtacaagttgctggatgggagcaaccctcttagacatattagtatgaagtatctagataaacgttactctgaagaatttattgcacttttactttacgatagtcgtccaactttccggaccagcagaatctatattggttatctgaatatctgatgatgatcaggttgttcgtggcaatccgtatgggtattctgctgatatttggagccttggatgcactgtcttggagatgcttacccaaagaattccttatcctgatgataactgggtcagtaaatcctacagtactcatttagacttcttacagtctcttcaaattcgatactgattcagttctatcaggtatcagtcttctaccaaattggccgtggtcaacttcctccagttccaggctccatatcaccggtgtcacgcgatttcatccacaaatgcttgcaggtgaatcctgatgatcggccttctgcagatgaactgctgaatcatcccttcgtggctgttccagaaccagactagtatgctgcatgtttgcttaacattgctaggcgaagaacattcagtagctccttgtttccttcctgtaagttcagggtcagaaagtcagaatgcttgtggttggaaattcatagtcctatggctaatttcacgagtacttgtttgtacgacatctgttccttataaaaatatcccactatccaactttgcgactttgaccattagttgggagagcaatcaaccaatcatgtattttatggttgagacttacgacgacttgctactccgcgtctgcatgtctgagtctgaagtctgaaccgacggcgctgacgttcccggtgacgaaaccaaacagccacacactctgaatcttacaagcaaagccaattccgcaattcccacgacttggtactcggagatagcggttggtcgtaacgggagcagttagccagttaccgatgacgtcgtctcgatcgacgctcgggtcgctctcggggtacggggagggtagtcggctccacgccgttataaaaggccctcatccgcaacgcgggtctctttccggcgtcgccttgtcactcgctcgccaccacccctcggcgccacggcgagcagcgcaccgggtccaggtcaaaagcgcacgcacccacatcgcacggccgcgtcgccgtcgtcgcgcgtgagccccccgtgcctagtcaaaccccaccacgagcagaatcccccaatcttctcgcgatccgctcgctctgctgctgcgccgcgggagcgcgggggaggaggaggaggaagagggaggggcactggccatggcggcgcgccagcggccgcaggcgcagctcgcgcggatcaacgccatgaggcactcctacaccgccgcgggggacgatggctccggggacgacgtgtgtggggagctcgacgacggcgggggcgagtacgcgtcgcagaccagcttccgcatccgcggggggcgcggggccgcggaggtcaccgccatcttccgcaagctggggctctccgggcccgaggacttcaccatcccgcccgcggtctacgccgccgccatgtcccacctctccagctccgcccgccgccgcgcgtcgctcgaggtggcttccccgccggagcttctagaagcttctccagccgaagccgcggttccgatgaatcgggaagcagtcgagaagggggaggaagctggtccggcccccaaattggttcaatcagaggttacagaagtttccacacgagcttatgcaaatgcaacgcctgcagcagaatcgagcatcagagtagtagctccatcggccaccaaatttgttcaagcagaagctatagaagtttccacacgatcatatgcaaggcctgcagcgagcgtcagatcagtagcttctaaacgagctctgctgaagcaggatagtgcagacgaggacaaggagaaaggtaaattggtcagattggataaatcacgagaggaaattagaggagaggtggttgtggaggcgacaagggagaccaccggtgcctcggctctggtcgtggaggcgacaagggagtccacttcacgtgacatcgagcatttgatttcaccctctcctcacaggcggtttaggagaaccatcacgtcctggcttaagggagagcatctcgggagtggatcgttcgggtcagtgtatgaggctatcagtgagtaagtatcgatctgcctactctgtcttgacgattgcataattcgttttcattatgtttgttgttaatatgtttgcatttgctactgttttatgagaggaatacaacgaagaaagaatatcaatggttttggactatgcagagaaatcagaatatgtcatctgtctagttcacttaattgttggtatatcagaatgagtattagcttcatgtgtccaccgaactgagatttcacaaattggctgcatccatttcaacttgttgggctatttattttatgccgggttgaatgaaatacttgaacatactgatgcaacatattatctgaatcatgcggctagctaaatttcttactcagtgcttttacacttcatttggcaaatttaattatttaggtgaacccttgtgtagttcttttgtagcactgcgtggattccatctaaaccactcttggaaaatataacttctgtcaacagttactatatagccgtgcctcgttttgttaataaaaagcttcataatcgacttttaacatttattttacagtgatggttttttcttcgctgtcaaggaggtgtcattgattgatcaagggatcaatgcaaaacaacgcattgtccaacttgagcatgtgagttaccctgtttcaaacattatgtttgttattgaactatttaatatccaagcaacaattgttttgtttcaatccactgagaatactggtgaatcatttggttccaggagatctctctgttgagtcgtttggagcatgaaaacattgttcagtattttggaacagacaaggtaatcctcctttcttatagatgttaattccattaagattacagttgtgaatgtattcttttcgtttgattttaatattatgttgcttttactctgctagttatcttcatgtaaacaacagttgtctgacttgagttgctgatttcgacgtttacgtttactttgttggataaacattttacaggaagatggaaaactgtatattttccttgaactagtaactcaaggctctttggcagctctatatcaaaaataccgtttacaggactcacaagtctcagcgtacacaaggcagattttgataggtttgaactatctacaccagcggaacgtgttacacaggtgcattactataatgctctatcaatgtgatagtgtactctagcttagatgtttttattgtttaggatttgctcaactgtattcttgctggcctattgataccccgttctttcctatgttaccagagatattaaatgtgcaaatatcctagtggattcaaatggattagttaaactggcagattttgggcttgcaaaagaggtatttgctctatcaaatatctgatgtaatcaatttgtcactagactacatgttgccctcactctttctaatttggcatgtcccagatgtcaattttgagtcaggcaagatctagcaagggaactgtttactggatggcccctgaggttagtctcacagttatgctttggtcctttttgtacaacccatttaccttacgctcctattcagaagagtgtaggtgctttaccattttatgttttaagcatatttctatgcctgatctattatgttcatattgttcacctctttatacttgtaagatgttgcatggacacataattgtatctctgtggtcaaaaagtcacggtcttgcaagttcaagcaatattttgcataaagtggtatgtgtctccatattgtaccgagcgtgtaaattttctgatagcatgttctcattcaggttgctaaggctaagcctcatggacctccagcagatatatggagtcttggctgcacagttttagaaatgctgactggcaaagttccataccctgatatggaatgggtgagtatatctcttgtcttactttccagtaacagcatcccatttttaaataccaaatgcactgatatacgcgggctgcacgctatttaattaaaggagcaaaaacattgatgacaacttcttcatgttgatgacttgtttgcttacatcagtacgtatgaagtatatctttttgggaaaatcaaacattagtttcatcaggaaaatttgggtagtattggatttaaaaatgtcagtaggaaaattaaacatttctattcagaactgcaaacagcaaatccactgtatgttgctgtgttaattttcttattatccgggaatttgtattattactgtccgtgatgcagtcttttcttctgctatgtagacgcatgctttgcttaaaattggtagaggaataccaccagaaattccagctacactgtcagaagatgctcgtgatttcataattaagtgtgtaaaagtaaatccaaatgatcggccatctgctgctcagctgttggaccatccatttgtccagagatcactgcaacataaaggcgcctaatcactcttgtgttgctaacaaacttgcttgtacataagctggtcagtattccattctttctcatacaaaaatttcaagaaatagggcgctatgactatgatcctgtattgcaaacattaatggatttctctctgttgcatttcatagattttaattttacctgtggaaacaggaaagctgttgatgctgaggatgatcccaaatcccttgccatgatacagcggtagtttgtaggaagtcgagcttacagcatgtgcaagctatattcaactgaagatacctttcaggctgctggatcatgtgaacagaagataccttgtcaggtgtttactccgtgccttcacaaccatcagggtgaacagttggttgtccaaagtttttagtgctgattgtcagggattatgagttccagtgcgaaccatcgaactacgtttcatgacttggataaaaactgggaaaggttcaaaaggaggattagtggtatctcgcctagtggcctatggaagcagccaagcaggggacgtagaaagctcagtgctcacggcacagttaacttttctgaccgcgtttctgtacagcgtttttgtacctgtaaagtggcttccttgtgtatgtcattgactgttgacgagaaaatccaatttgttttatagccataccgtgaaattgtccagaaaaatcagtgtgttttgcgataattcaattcatgttggacttcactcctgtgactacacagatgagggggaatcatagtggcaggacagctaaatgtactgaactactgatatacaacagttctctaatctaacgtcggctatcttttgacttcagaatatcagtcttctgcattctccagtctccagggtctgaattcatcccccatccaagcaatcgattacatggtcataatcatgccctgccatctcatgcatgagcaacccaagcatctgagatatctcctccgcctgtggatgcgaccgatcgccggagacgaactcgtgcacgtcgccgtcgatctccacggcgctgtagcccggcctcttcctcagcccccgcgccttcatcaggctccggaccttcccggcgccgtcccacttgccgacggcggcgtagatgttcgacagcagcacgtagttggcgtcgccgccggggtccagctcgagcaggtgctgcatcagctgctcggccatgccgacgtccccgtgcatccggcagccggcgaggagggcgccgagcaccacctcgtttggccgcatcggcatggtggtcaccacccgcatcgcctcctcgagctgccccgaccggccgagcaggtcgaccacgcagccgtagtgctccatccgcgccgcgatgccgtactccgccctcatcaggtcgtagtatcttagcccctcgtcggtgaggccgccgtggctgcacgccgtgagcacgccggtgaacgtcacggcgtccggcttgaacccctccctccgcatcgcctcgaagtgctcgacggcgtccgcgcaccggccgttggcggcgaacccaacgatcatcgagttccaggagaccaccgtccgcttcctcattccgctgaacacctgccgcgcgagctccacctgcccgcaccgcgcgtacatgtcgatgagcgagttggctatcctgacgttgcgctccagcccctgccggaccacgagccggtgcacccacatcccgagccccagcgcgccgacctcggcgcacgcggagatgacggctatcagcgtgacgtagtccggctcgacaccgtccagaagcatggcgcggaagcagtcgatggcctcgtcgtggcgcccgttcttgacgcacccgtcgatgagagccgtccaggagaccttatccggcgccggcattccgtcgaacacctcgaacgcggcggcgacgaggccgttccgcatgaggccggagatcaccgtgttgtaggtgacggcggacctcacgggcatggcgtcgaacagctggagggcgaggtggggcaagcgggacgcgaagtagaagcgcacgaggcaggtggagaggaggaggtgggaggggaagagcttgagcacgcgggcgtggacggagagcgcgaggcggcgggcgagcggggaggacggggagtcggcgcaggcggagaggacggtgagaagggtgacgtcgttggggacgggcgccgcgggggaggagagcatggcggagagcgcagcggccgccgcggggaggtcgccctgcttcgccgggcgcgcgatggcggacgtccatgaggcgacgtctcgcggcggccggcggcgaggtttaggggttgggttctgaggaggttggggaagggcaagggaaggaggggctacgacggccatgaggtaaggtctatggctgagggctgaggcatttccccgcgggcacgttggcacggagcctttgctctcccctggtttcttcaggttttcttcagaattcatccccttttatcctggtttcattagcatcccaatgatatgttggcgatacaattcacaacatatatagatcctgttcatttctccaacaagagttggataaagataaagattttcatggcacggtttttaaactgataaacagtatgtgtcatgcgaaaactttctatatgaaagttgctctgaaatatcatattgatctatttttcaagtttgtaataattaaaacttaaccaatcatacgttagtatcacctcgttttacgtaaaaaaacttaaatcttcatctacacctttatcttctaactatgcctgaataaacacaacagtctggttttcagttgaagactataaggtacgacgtgcatatggagccacaaaatgaaaatatgcagaaaagagaaagcaacatactgccaatacgagggggcaagccatatgcatcaaaaccacaaaaggaggcaaatcaaagtctaaatgatatttttgaacttccttaacgaaaagaaattacatacagcacaagaagcatcttgcactagataattgcgcacagctgaacataattctgcagtccagttcttcagtaaatctagtgaaagtcagatacagaagaaagttgcttaagggaggtgtatggctggagggcagattcattggaccatcggatcagggttcccagctgcaagtatgtccagcaacgagttctggggctccagctcttcatgccacagttgtagtttgtctccagggtgaaatttcctcgaaacaccatctgcgtttatctgcaagattatcatatccataagttcaagaatcattggtctttcagaaaagtaatagcattttaagcaaagataacaagacatgcctcaacttaaaatttactttgccacatgctacacattttcagaaaaaggaagagctacaagaaaatgcaatcaaagcaaatagatgcccaacaaggacataagaaaatttgttactaatgcttccaatcatccaatgtcttgtctacaataccctaacacattttagtaaaagagtaaaacaggtctgaatgaagtataagggatatatcacactgaaatattatccatttttggcaagaaaaccagtccatggaagttaaaaaaggccaactttttcattttaagtttcatctgatactatattctatggccatcacagcaaacagcatgacaaatatagcatagaaatttacatgtttgtatgaagtcaactaaagcaatcagttccggtatctgatgtttcaaaatatctacaacaagggaacagacaatgacaataaggacgaaaaaagggagcacttacagtgacggtacgaacaacccctccactagcaccatcacgggctatagcaagggaaactaccttaaccacaaacttctgtaaagatgaagaggaaaattaagtaataagagatgtgatgcagccagcaatattatacagggaacactgaagtgatggaaaatgatctttgcactctatgaatctggacatataaataatttgtgatattttcattaaatcatggcaaaaatgctgacaaactatctcttattactcatggattacgactgtttgatatttagatgatgtacctcagcttcttcctgggacatgccctccttccattcgtggtcaagcaatccatagaggtaactagagcctgaacctgcaaaactcagaaatagcatctggtgtcaggcaaacagcaaacaggggcttgggaaaattttatagtcaatgattataacagggcagggttgcacaggacagtgttggtaaacaaaaaagaatgaggcaagctaattcaagacatcaacaaataaagaaagaaatgaatcttgctaactgcaaaagattgcttctgctttgcttgaaaaaattaaactgctcaggtaagtttgaaaaaaaatatctcataactaattggcttatactattgaactgacaaattattcttgtacgatatgtagatatgttatatatagacacaaatgttggtgggaaatatgtttcccattagattactctgagcccaatgaagagacatttgccataatatatatacctccgattgcaaatggttgcctcagaattgttccaccaagggggactgagaaaatttggcctccctcatatttatcccatccaccaacaatcatgccagcttgcaacatgttctgaaaaataaaaaaaatggtaaaaaaaaaaccattgcgacaataaaacaacaacttaaaatcgtgtatcagagaaaccattgcgacaataaaacaataacttaaaaaatcgtgtatcagagaaagaatttcatctcatgtagtcatggagttattggatcgcagaatgctatagaaaatataccttgttctgataagccaacaacctaattaagttggctgcaactttcacggtagctggctgcccaagctgaattctgaaaatggagggaaaatttagcatgaactgtcttgcacatcaaatgtttccagtaactagtagaacaatatatatgaagagttcattcaacttcttcctattcgcttcaaggggacaacttacgtgtgttggtggagaaaatagcgtacataatcggaaattacttgtgtatcagcagcctgtgagacagagagaaacaaatatttacatgtgaatactactggactcttggaaatgccttagctgataataattagaagccgactactaacaactacagaataaatgaatcaaagtaaaatattgacaatgagagtgtaacttatgagagggcaatgaatgactgggaaaaccgatcaagatgacatgacacagtataacaaaagaacatatataacttgatgaataggaagctcgtgatttcccaatatcttatggccacagtacaatgagacaacatgaaaaaggagtaaagtccctaatatagatacttacagatccagagcggcagatgtacacattgtcagttagctgagtaatcttgtccgacgcacggtttgccacatacattcctaagaattaataccagacaacaaagggtatattaaaggaaagtaacaaaaaccaacatagtacgtcaacataacatcgatttcagttggttcagaacatgcacatctaagataacaagtcagaacatcaaaatcatctaagaaagcttgttaatcatgtagacacgagacccaatgttctaaatttccaaaacagcaacatcacgctaaacaccaatcgtgtacacttttctgactcttcactcttcagggccaaacgagaactatatggacagaaaaatacaactggaacaattggtgttgtttctagtttcctctaatgctacagtcacgattttttcacatatctgccatacaagttttagcacgcattctactcgtcacatacagatttaagcaggataaattagtggtaagaagcaattttccatcaacactacattacgtgatccactgtggacgctatatatatattacaactaataatctcataagtcacaaacctaaaacagtaaaacttgaatcaggatcgcagaggctaacaatcactactcctattccccccatcccccgcgattttgcatcaaaattgggcccgcgacgccaccggctccacgttaaaccccaaccacatcaatggaagagatctcccgcatcgggaggtgtcgaggcataccggtgctggttctggaatcggcggcgaggacgacgccgccgtcgtagcagacgccgacgatggtggtccccatccggtgctccccggaggtgggattgtctcccgctgcggcggagggggcgcccatgagagaggcgtccatggctggccgggggcgggggcgagatcggcggtggcggaaaaccctagcttagctgcgcggcggcgagatgcgagtcgaggcgctcctttcagtcgcgcgagcgagaagagaccagacggcgagagagctgtgtatgttacggttttgggctctggtctggcctcccccgcaagaaagaacacgaaacggagacgagacgaggacgtgactgggtcggagttgtcgcgtgctggtgcggttcgacccgatggcaccacgagccggtgcaaccacataccgacttcccgagcccgaccgaggtcgggtcggagatgacgtcagcttgacgtagtccgcatcgacgatatcccacagcataactcagattcaacactacttacttccaaaaaaaataatttacatagtatatgatgtaacatatactacgaatcttaacaacttgtattccctccattctaaaatataagaacttatttgatatgtagggaaaaacaacaattttagaggattttaatcatataagaatatttcatatggatgcctttgaaataaaggattgaattcctatcattttaaaattcctatgaaatggacaatcctatatagattttgaaggaaacttgaaaagagctctaatctattgaagattttcccttgagcctatccctctcatctgactcatatgttttcatgcattttgcaatcctttattttgtagttgaattcatttttgttttttccatgcctgcgatccaaagagtccctaaaggattttgatcgaatgggacacatctaacactataaatttggttagaacatcctagttctactaattttgatagaacatcttagcactacgaaattggacaaagctattcataataatatgatgtgtcccatctaactaaaatcacttatattttgggatatagaaagtatattacatctcatattatgttaacttattttgggatgaagggagcagagaaaaaaaaagttgcaatgtactctacaaaaacagcattggaggaaactgcaagcactaaacagatatcacaaccaccttactgtaaacaactgaggaggaaagcaatacacagaaatcaaatgcattgattaaaatcgatatacatatttcaccggttgatccatacagcaaaactggaaaaaataactcttcaatttagtatttacaaaccaagactctgtacatcacctgctgaatgttttacagccatttacatgtacatacatcagacgacccatactgtacattggcaagaaaatacgaaattaataaatcgaacatgttggcattacaatttacaactttacatagaccgatcaactatgcctgaataagtacaccaatctggttgtcagttgaagtcttgaagccgcagagaaaactcaaatatgcagaaaagaataactaacatacccccaatatgaaggacaagccccatatgcatcagagccacaaaaaagaggcaattaaagtataaacgatattctttttgaacttccttgatgaaaagaaattacatatcggaaatgaagcatcttgcacttgataatggtgcgcaaatgaacacaaccaaaaacctgcttggctgcttcatctgacgtttcaacaatcaagttctgctcatgccaacaacctacaaagctgagcaacctaagaaaaacacagcccttcttacaacagtcaaatctgatccatatctgacaacaacgttggaagtgttattgtccaacctgaaaacatatcaaggcttttctgtcgtgctggtagacagatccaatctctcaaacctcagtattaattctaatgaatttggacttcatatattctaccacaagctcattccagtctgacagggaagcaaatggcagcaaaccagccaagcatgggagaataaccgacaggacagtataaaatgtgtatcggcaaacccgatatggtaaatcagacgccttcgttctgtcagtcactgaaataggaccataaagcatgcggtataaaagagatggcctgctgttcccaaataaatggatgaagcagagaatctcccagaaaaagagccagacatttccatccccgcctagtgtgtcaacgcagaaccttccgacagaaccacagagaactcccaataacataacattgaacgttattggcatgtttggtccagtcattgcagaacgctggaatatcaaccaagcaatcaagagaatcattaacatgccaaatgacatccttgttgctgctattaaatgacacctgaaaaacagcaaacccgaattgaaagctgatactgaatttggcatccaccaagatttaggttcctgccaaaaaaaaagtgggttaaagagattagttcatagcacaaatatttactagcagttagtagcgaaaaatgatgggacatacccttgaagccgctgcacaagctgcagtaacagcagttatccgcttgtacgaataaatataggttccataaccaaaacagacagacataaataccactgcggtaaggagcaaatctataagcctcctgaggagttcagcatgtcttgtgtcctccatttgcgtcctaaatttttcctctctgaaagaagctttctgaaatcccatagaaattttgatcttctctagcatgtgtgagtatgagctgagagctatctgagattgcttcaattgcaatttcctcatgtttagtcctatttcaagttccttgagctcatttgaacgagtctgctcattcagagatctctcaaatacattaagaatgtgcctatcaaattctggactagctttattatgaggtagtttaaccaactgctgatcggtgcccgcatgaagaatgatttgattatccattgaacttaacgatgtactctcctggatatcatgtaccggcctttttgaatcagcaccactcaatttgatttcagcagcagaagtaccatcttcgtgagaaaaccgagagttatcttgctcatagacaggtgtctcattaattaaatgaagtgtcctcaatgtacttccaaatgatttctcaaagtttttcgtgaagttgtcgaatctatcaccatatatctgcagaataacgtaagtcagatatgtaaaaaaacctgtctaagtgtaatcacagacaaggaaatgaaccattcatacatttgtcaaggactctttcactgctgacgtgcacatctgcatcaagattcagagttagcatacctgaagttctgttatagtccatggccatcatttgtagaaaggctaattacatgaactgtgtacctttgaaaggaaatcaggttgtaatcttccttcagagcaactgcttctattaaggacctgaaacaggataaggtcagttcttgttaattacgagtaagaaaaggttaaaccatacaagctgaatccatgcttcagaaccacagttctctactggagagcccaagaaattcatttgattcatttttgtaaataaacaacttcattttaatttggcttggatgtatttcatcatcctaatggcgagacgatcatccagagaacagaaggattacatatctgagcctacgcttcaaaacacacgcttctgttcattagtgccgtcccatgtaaatttgcttaattcaatttggttatataaacgactttagttgaatttagatgcaatgtgaaaagacgcccaaaatgagttccggagcaaaagaatatctctacttctccatcctaaattcataatccaatgaccgtcccagcaaggcaagaattgggtgaaccacatgaggagggtaaaaaccgaacctttccgccgcgactaaacaagaaaccagtcaagaatcgaagcgaacgcgcacctgggcaagaaccgccgcgaaggacatcccgagaggcagcgcgaggtcctgcgcgccgtcggcggcgcccctcccatcccctccagtcgcaagcagcggtctccggagcctctgccgccgccgccgcaggcgcacccccttctgcagccgggacgcggagccgtacgacgacgccgacgaggacgccccgccggactccggcgagccaccgccgtcgcagcaggccccgtccataataagggagcgtggcggcgaggcagaggcggtagggtttagttgccgcgccgcaatttcttcgcctcgaccggtgcgcgacccgctctccggtgggcttctcataacgggggagagagagagtctaggaaaggcaagtcaaaatgggaacgcgacgcggaacggcttcggggtcgcgtcgcgtcacggtgcggtttacgttagccgttaagcaaactcggaaattctgagcaaactttgtgccgttttgtgcgtgtatattaggcttttggcctggtttccattaaggaaaaatgttgtaaggaaggaaagcagtgttaaattattataggaatattatttaaactactggtgttgtagtatccacgaagtttaccgtgtcatttgaaatttctaagaaggtttcacaaactttttccgaaatatttgcccgtcaaaaaacatgcactgaaagatcaaaaaactttcttcaagttttcgagagaagttggtcagtagctttgggccctgcactgccactcggtctttgcaggccggtgcacatcaagattgggctggatactccgctatcaacgggttccgcacccacaaggcccgttacgctgctgattttgcttgcgcgcgaaccggattcgatggcacgaaatctcgttcaatcctcccttgattaacctgacgattaccttaacatatctgccacttatttataaccacctcatcccataatcccatcctcatccaagagaagatagatatccatcaatcaaataaccatggatgatgcggcgggtagaccaccgcgcccggcggcgaggtgcccacaggctggccggcggccgacctgccgccgatcaccaaccgcgacggcctcattgtatcccgatccagctgaagcggcggcggacgtggctgatgattgctcggtctcccgccgcacatcatggccgacgaggaggccatcgaggatgtcgatcatgaagacgttcgccgggctggtccgcatcatatcgaccggtggctcgacctgacggatgggaagacgacgcacgcggctcgtctgcgaggtggacgtacgtcgtcgccgaaccatgcgaggtgccgcgcgtcctcgcgctccacctcgtgcccaagtggctcgtcaccgtcgtgctgcggagacgcgacgacgacgcctccgatgacggctgtgacggcgagtcggctaaggccttgttcggcacgcatgtttccaatccaggccaggaattgatcaaggccaggtttcagtggatccgggtggattcactggaaccacctgtggattgaatccattccttttttcaatccacctcttcaaaaatctgtgttcggtttgacctggaatggaatgaagccattcaagctgccgtggattgtcgatcgatcagatccagtgattcagaactcaaaacattcagttaatgtcatcactcattagaattcagaatcatgcacatttctaatttctaacagtaatagtatattgcaggagttaattaaccaaaattcccaaatagaaagacagggaacaccctgaatagcatcaggacaattcttcaccatattcagttgctgtcatcattcatcagaattcagaacatcatgcatatttctatctagttaagcatgaacagtaatatatttcaggattaagcacattcttttcaggactatatcactaatcaatctggcttcgccttcctccggtccctctggtagcaatccatcggcatttgggaatatcaattgattatccgctgcagccatagcaaagaaatcttgcggttaagacttagacagtgtgatatagaagcagtacaactcttgcaagtaaaaacagagcaagtaaaaatacaatagagctgttgaacttcacacttattatccattttacaagtttgtttgcatgcattcaaacaaacttgggggatctgcatttgtgttatcatcataaaagggctatcctatgtggacacaacatttgatatcttcagattcgaaaaaaccaaacttgtcggcttatataataagtagatatgtgaagtctaatacaacataatatcaagtaaattcaaaagaaaatttggtaatgaacagagaatttccatttattcacatgtttgagttttttaattagcctaaactacccagagcttagaaagaaaatggtcctattccaggacttagatgtaattgaaaaatatgagcctatttgttgttgtcatttattacagactacataagaggcaatttagctgaaaaaaatgttaagatactgcactgtagttgccagaatgaggcagccaaaaaagaggcaacaaaatcatcttcctactgcagttcaatttatatttcagcatcgatgcgcaaagctttcttctccaaataaagcagaaaaatatgcttgttaatgatgtttgctgataacaggggctggtttgttaatggatcactagcaggattgcagtttccaccaccctcaacaatagttgtcagtaatgccaggccttcatgtctgttgaaaacgcctgaagcttcctgcaaattctggttatgaggtgcaaattgtcatgcatgatgatcctcagagaaagaggatggccccatcggaacaaggacaatctacaatgatatatgcagagaaagggagaagggaccaaagcatctgatggaaaatggctaagatttaatgaatcataaacagaaagatggaaatagaaaaggtttataattagcatagtagtttgttgaggcagccagtgctggctaaaattaagtatccaagctaaaaagcagctaatccatgaggacatgtggttatcaaaatctgaataatgaacagaaatgccatcaagaactgacaaaaactggttatcaaaggatcttttcttatgcaacactgaatttaataacaatcttgacttagcctggcttgggtgagtacaaaaacagagatggagcaccagtccagttacagtgacatgtttttttttcagcataatttcctggttcattcgagaagaagacaaactgaaagggaagctggttgacagatccatggctatgcaacacatcgatccttcagccaagatctagggcaagaaacagaaccaagaacctagggctcttccaccaagaatcccccgcaacactgcaagaacctaaaccacagaccaaatctccaagaacccatcacgattcccccatccccaccccctacgcggatcggaatccccaacaaacaccagcccttggaaagccctcatttgggcggaagaagagcagcagcagcacaagaaccctagcaagcaaaaaccaaggaggcggcggtggcgtgctacagcggcaggggaggaggcggtggccaagaaccctagcaagcaacaaccctagcgccggggagagaaaggaacaaggaagacgacggtgatgcgttactggcgagaaggcggcggagagcgtggacgtcggatgggaagcgggtcgtcgtcgccgtcgcctctcgcgtcgccagccgcatgccgtcgcctcttcgcttctcctctcgcgtcgcctcgcgtccggattggaaccggagggtcagaggtggggaatggatccgggccaggaacagggggaggcaggccaaaccgggcccgtttccaatccgggccggccgaaacgaacgacgcttccgggccagaccagatttggaaacgggccgcttcgttccggccggaactgaggccgttccgggccgttcctggcgctgccgaacgaggcctaagatggagatgctgccgtggttggatcgtctggccgtccaatgcagccacgattttttttatggcggtgagaataaaaccatccgttgttcttggtgattatggaaattaaccggaacaggttctgataactctccgcgaggagagcgccgcggcgtcggtagcgggcggcacggcgagttcccgtggcgatcgacgaaatgggccggaacggtaatgcggcctacgtgcggaaatattggtcggaactggattcccacgtcgcgaatgttgggctgatatcgcgctatggacagaccacaaactaccagcccagtaacgacgatctgggcctgagccagattcccgtgaactgtgccgatatgttgggccggcctcagcaattgtgggctgaccaatttgtgggttccagctccacatgtcctggagctgaaccaaccaaacatttgtagctctagctaaaacaagagcggagctcgcgaagctcggtggagcatttttataaaatgaactagagaggcaaagttaggtttagactactcaacaattacactccagattcaactcctggatccattgtaactggcttttttttcaaaatcaaaaatcagaccaagcgaaaaattaagagacctaaagtgaacttattccacccagatggtgctctggaatgggataccgacgccgcgtcgccttcagttgtccacggtctagctattttttttttcaaaatcgaaaatcagaccaagcgaaaaattaagagacctaaagtgaacttattccacctagatggtggtctggaatgggataccgacgccgcgtcgccttcggttgtccacggtctagctactacaaaatcaaggccaaaatgcagtcttctgcttctttttttagaagggtattttttacccggcctctatatccaaccgaatatatgcatccattgaaatagggaatttagttctgcaaacaataaattcgctccatagaaaatttgaactcagaaccttggggtactactcaggtcactgtagccactaggctatatgcaatcttctgcttaattattattgtcaaaatcaagggtcattttccgcttagataatccgcacgacttcaatgttcgatcgtatcagcatggaatttgtttcaccattcaccaaatatgaaatcagccctaggcctatatatctagggcactattacttcactttatagagccttgatgcttgtcgcttcagccacagcggacagcgtccgtccgtgcgtgcgtgcgtgcacggtctccgtgacgccgaaacaactggccaacaacaacgatctgtgggtgcagtttactgtagtgccaaacttctctctcttcgtgtcctaggatttgtttggatgagcttaagttttgagaagttgtccttggtagttaacttatgagattcttgagaagctgaatttctcggtttctgacttttatttattttattttggaatctgaataaaaagctaaactatttataaaagttttaattcttggagctcgatcatacatcccctccgtcccaaaaaaaaactcaacctaatataatgaatatagacatactagattatgtcacatttcaatcctagattgttttttttcagatttattgtactagattatattagtattatattatagttctatgttaagtttctttggaatagagggagtatgtcacagctgtcacctatcccagagcccgaaatgtttgacatattccctcgtctggtgctttctggtaggctatcacatgatcatctctaccagtcagttcttgccgctcgacctgattggtcacctaagccattaggtccacgacgatctctcaccttgcacacgccatggctactgtggtaacagtgttataaatggagtgcacgcaataggtgaaactaccctatgggtagctgctgctagtagctttgagagcgtgcaacttgtcacgtccagctagagcgagtcactgactcgtgggcccggacaccgtgcgtttattagatggcgaattgtttaattagaggctaatttggcctcgacctgggacggggttgataggctaaacaagggtcaaaccgacccctatcccgactcgtacttggcccaaattaaacctgtgtgcatcgatcggaccgagccggtttaccccagcacgaatcgtgatgtatcgctgatcacttggtgactcggaaaccgagagccctaggtagctactaatccatttgcacaaatttaaatactacctccgtctcaaaataagtgcagccatggatatccgtgcccaacgtttgaccgtccgtcttatttgaaaaatttgcgaaaaatttaaaaaaatttagtcacacataaagtagtatttatgttttatcatctaatagcaataaaaatactaataataaaaaaatttcaaataaaacgaacattcaacctcaaacgttaaacgtgaatagtacaaaactgcacttgggacggggggtataacgtaccgaattgaacccgatccaaatctgcactcaaacccatggcataactaaccacaacgtcgtcataaatggatcacaagggagcaaaaaccacttgtgaataaatttttactaatcccagaaaggtaaactctaatgatctgcaacatggccaatcagatcgtttcaaatatcatggccaatcaggggccgtacacgttcatgcgaaggatcgatgcagcttgcagagtagctagcagtagaacttctggtagatttgcacgtgattggtcgttccgatccattttgctttgggctacgacgactatgagcagagttcaagttgaaccttgttttgtttacatgcaacggttgccgtgctaattaagcagtttattaccaagggagttagttactactggtcttgtactattggagtacaatattttgttgaaggcatgtgggaagagaattaattttattcgggaagtgaatattaaactcttaagaacatatcctcatgttgtctatataccatctaaatatttatgaaaaaaattaaaaagataaattaatatgtgatatattactccgtaaatatacaagctataattcaactctcacaagttacaacaaaaataactaatcaaactaatgtatattcacaattaaatttgtattttttaacttataaaagttgaatctatcattgcacatgtttgtggagtaatctatcacatattaatccatcttattgatcttctaaaaatatttcataactatttaaatgaaattctaacaacgagatgacgtccctcgagatagtttagaattatcttttatctattcgcgatcgaactcactgataatagggagcaaattctcttacgtgtaagatcgaatcacaagaactaagccaaccagagggggggtgaatggttgatataccccaaaacccaaacttttagcgcaaataaaagttaccctcaaattcgatgtaaaccggtctgaccgaggttgatccgccggtctgaccgagctcgtgccaccggtctgaccggtgttgatccgccggtccaaccgcctgaagattgcctgccgcgtgtgaagtcgccgccggtctgaccgccgcctgccaccggtctgaccgccggtatgtcgttggttagaccgccgaaacccgatgaaacacaaatcgaagaactctcaaaatagatgacaactttattacttctctctgtgtttacaaagtgcaccaacatcactccttacaaaaatcttgactaaactcgaaaccctaactaaactagcaactcaatagctctcaaaagcgataccgggaagcctcacgctccccctctatttatacatgatgtaggcagcctaaagccacgaaccaaactcatactaagagtcctaaacaccttaggaaaccctctagtacaagacacaaactttacataaccaactgtaccaaatttggactccttccaaattcgacttcgcatcccatacgcacactatacctccatcgtatgccatatggaatcttcaccaaccacgtgcatcaactctagccttagtatcccgcatgatatctgaccaccacggacatcgtcttaccatcaagccgactcccagtccatcaccgcaaatactcttccgaggcatcgagtcacctacacacgaaataaacaaagaaaccatattccgataccaagctatccccaacttgactcattgttagcaaacaacagtattacatacgtatagtatccatctagaagccataaccatgaaacaatcacggatatccaaagaaacaacccaaaaccgaaaccgacacaacatcggccggtcagaccgcgggccggccggtctgaccgctcgatcaccaccggtctgaccggcatacaccacccggtcggaccggtaagataaaataacagtgaatctgatcatcacctgaaaattgattatctccaaaaccacttcgacgataatctccaaatatcaaaaccaataatcacagatacctattgttcatcacagaataagaatcaaaacacactttgatcttacaatctcccccttgatgaacacattggcaaacctcataaaaaaatgttttggtgtttggaaaaataaaaacaaaagtggtaaaaaacacacttcgtacaaatgtacacatcgtgctcaaaaatccaaaagaaaacttctccccctttttaaaagaaagaaattctcaattatacacactgtgctcaaaaatccaaaagaaagaaattcccccaattgaaccaaaaacatgctcttctcaacaactctcaaaattcaccttgcttctccaaaaatccaccttgcttctcaaaaaatccaaaaattttcacattacttctcccccttttgacaatgatttcatcaagcataggaattatgttcattaatgttcaagagcttagtatacatatagcatatcaagtcatgtattgcaataaaaagaagatgaacccatctataacagaacaagcatgcattaaagtataaccatgaaccaaagattttacaattaagcttgaatcaacaatcaaaattcatgatttcatatgatttataatgcaacatttttacaagcacataggttgaagaataaacactaaacacatatacctattgcatttatcactctttctcaaataacctttagcacaaaacaaccaagagaatttttaactttttctttttcttgagcatttttgctcatatttttctctttttattccgggtacgtccctgtcatcaagactgtttctagggattcggcacccattattttgctcacatcgaatacgtccttgtcgtcaagactgtttccaaggattcggtatttatttttttctcatatttttattctgtttttcacaatgagcaattaaagctatttgaggaataacaagtcaataaagcatatatataaagcatttataaatcaaaccatatgctagcatcaacattgcatatttgcttaattcaagtatagaatttaagtgtcatgcattatctcccttgaaagcaaaatctaaatcacatgaaaagactagaatacatacaagctttgctagagacaaataaaccttcaaagtattgctagcatgcacaagaaaataccatatgtataaaacaaagttctcttttctcaattttttcattgtcatattattgcttgataaaaccatgaggtacaaactccccctcaaaacatgccaaaaggattcacgaataagcactaactccccctcaaaataacctccaattctccccaaacaaaaatcaagaagaaatcaaagattttgaaaaagacatccaattgccaatgatatcaccaagattatcatgaattgacatgtatacacttgtattaacaaaaactactacctcaaacacaagcatatgaaaagctaataattaagaaagtagaacaaaaaatatgtcaatccaaaattaaattgatgttaccttgtgaagcaatcgtcatctcaaaattgaacactcatagggagtatgctgccaaaatacctacgaacgagaagatgtcgaggccttcgtgttggggttagaaataagaaattttggaatccaacactgagttacacgacctgtagaaccagtaggtacaaatgcactgacaaaatcagaatcagacttacctgaaaaattacctttttccttcacaaaagtctgagttaaatttcgtacaaaattgccccgaggtcggtctgaccaccgctgtgcctacggtctgaccgggcctgacagccggtctgaccgccggttcaactgcggtctgaccgctggacggtctgactgactggtcagtgtcggtctaaccgtggtcctcgaattaaaacccgatttttgccaacgtcgttttgcaaaagcaatttctctttccttttttctgtttatgggcaagtttaaaacaaaaaccaaccaaatgtccatcttttccacaaaaagaacaagtgtacttctcacgacaagtttgtgaagtggatggttttgaaattgatggttttgcaacaacagaaggttttgcattcacaacatttgatttcgaagaagatgcattcaaagaagacatgatgccagcagatttatacacagtgttcttaggctcagtttcaatcaaaatttcacctctcccagcaacacccaaaaccgtaggaggatgtctagtatgatgagcataagaatcaaaacctaaaccacgattgtgtgtgctaactttagattgatcaagaatcatgttgaggttctttttaccatcagaaaatctttgcaaagaacttttcaaataagaaacctcctgagtaagaatagcacaatttttgcaagcatccaaaagacctttttgttttctacaagttgagcaagaaaacacctcatcttgtttaacaatttcttccatgtgtttaacacgctctaaagcatctttcaacttcaactcattcaaaacacactttgaacaatcttgagaaatcaaaacaccattgttttgttttgccttatttgcacatgaagcattgaccaaagaacttgcacaaaaagcaactttgtatttttttcaaaacgttctttgtcaaaatcaactcatcaacaacacgagcatgtaaagcaaatccaagagcaaaagaagactccaactttttagatttttcaatctcaaattccatttttttgcaattaacagaattgacatatcgcaaagcattaatttcagaaaataaaacttcacaagattgacaattatcatctttaggaatcaaagattttaatctagcaatttcagcattaagaatctcaatcgtacgatccttctcatcaagcacaatagaacatgtttgaagtttcttagcaaatttgtaagcatcatattctaattgatcataactaagcttttcttcattatcatcatcagattcatcaacatcagaacttgcattacgagcaataaaagctagatcaacaacttgcttacctttgccctcatcttcatcttcagatccatcaaaaatttttatgagttcttgaattaaccactgcatgcaatgtttcttcttctccttctccttcatgttcttcttcttgttcacgtcatcctctttgactctaccatcatcttccttcttgactctcccaagcttagggcaatgcgagcgaagatgatcaagtgcaccacactcaaaacaacgattcggttatcctcttttcctgttcctaacatttttcatagctcgagaaaatttgttaaatagcaaaaccaagtcctcctcctcgaactgttcgagttgatcatcagacatggcattaaataaagtaagaacataagacttcgatgaagaagcaccaacatccaaagaagttgaagacgaaaccaaagcactagaattagaatcacctttacgagaaagaatattcatctcatgagttttcagttttgtgtaaagcgaatccaaagtcaaagtagacatgttcacagactcctgaatagatgtaattttcatctcccaaatagacatgtcaagaccattcaaaaagtgacgagaaatctcaaattgtagataattagcatcataagaagaatcaacagatctaagatcacccaaaattttattaaacctaaaaaagatagtcatccaaagcttctccaggtttcatctcaaatttaatgtactcctttttgaaaagatcacaacgaagttctttaatgttattagtaccttaatgaaaattattcaaagcaacccaaatctcatgagcagtttgaagatgagcaacacaatcataatccgaacgagaaatcccactcaaaaaaatattgcgagctttgcaattcagttcaaaagcagttttttcagcagcagtattaataacttcaggaatcacataaggaagagaaacttttctccaaatatcataattctcagccataatgtaagattgcatcctactacaccaatgagaaaaatccattccatcgaaaacatgaggcttagttgaaaacttattagaagcagccatggcaaaaactttggatcggttaaaatccaaagaagcaaacaaagctctgatactacttgtaggatcgaatcacaagaactaagccaaccagagggggggtgaatggttgatataccccaaaacccaaacttttagcggaaataaaagttaccctcaaattcgatgtagatcggtctgaccgaggttgatccgccggtctgaccgagctcgtgccgctggtctgaccagtgttgatccgccggtccaactgcctgaagattgcctgtcgcgtgtgaagtcgccgccggtctgaccgccggtatgtcgccggttagaccgccgaaacccgatgaaacacaaatcgaagaactctcaaagtagatgataactttattacttctctctatgtttacaaagtgcaccaacaacactccttacaaaaatctcgactaaactcgaaaccctaactaaactagcaactcaattactctcaaaagtgatactgggaagactcacgctccccctctatttattcatgaggtaggcagcctaaagccacgaaccaaactcatactaagagtcctaaacaccttaggaaaccctctagtacaagacacaaactttacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccatcaagccgactctcagtccatcaccgcaaatactcttccgaggcatcgagtcacctacacacgaaataaacaaagaaaccatattccgataccaagctatccccaacttgactcattgttagcaaacaacagtattacatacgtatattatctatctagaagtcataaccatgaaacaatcatggatatccaaagaaacaacccgaaaccgaaaccgacatagcgtcggccggtcagaccgcgggctggccggtctgaccgctcgatcaccaccggtctgaccggcatacaccacctagtcggaccggtcacataaaataatagtgaatccgatcatcacctgaaaattgattatctccaaaaccacttcgacgataatctccaaatatcaaaaccaataatcacagatgtcaattgttcatcacagaataagaatcaaaacacactttaatcttacattacgttattatacgttcaccgtgaataacatttagacccatcactctcgagttcatatatcagccaccacatcggaggaaagttatgtgagagaatttcaatcggtgataatataggcacgtacgtgtcgcctctcgacgacatgtaagacctgatgactgaaaaaccttagcgcagtactactctgggccccggcgttagtggctacaaagcagtacaccagttggtgtgaactaatttgacagcttaattactttgcagtcgtgttatgttagagtaccgaaacgtgtgcatgactagtgtaggtgacaattacatttgggatcgagttaatggtgacaataacattggcatcgagttaaacacgccgtacattgaaacttactctacggatatattctccttgtctcgaatgaaaaagaaagaaagaaaataattaatgatgaggtcaagaaaatatcacatcgttgatctagctggagaaaaccaacaagctaagactgctagctactgaagaatatcaaccatggtcgctataatggaacgatcaaattagaccactcgacaagatgttgaaagattccatacctttgactatgctagagcattttcaccggtacgttaattaccgcgtgttaattcgacgtacgtcaaaactaaacacctggtagtacgtgttcgaactctcctgttgcatgcacacgtaagtgacacgcataagaatccagaccgatcacacgtaatacacatggaaatcaaatcgcacagagactaatgctgcaattaaaattccatctggaatttaacacgatcagtacgtctgaacatgcctacatctacctgaaacggacccgtggaaaaccggaaaacgccatggccgacacacatctacactactctcaggctagtccaatgagcactccggtcgtcgccggccgtgcaaccgccgaaataaacgacgacgacggtgacgactgatgagacgttacaagctaggcaagaccataaaattaaattaaaaacaagcacacacgcactagaattccaagaaaactacgtcttgttacgactctttgcttgtagcagtacatgtgtcttgttgtgaaatgttgattaattctagcccttgtaagtgttatccatatcgatgcaatgcctgatcccgaagccacgtcttgggatttcgtacggggctcctcctctcacgaggagctgagttttctaaccaaaaaaaactgttacttattgtgcatagtcagatcgatagataggttgtttcaaaaaagaaaacgatataagatagatgttgcatgcatatacattacattagcagtgagattaattaatagtaagaacattaattatccataatatgtaattaacattcataatatatatatgtctgttgcattgctggtggtaatgagaatcttgagatctattccaagtccaacgtccaattaaaggagaacagcttatatattagccagtttttggttccaacaaccagttgacctcaatcatcatgacgatcgaagagctagagaaaaaaattatcaggatcaaaggtgtattataatacagaagagaggatagttggcgtaaaataataactatacattgttactgaaattctgtgtggcccaaacaagttgactcgagattttatacggagacgcaactgctagtccggccttagttttccattatactgtataaatcttcggtcatcggtgagctatagaaggagatcagattaaggcactgaaatggctatcaccttacaggatgcagacgatggcatgccatgagtcaacattgcagaggtccgacttaagacatcgaagcatatatatacactaagtgttgtgaatcacaattaatgcatgcgtttagaaaacaaaatggtaacaccttaggtttttttttctaactaatttttgggttttgctaggtttgcatacaagctagctagcaacctcaatcaagggcactccttaattacataagaattatataaaggtcatgaacgaattatattgtctaacacatatatatcatcaaaaaaaaatttgcatgttgttttactcaattcctaaggtgctgtagacagctatattctccatgaaatgaagtgcttgcgagccacttgatactaaattatagtcacatacacaagtcaacagttcaatttatagcgcgagcgagttctataaaagtactaaacatggcattgaaagttgacattgtgcaactagaatgctagatttatacatatgaaaagaaaatattaatgtatatatagctcacattttaatctgtcattttggtaatggggaaactaaggtgcgtgatgatagcggccctgaagaaattccaagagttgacctgggctccatacaatactaatccccttagcgttagaagcgctctctcccatcatgcacatgaccaagcccccacttgacttcggtatcccttgtcatttggatcacaccaccgtgcacttcacaattcacactactccttcagattaatccatctcgttgatatttcatctcgagtcgtaaaaaccctcatattgtattcatcactgacatgtgtgcccccaaaaaatatcaataggtgtagaaggtcgtgtatatatacgcattcatgtgtgtcaaggcaatatattttgttgaatatgagatgacatgggataataggattaaggaggagtcttccctcctcattgcccttttaatacgtcttagacacccagacattgacttagatgcctcgggagaagtagcattaggatttaagaccgttccccattttagctgtaccaagagagacaaaggtacacaagattaccagaaagaggccaggagcatgtcatccaagaagaagagagctgccatagatctctccctggaggcagagagaagacggccagaagaacgcggcggcggcagcgatcgcgaagccagcgatggcgccgctgctgcagctgaggaagatggtgatgtcaagcaacgagagggccctaaagaggaaaccggcggcgaggaggagaaggtagttgaagtggttgtggaccaaggagaagacggctccaatgaggagatcaaatataggactcaacaagcagagatgatcgaggaggacaagcaaccagctgcagcagcaaacgtcgacgacgatggcggcgacagcgacggagtcggagctagcgcggaagagaagcacatggtaacagaggccaccggcggcgaaggcgacgacggaggcgatagccgtacccccatggcgcaagatgaggtactatacacagtactacaattaaacttaccgacgattataaaaactcctaattatactattagctggtgatgtgatgcaagtagatagaattaatatcgatggagatttctcttgtcctttgctcccatttggagttgacatatatatgtgtgcttcttcagctcagcgagatgcaggaggagatggagaggatgaaggaggagaaccggatgctccggcgagtcgtcgacaagacggtgcgcgactactacgagctgcagatgaagctagccgcctaccagcagcaaccggcagcagcagatgagcctaaggtgatttaatttcttaattagctgagctagcttaaccaagctgatttagctagctattatagctaggctaaatatccaattgagcctacccatgttgaaactaagcttagctctagctcgcgcgctcatctcgtgcatgactttaattattcttccacgtgacacaccataattaccatattactcaattaagtcacgccttgttgtttgcgaactcgtgattgattcgatcgatttccgtgtaggagaccgaggtgttcctctccctcggcgcaacggccgccgcctccgccggctgcggcggcggcttcccggaggcgaagagcaaggagcaggccgcgtggcggcggcgctctgtcggaagcgacgacagcgactgcggcaaggaggatctagggctgtcccttagcctgggagcgtcgtcgtcgtacgacgacgaccagaaggcggtggaagcaaggccgcacgacgtcgacggcgcggcggctgcggccatgatcggcggcgacggcagcaggccggcgccgagggggtacgcgctgctggagagcagcaaggtgcagggtggcgcggcgccggccgccggcgagctcgccgcggccggcggcatcacgagccagagcgtcaacccggccaaccgcaaaactagggtttcagttcgagtccggtgccaaggccccaccgtaagacacaatgcatgcaacatctgtgcgtgcatgcgtgcagtacatgatacgagtactaattactaatattgatcttgtgatgttgtcgcaccggtgcagatgaacgatgggtgccaatggcggaaatacgggcagaaggtcgccaagggcaacccgtgcccgcgagcttactaccggtgcaccgtcgcgccgggctgcccggtgcggaagcaggtgacgatcgaaactgacaagaattcagattgattagcattggttgcatgcatgatcatgtgtgttcgtgcatggattgatcgatctcgtttgattgtgtgcaggtgcagagatgcctcgaggacatgtcgatcctggtgacgacgtacgagggcacgcacaaccacccgctccccgtcggcgccaccgccatggcgtccaccacctccgccgcggccaccttcatgcttctctccagcaccacctcctcctcctccgtctccgacgcctccgccgcgccgtcgtcgtcctacctcagcccgtacctgctcaactccgcctcgccgttgctaatgccgggcgccaccggcggcggcggcggcatgcagcatctcaacctgttcgggaattcgccgtcgtcgtcgtctctgctagctccgcaagcgccaggctccagcaagtacccgtggtctccgaaccaccctccgctcgccggcgccggaggtaataagagaccgttctggagcgccggcggcgacggggacaagccggcgccggcggcattggccgagaacgtcggcgcggtgatgtcggacccgaacaagttctcggcggcgatcgccgcggcgatcaacaacttcatggggaaagacggcgagagtagcagcggcaagagtagtagtaagtggggcgtggttgaatcacttccaccccatgagtagtagtgagaattatattactagttactagctaatcaaatgtgacaagattgattcaatgattgggaaatcagttaggattattgcgtgtaaacaaatcaaactaggggaaatcacacattggaaacatttttttcggggagatttcgttgtaatttttcagtttttttttgtttggaacagatcgaattgttgttaaccgtaaattacagtatctgttcatcgtctttattaattaacaaggttgtacgatcatattcagatcatacaaagtagtatcctatattagtagggccgtgggggttcagttctgtgtgctataacagttttttatttactacatttataagcatttttatggttattttaccatacttaaggagttatcgggagttaccatattttctatattgaaaatattttctagtataaaatttgatgcatatggtggtattagttatcaaaatttttagtgtaaaatgtaggtacctgctctattaagaaccataaaatttctcattttcttatgggcagtcgatttcacacttgcccttggtttattcaagaatgtttgccggcattttaaattttggagaaaaaaaactaaccggtggatatatcagtgcatttaatagtggtttcaatttggtccctatgtctaaattgatcggttgttttgctctctccttttatttatttttatttttttaacacgcaaaacaattgcacatcaatgtattagaataaaaaaatgttacacaacgtaagtggctagacatgtaattaatgaaaaagagttttcattatttggtctattaattatacacatgatctggttgtaactatatatattgtgacaattattttttctgtttgagaaaacaaatgtccacagaggttcgcttaaatagtaagggttacatcatgacaggatcgcatcatttatgaaacactgtatgggctactgtgccagggtcacacctgtagctgatcaagcattatcagttggcttccagaacaacaatactgaattaggcctaataacaaaaccacactttgaaatcttgtggctagtactatatatatatatatatatatatatatatatatatatatatatatataaatatatagcttgatgactacttcatccgtttcataatgtaagactttctagtattacccacatttatttagatgttaatagatgtagacatatgtatgcgtttaaatttattaacatatatatatatatatatatatatatatatatatatatatgtggataatgctaaaaagtcttacattctgaaatgaagggagtattaattaagacagatcatacgaattcagcaagtattgttttgtgctgtactgctagcagtgcaagagttgttccgcgaataactcatttttccttttgatttttcggtttgagaacgtcgtctagcaccattcaaattaaggaagcctgcagtgcactgtgcactctgcatggtctcctgactaattagcaatctggcgccgtcagctcagctttctcttgtaaaacatactccctccgtaaaaaaaaaaagacaaaccctgggttttcgtattcaatgtttaaccgtctatcttatttgaaaaaattatgaaaaaaattaaaaagacaagtcacgcataaagtattaatcatgttttatcatctaacaacaatgaaaataataattataaaaaaatttcatataagacggacggtcaaacgtttgacataaaaatctagtgtttgtctttttttttttaaggcagagggagtacgtagagattggcgcggccggggatgcaatatgcaagtcaaggccgttgcagcgaaccagcttgttggtagcggccatcaggatgcaggccggatcgatgcctgcaaactattgttgcgcatgaagcgactgttgtagcacattagaagccagtatggtggacaggatcttccggcaggcctctgtaaggccccagaggaatttcacagagagaacgctaagccgctaactcttcagttcagtaagatatcttatatatggggtatatagggcaaagttgtctcggtacccaaaaagaaaggggaaatgttatcactaaacaaggaagaacagagatcgcatattacattcgtatagaggaaaacaatcactgtacgctccggacaagcttctccagactctagagtggtgtactacgttccaacttccaaccccttgtttccattgatcattctaacacctctggtcacatggttctgaccatttctggaacatgcctatgctctcttgcagtagtgtccttcgcgtaactaagcctattttccgttaagctcagtcattgcttgtacttacacgagtgttaaatcccctcctggcatgtactttcatcagcactaaagtctgaaatttcttgtagtattagggtgtgtttgagaagaaggggattggggagattgggaagatacgcaaaacgatgtgggccattagcatatgattaattgagtattaactattttaaattgcaaaaatggattaatatgattttttagagcaactttcctatagaaattttttgcaaaaaacgcaccgtttagtagtttgggaagcgtgcgcacgaaaaacgatgagctttctcacccaatgtcactagaacgaacacagccttagtacaaaaccccaaaatccacactgaacttctctgaacttttatcacagggccattagcctgaagcctcgagcaggaggtaggagagagagagaggctggggaccaatacgccagcaaaagccacagtcccacggatcatgtgatcagccaccgcccacgccccaccaccaccaccaaagccaccaaactcttctctgaagaaatttcagtactcagtgttgaagcctgaaccacccatccagaatcgcaggagcagcgagcgatctcggtttgatctcgtgcgagccgcgcttctcggtccatccgaaaaacgccaagcccaatccaattatccaaccctatcccagatcagaatatatcggatatggttgatttaatcccaactcattactgctatttcttcgcttgtttctcatgcgtgtttacaagaatcttccaacctaatccccccgtcttccaccacaatcacgcagtgacagcgaggaaattatagttgcctggtcaagtaaaactctgcttagtgagacattcctacttttccaagttataaaacaaacattctgaattttatccatggggttaatttcagctgttccaattgtaatctcactagctttattaatgaattttagctgttccaattatgaactcactaactttacatagaggttgatgaccaccggcgggaaggaatctgttcccgtttaatacgggttaacacgccgaaatttactcgaccctacgataaaagtacaaacgataagaggaatattcctttttatattttattttctctctctctctctcaacgtgctacagttcaacggtgtacggcaaatcgcaacacgtcccgtagaaggcaccccccgtctccgccggtttcgtcaccccagcttttgcgtggacgcggtccatggactgcaccgcgaccccggcttccgtcccggctcccgcccgcccgaggagggagccggtgcatggaccgggtccacgcaggggtgaacaggcggcgaaactgtaattgcaacgcgaactcgcaccaaaaaacgtggggcccacccgcccaaaatctttgcgtctcctcccctttctaatccactttttattttttgcgccattttttctttttctttttcgttttgttttttttttcgttaatttggcttaactaggggtgtccttgtctttcgccattttctctctcgctcggtttgctgctctcctcctcctcgtcgtcgtctccaactccgtcgcggcctcgcgctcaccgccgccggaatccggctgacctcctccgctcccgcatcgggcgctcgccccccgggtctaggtacttgcccttgcccccctgcccatgcccttcgtcccgattcgaacatgtcagatttggttggttgggtatcttggtggtgggttggttcgccaggcgccgaggcccaagttctttgtcctggaatggtggctagggagctttgtttcggggttctatctctgtgatttgggtgcggatgggaggaattcttcttggtttgggggaatttggggggttccggtgctgatttgagtgttttctggctggttcttggcgctccttcgggagaattttgtggagctctctgatgggagtggtctaggtcgggatctcagactggatggcctaatttgatcttatcaaggtgaattatgccttctcagtgaggatttaggtgactgtggttacaattgctggggtatttgacctaaaaacgaagatgggcgagcaaaaggggcctcctattgtcaaaattttagtcattgaaccagtagcacgagagcggtgttctcggtgtattctttgcgtgtagattggaggattggccgcaatggcgtagcaaaataccctttaatgtatcttttgagcttctgttgatgcttttaagctttttgattgttgtagtagtgattaacaattttgtaggaaatgatctactgcgagaaggtactgtagtaaggaaatttaattggcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17867 - DNA, 283 bp, Oryza sativa
tattaaaaacaaactggtgaatttatcattattttattatcttaaggaactaaatctttcatcataaatactatctgactcccatccttgtgacagatatcgaacaacatctctggcaatacacaatttggaacttccatggcgataccaaatgaaaataaaggtaaaatatgatgaagtatctccctctgccttttcgtctctctgtgtaatcggtacaatttctggactgtaaaatacattttgattgtttgatggcctatccttttgttctcttttgcat

SEQ ID NO: 17868 - DNA, 1820 bp, Oryza sativa
cttccaccttcgttggagaccgccgaatcaccgccgtcgtcttcgccccgtgggatgctgccgcctccctctgctcgagccccatcagctgcctccttcgccgccatgcccctcggtgagctccgccgcctccctcttcgcctcctccgctcgttttcgccgctccccggtcgccccctcgctcgtcgggccgacgccgccatcaccattgtcgtcgtcgtccttcccgcgtcggtgagcatctccctcctcctcccctccctttctttttctctctttgcccgccggccgccgcatgcgtgtcgccgtcgcgccgcgccgcgtcgccgcctgtgtcgccgccggtggtcatccggccgcgcgccgccgtctggtcgggttggtcggcgagccaaccctcccctccgccttgcacctctaccgtggactcggtccacggtgggctagatcccttgtgcccgctgacgcgtggggcccgctcttttggtggacccggtccaagccctcccctttgactcgctgacgtgtgggcccgcctgtcggcgccggcgccccttgctgacgtcagcgaataacatttcctttgagaaaataattaataattgcgcaataattcgataataattatagaaattcattaaaatggctcaaaaccttctaaaattcatatctaattcattcgaactccgaattgagccattcaacttgcaaaattcatctaaaattgagctctacatgtttgtttactttttatgtactgttttcttggtgtttattagagtttttcctcattttgcgtgccagcgtgtagtttccgtcgtttcggaagtccgcggtcgcgaggaaaagagttcggaagatcaaagtgaagaagcaaggcaagtcgcacattccccttgagcatgttgatcccaatttataaatgttttaccgtttacaaataaatatgcatgttttgctaattacatgggatctgggtattacctatctgctcgcttgtgccatgtttacttgatatctgttctttgtcaaccttgggtaatactttgactagctcgtgttacttatgtgacctagctagaactatatgcttagccatgcttaattaccactagctcagtcgatgggataattgcagtattagacattctagtatcttgttgagccgcgtgctcgagacatctgccaggtttcatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcggagggtctcgtcacaatcactcgacatggtgacgtgtgcatcatgggcacatgatgacgcggtgacatgtcggtgggttgtgtcttgtgggtacagttgtgcacctctgatcagagtaaaactattcgaatagccgtgcccgtggttatgggcgatcgaccagattcaccgtgattagtctcacacttaataaatcgacccaatgcactgtagtacaggtgggttggttgggcctgttcaacgtggtgtagcgttgatcagtggagattttaatgttactttaat

SEQ ID NO: 17869 - DNA, 721 bp, Oryza sativa
tggaacccctctttttaattagtaccataccgtgaatttttattgtgttgaagccacataaaagagggcgtatctcaatcttagctgcctggtctggtagtgcggacttgtaaccccatgctttggggggcatggagttggcaattgtgctagtcgtttcctagtaacaaccaaatctaaaagtcccttaataagggagacaccctcattttaagggagcctgcaagggttcgaccccacacaaagtaaaaaatgtgctggcgtcgtaaatggtttggaattgtggcagcaagtcagcccgcccaaactggatttcggcctcctagctagagaaaacgtacccagcctcttgtcaactccacatttttttcttctctctgtcattcataaacttcttgggtttttttaatgtcttcaccagcaagctaacccgctcaatatgtcattcataaacttcttgggtttttttaatgccttcaccagctagctaacccgctcaagaaaatatcaactccacattttttccttctctctgtcatttataaacttcttgggtttttttaatgtcttcaccagcaagctaacccgctcaagaaaatgtcaactccacattttttccttctctctgtcatttataaatttcttgggtttttttaatgtcttcaccagcaagctaacccgctcaatatgtcattcataaactttgtgggtttttttaatg

SEQ ID NO: 17870 - DNA, 342 bp, Oryza sativa
cgagactggccaggccgggaacgtggtgaccgaggggttatgggtgacccgattgtgggtttttgccgattcccccccggagttcaccacgccccggggcacggctcggttctgggccccgtttggcgattttagctgaccgaaccgagcccccgagggcaaggttgagcacgagtgacctcatttcaaatcaaaattcttcaaaaaggaaaaaacggcacagatacagcccttaggaaattgaaactgcttttattgaaatactgaaatgagagaaatgagaatgtgcatgtgtggcagcccccggccaaccctgcacacccgagggggggtgcggggttg

SEQ ID NO: 17871 - DNA, 1140 bp, Oryza sativa
  unsure (1)..(1140): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatggagatgtggaggtggcgaaaccggagcctacccgcgttgtcggagttggcggcgcaaggattgtcgatgtagagccatttctgcatccaatgccaatcctacttcggtatggacgtagggaccggccatgagtccgaccgctctggtcggaggttgaagttcacactgccgaagacagacttcttcggcccagcgggtgtgtgcacatctttcgtcgatgcactggcggtgaagaggagggcgaagagctccactataggagcgaacccggtcgttcggcacatctaagcgaagacggagagctttgcgatggccaaagggctgagttgcggaagcctcgcctcatacatctccaggacggagggcaagaaattgtcgcacggcagccagaagtccacgtcgaagaaggaggcaaagaccacggttcgcccgtcgcctggcgctaggacgatgtcattgctaggttgagaggcatggccttcggcagttaccccaacaagaaccattgcggctacatcggagtcgttaacctttgacttgcccaggtagcaagtccagttgttgccaaggctcccggggccatcgtcaatcgcaccatcttgggtaggtttgcgtggggccattttcatccgtggtgaaggagaaagcaccaagcgagtacaaaggcgaaaggcttaatgggggagaaggacaaactcacgagagcgaaaagcacaagatgcatgagagtgagggtgactgaaagcaactgtggtaaaaaagtgagaggtgtaaaggtcaaagcgatccgtcgggggggggggaggggtggttgtagcccgatgaagcgacgcttcgccttccacccaatcctagcccgccacgtgtcacaaggggggtagatgaaacggtaaattcccattggatcaggccacacagtataagg

SEQ ID NO: 17872 - DNA, 515 bp, Oryza sativa
tcctgcagccccgcgatgcagcgaagccgacggtggcagggcgcggcttggcagtggctggagcggcgaggagcagcggctggagctcgtcggtgagtggtggagagagggagcgcggtggggaggtggttccggcggtggaggagggagatggagtggatgccggggtgcggcgaggcgctgtgatgctataggtggcggcggtgcagcgcggcagcgacgggagcggcggtggcgggcggctggagatcgccggcgagcggcggtgcgtgggctcggcgcggggagagcgagggagggcgcggcggcttggggaaaatgggggaaacggaggaggggaggccggggattgtttttatagctcaagggggcgaggagagggccggggagcggcggatttcgagggggaagtggggcggcgtcgtgggggagagagagacgccggaggcggcgacgtggccggattttgcggggagagggggggaaaccgcgcggacgtgggcggcgaggtccca

SEQ ID NO: 17873 - DNA, 238 bp, Oryza sativa
gcgtgcgcgccgcccgtcgtcatcccgcagccgccgccgcccgccgctgtcgtacccgtcgccgtcgacgctgccgcagcccgccgatgccgccgcactagctcggggattgggaggaagattgggggaggagagagaacgggaggaaagaaggggtgaaagggtagttgagtggcattttcgtgtaaatacactaaaatattagagggtagtgggtcttttggggtggagtggagct

SEQ ID NO: 17874 - DNA, 6994 bp, Oryza sativa
  unsure (1)..(6994): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcttacaccacctcctcgtgattacagttctaccaacattaattaattaatttgagaagcaatcagcattaatcaaagcgaaggggtcaggttaaaattatactctcttgagttgcccactttcggtggtcggcaaccttttacccgtgcactagcttgagtgtgaagcgcacacgtccggtactgtacgaatccgtattatatccatacgacgaaaaacacatctatcctcgtacacatatacagaggcgggattacgattttaaagtatcgtgttcaaaatataaaaggttaaagaggattttatagctaaaagctgacgtgcataatatatatactaatggtataacatatttataacatatagtatacgaatactatactaattgcatatagtatatactctctccattctagaatataaccatttttagagttgaagaccgttattaaaaagatagatagaattaaatagatgagagttgtgattgaatgagaagttgaggtaggtgaaaaatttgtacagtgaaggattgtgattggttgagaagaaaatattgatgtagaagttgttatattttaagacaaattctagaggctgaaagttgttatattttaggtcggagggagtaagttttatatgaaattcttacatattcatctgaatactcttgagctggacctgacatatgaaatcctcaactgaagtttggtctctgttaagtctgcggctcaggcactcactcgctgggcaggcaagaataattgtcgttttgttaccctctcaaatatggtgccaagtgccaacgacatttaaatggatcgtgttcttttcccattttaccaacaaacctctctcgttttccgcgcgtatgttttttaaactgataaatgatgctatttatgaaaaaccttctatataaaagttgtttaaaaaatcatattaatatttaaaaaaaagttaatacttaattaatcatgcaataatatgagcttcgttttgcgtgccggggagaagggttccaaagaatctactccctccgttccataatataagacacatctattatttttttatgttccataatataaggcatgcctgcatgcatacaattaattatgacatcttcatattaaattattacttttttaaaattctccaccctcaatatctctaattctattggatgtatttattatatttattagggtggtctaaactaggaggtgataataattatttcttgatatttaggttaagactgattgtgccttatattttctaatggagggagaagaacaaatggtttggttcgagtggtgctacactcagactaggtagactggtagtcaaatgtcttttattttactcatggcaacgtgattggaaaaaaaaatacaacttgctggctacaatatatgttactctgttattagtactggtcagtaataagggaagttctatcatcatttatctattttttaaaaataataattatatgccttatgacttatatatggtgccattactgcatacaatcgccggatgcggtaaggttacatagtttttttttttgtaaaaaaaaaagaagcccataggtccggcttctattgaaagaccaggggaaagttttgggtgcagccccagacattacagtacagaggcaacgcctcaaaagattacaagaagttcaataaattttgtacaaatttttcaaccgctcaacggggtaactacacagttaccgcctgggtagggtcgataccactacaccaagcttacgatgccaataatataaaccatttctgttatcttaaatataggaaaaactataaatcgagcttctgatttttctaaaacaaaaaccagattttatttgaccatcggttaaacattaaattatacgtgataaaaaaatcaaataaacatttaattatttttcaagtgaagacacatgttaaaacatgttattaaatgaaacaatgaaatatatgattttccatcaaaatataaaagatttaatcaaaataaatataatgatgtgattggattatacatcatataagcagtttaaaaaaaatatttaaagtgagaaggaataaggagaagctagcttagctgcagccttgcatgcatgtaagtattagtctttactcgcctcttgattccgtggggagcaaagccgattccggcgccggcgccgtcgacgccaccaccacgaggttcgtcgcggtcggtggcctgtagaacggcaccacctcgaaccgcgtgtagcacgtcagcgagtaggcacgccctcctctcgtcctgcaccgcaaccatgtccatgcaagcttaggttgtatttggtcgggctatggcttttaaaaaattagctgtagactgtagcattttaaaaagtaactatgaaatatgggctgtgatttttgaaaaagctcatttgaggatgcccaccccagcattgcagtctcaatgtcaatccttacatgggcagcgacgccgcgatgctctggaggcagcggcggcagtcgtccggcgagaggtcgtcgacgcactgcacgaacgcgtagaggctgtcgccgccgtcgccggtgatgttcgtctgcccgaacgcgaaccgccggccacgggaagacgacgacgacgacgcggcggcgagcgcgaggcggtccatgagccggctgagcgcggcgccgaactgggcggcgtcgccggcgctcgtcatgttggggttgtagacgagaactcctgggccatgtccggccgcgccaggaacggcgcgccgccggcgtaccggagcaggcagttgttgtacagcatggcgccgcccacggcgcgcgggcaggcgagcgacaggttgcccgccgccatggccaggcagagccggcacacctccggcggcgcgtcggcgtagcagatggcgaggccgtgcgcggcgccgccggcgtcgttggccaccgcgtatccaccgccggacaccgcggcgtcgacgacgtccttcagcacgccgcggaggctcgtgccgtaggcgctcccggcggtgtagttctgcggcgagcactccgaccacacctgcaccgtctgcgcgaacgccggtggcgtggtgcgcgcgacgcagacgacggcgacgacgatggcgaggagcacggcgaggttggaatccatggcggtcgctgtgtgcaaagcgagtggcactagctctagctatatagcagtctagcacctctttagctatggagtagaatggagtattagatgtagttgatgatattataagtcgtttgacttttttaagttaaactttgttaagtttgattaaatttattgaaaaatttagcaatacctaaaatatcaaattaatttttattaaatctaatattaaatatatttcgataatatgtttgttttgggttaaaaatactattatatttttatataaacttgatcaacattaaaaaagttttattaagaaaaaagtaaaacgacttataatatgaaatggagtatgttattgtgcaccgactctgttttaacatggaccattaataaatttttaaggaaaacttagtgcttacatttataatacaacaacgtttaatttataagctctgataaaatagacaaatgataataaaattttaaatatgaatagcagtatagcactcccctataaaaaaaaaagaaagcagtatagcacccagtgacaagtatataatggaaagaatatgcacaactttttcttcctatatttgacagcacaatgcatccaactgtctttcaagtatataatggaaagaatatgcacaaactttttcttcctatatatgacagcacaatgcatccaactgtcttttagccaataactttatgccaaacttgttttgtgaatcatgtgttatacaatgctattctatatctttaaacaccagctgacaatttttacagtaagtagctagttatatatattatcgtacctgctttgtaagagaaggtgatgagagagaaaaagttagcaattcctaaacagtcgccaggcacaaaatcatcccaatacagcatgatgaatccaacagcctgctagccaataactttggcatactcaaatagtgaatcatgtgatcaagcctactccattcgtctcatattggaagagattatatcctcaaaaattaataaaagtgattttataattctaagacggtactttattcttcacctaccacctttgtaactaatttattccttcatatgatgttttttactaattaatttctccaatcatcactttcgtattgtcttttttcctttcgccactttcttattttttgcaaaaaaaaaagtataatcccttatatcttaggacggaagaagtataagtcaacgttagatcgttagtaatatatgacgtgaaaattttttgtaaccaacagtactactattgtgttttgataccatagatataacttcttgactttaagtgtactttctgtctacaccctaagtaaaaaaaaagcctaattgtagctataaacctgcatgtgtaaaaatctaatcttagctatgaagctgaatatgtgctcacattatttataattagaattggattttttttatgtaaggagtacatgtgagcaattaattagtgctgggctctccagtaatcattcatattaagaacattaataaagtggaatcctaggaatacttaggactggggtcagcgaggcccatgtgtcaatgaatactaacttaattctctgagacagtctcctgtcgaccaatagcaagcatgccgtctttgaccagacaagatgcaggtctcgtcaagagtcattttatctctggcagtttgctcatcattttttacttggctgtgtttagatctaaagtttggatctaaacttcagtcctttttcatcacatcaacctgtcatacatataatttttttagtcacattatatccaattttaaccaaaatctaaattttacgctgagctaaacgcaacccatttgtttcaatggagtgtgtacatgcaggaccaagaaccagctactgatcatttcaatgggccgacaaccagtcacagcagcagcaacgatacgtcatatattttagacgaagagtagtataataagtagaactggagtattccgctgccaatgaaatgaagtttattttatagcaagaatggatttatagggtggtcctcagaccacgcaaaaaattcgccaacccatatactaaatataggaatttaggaaaaaaaaaagaactctaacacatgaacacagcctagaaaatgaggtttagagtgcatccaatgaacatgcacttgtttccaatactccctccttcccaaatgttagacttatttcatattttaattttttttcaaatatgttaaccatatttgtagttttcatttatctaaaacttaaacgaggagataaattaaatgtttaatcggaacctgaagagtcatcttaacccttattagttgtctctttttaatctttattacatgccagatgtgttaatttctcctttgtcttggtgataaaattaatatgtttaactcttttggtgaaaggagtactacctatgagcccattaagaattatttttcaaatagaagaaagtataagagaacaagattatctaggaagattagtaaaacaagatatttagtcgatacattacaaaaaattacttttactaatcatccctcctcctcgatcaaccagccaagattcctgtccaaattaaaatgctataaccagttacttcctccaatctgcaatgcaattaacagaaacatacaacgattgtaatgacagtccaaatccacgtgcatttactcaacttcctgtacattttcatgaacattatattgtacttccctacgaactaaatagattcccccaacttccatgtacattttcaggtacattgtactgagaataagtctaagaaatccacgggagcaatccccttctataattgcatcgaaaattcttccttgaaaatgaatggcacaacagaggtactgagaaagaagtctaagaaatccacaggagcctagcaatcccttcttctataatggtagcagaattcttcctcgagatcgactttttactatattagaccagtgttacctcatcaaactcgagtggcttcggccacatgcccacatcctcaccaactccacctgctatgaaatcctaggaagatgagaggagaggaaagaaggcctgaaccctagatcccaaacagggaggggcgacggtaatggcttgccagaggaggaggagaaaaggctagggctggtgagaagggaggctcaatggtatcttgagtatcttgagcgagggaaattcccctctgtaaacatggtttggttcccaaggatcccacatgaaacgggtttggaatacctcatcccgtgggctttcaattggataagagaattggcccataaaattttctcgttggtcttttcttcgggaaatgggtcagaatctcaacagaattcaggctactaaatgagacatattgtggtataaaacttttctcccttgatcgatctcctccaagctctcttaaccgaacaagtagagacggggatcagctagtcccatatactccctccgtcccatataaaaccaacctaataccggatgtgacatatcctaatactacgaatctggacatacatatgtccagattcatcgtactagaatatgtcacatccgatcgtagatttattttttatgggacagagggggtataaggtggtgtt

SEQ ID NO: 17875 - DNA, 9547 bp, Oryza sativa
gccagcaggtggcggcggcccatcttcttccccatcctccgacgacggccacaaccggttgtggcggcgtctgcgttggcagcatacgggggcagcaggccacggcgcatcggcggcggcaggcggtggcggcggctgcgggcggtgttgcggtggccgcgacgggcggcacgcggcggcggcgtcggcaggcgactcgcgtgcgggggcgtcggcaggaggcagcctgggcgacggcggcggcctgtgcggcggcgcttgcgcaacggcttgggaggcggcggagatgtgtgggcttcccggcggcggtggctcgtgggctgaccggctgcggcggcaacgtcaaggcgacgcctagaaggtgttcgatgaaatggcgacaaaggatgtagaaatgtggagctgagtaatctagccaaacacttttttacctacctcagctcctagaggagctagctctcaccggagttggagtttggagttgggagttggagttaggagctctaccaaacggggcctaaagttaagtccctgatccaaacaccacctaatataccaacttaataattctaaaatgaggctgttttctgtcgagcatgcacgtcattgaccagaccagatgcaggtcaagcgtcaaaagtcattttatctgtgcttggtcatcattttcctttgatttcatttcaacggagtgtgtacatgcaagacaagaagtaacaagttgagataggccgacagcagtcacagcagcagacaagtcggctgagttcctttggacgagatgggaaccaatctgctcacagtccattagcacgtgattaattaagtattagctatttttaaaaaaaatggatcaatatgatttttttaagcaactttcatatagaaactttttgaaaaaaacatatcgtttagcggtttaaaaacgtgcgcgcggaattcgagagagagtagttgagaacatcgtgtgccgaacacagcaaactcactttggaacaagaaaaaaccaagggatactaagaatttttatcaaaaataatcatacagaaccctctaaaataaagaattggttactacccatttttaaaaaaattcctatgaaatagactattctaatgatttttttaaaaaaaaagtatgaggtctcacctcatatttttctctgcatgtgtcagactttctgtgttttttgtgtgctaatcgaatgatagttttgaaactttcatatgtttcataatctcaatgagtaggacattctattcctactttttttttctatttctatctttctttcaatcctacgtttcaaaggggcgaatatataatggtaggccatgctaccaacggatgaaagtattaatctagtcgttgtatttgaatcagaggttagcttgagcacgcataacgagatgagcaattagctcattaactatttaaaacttgaaaaatatatttaatttgtttttaaaaacttctatttgtatttttttataaaacacaatgtttagtagctcagaaaatatgctccctaagcatgataaattagctatgccattaacatgattagaactaagcgtaacaccttacaggtttacaccaacaaatattgaaggaggccgttcaaacatgatactccatcttatacagcatagatatatatttaaggtgtatatgatgaaactattttatatctttggtaagcgaaacacagttgtagtggaggcgtgagtgaataactccatccaccaaattaaatcctattgtcaattaatatatttgtgtattctcatattacagaaccagaagttatactttcattgtacataaaagggaaacatcacatctatttttttaattttaatgccatgttagtgtagtactgctcacaaagtcacaagttaggtcaattacctaggactatgcattgtgaagtacagagaatgtatgtaattgagaggtcatgtccttcgatattgtaataactctgtttaattaacaaaaatccccctcccaaagaaaattttcttctgagaaagaggtaatagaacaaaacaggtcagtatataccatggatgaaaggaagcctcagtagagattttttactccctggttaacaccaacagccatttcagcacaatagatcacgatttagaaagggtagaggcctttcatgttaagaagagccactatatacaaaatgttcagaccagaatggagatatatccacaaaatcgaatgggcacatagtttcacacccattccatccccattcacaagtccgaacccttaaaacattggatcatttcccctaaaatgctagcaagtctccagggaacaaaatatgaactgtacaacatcctgcaaactcatgatcaagacttctcatgtaaacagcatcttcagttgctcgatacgagcggagcggacttcatcgtcggtcagcgccccagagatcatcctctgcttgcacgcttgcaccttctgcatccgctcctcgaccgtatcctggaatccagacagaatgtgtttttatttttgctgtgctttctggcaaaagtgagcagatgttgtgactgggattgtcaatgtccttaccttgacgatgaagcgccttacttggaccgctctcttttgcccgatacggtgaattcgcatgatagcttgttcttccactgcaggattccaccatgggtcctatatgaatgcaaaaaaaaaaaaaagttgatgtgaccatttaggttagaaagttggtgcaagaataagtatttgcaggtcattggattgacagtgtatagttcaattaccattaggaacacattggaggcagcagtcaaattaagtccaacacctccagccttgagtgacataagtagcacctaattttcaggaaaaaggattttcagaatatgtgatgcttcaagaatcaaacgttgcagaaagtaaagcaagagtacaactagaaatgtatgtgcataccagcttgtccttgctttcactgaactccttcagaaccttttctctgtgtttctggctgagcttcccatcaaacctcaagaatttgatccctttctgattgaagggaacctcaagaagatcgaagaaggaagtgaactgactgaacacaatgctcttctccctcttctcctgaaggccctccaggatcttgatgagttttatcaccttacatgagtccttccagttattctcagggtcaacctggaatcgacactgactaggcaatgtgatcagctcagatttggtaatggggcttcggcaaagtgggcatggtcctccagaaggcgtcctccagctagagagcaggcactcacggcacatccggtgcgcgcatggtgtgagcactggatcatcagaagctgattcaaggcagattggacactcagtagttgcgccctggcggatttcttcaacaacctcttctacatacgcctgtgaaggtggcgcactgcgtctcgcggaatcacgttgcaccccatcaaggaacctctgtgctagctcatcgaggtcagtatacttctgagtatcagctcgactgcatatttagaatttaacaggagttagaaatgacatgatgaaaatgtaagggagcatatttctttgcaatccatgtctaacctgatcactagaaaagggtggtcgcagcactgccttagccgaaggagtaactcaagaatattagcgtagttgttaagaacactgccttgtgctacaaatttatcaaattgaacctgttgggagtaccattttgtgttagacaaaaacaaatctcagccatgaacattaagaactatgggaacaatggtccaaagaacaattcagtgaaggttccaatttcttatattaacccaaagtcctgaacaagaaaatttaaaacaaagatacctttgatctcctgaaaagcgcttcatagaaatcgcgttcatcttcagattgttcgcactccacaatctcaatattagctggtgggaggactagtatgggactggaaacaagcatttaattgttgtgagcaacagtacttccaagagctaaggcatggcagatgataattgatgcagtttattgtgttgacaaagtaacaaaataataaaatgcgtactttcccattttgtcttttgtttccttcgttctcctcagcatgagtggcctcagaatagctctgacaagtttcaatcccctctcatcaccattctcataaggtctttgaatcagcttattccaccttttgaaatcaaaacagcttgagtcagattttcaatcccaataacacatcggattagattttatgtagccagaaaatgttcgtaccaacttgcgtcaccccatggttctacatgtaggaagcaaagaagactgaaaaggtcctccaaattattctgcagcaaatgtgatacggataagttagcttactagaaactacaaaactattcatcaatgcttcaaattctggcagttcaacaggaagtattaaaataacaaatggcaatggttgcaaactcacctgcaatggtgtacccgtaaggcaccatctgcaatgagaagttaattcataagctgctcgtgctgctttggttctgggagatttgatcgtatgtgcttcatcgagcacaactctataccaatctatcctgtgaaagatactgctgccatcctgtaaatagtaccatttttcgttagttaaaatataatgaccacttcttgcaaaaaaagctatgaccattacactgtagagaaggccacagtccaaactcttacattcttgtgagctgattgaagaacaccataggttgtcaagacaacactatgctgagccatgaatctcaggtcagtggttctgtcgccaccatagtagacaaacacagaaagagctcctggtgttgaatgtgcctccaattcatcctgcaaagggcaatgatcacattactagtcttgcaaatcaaaagttcctagcagaaactagaaaaaggatcaaacaagctgcttgaaaatgcaaggctggaaaaaatgaagacaaaagaaagacaaacctaaaaggttcccctttcaattgttctcaagttgaaagcaagcaaaataaaatacaactataaaaccggaaaagtacaatataatggtaagcatagatataatttcttaccttccactggcctagcaatgccattggacagattataagtgtgcctcctcttacagaggatctcgaagtttgtgccttggtgtcacgatctctagtacccctcttatcttgttctaactccccccttgggtttgatagtattagagcaatagtcatgacagttttaccaagacccattgcatccgctagtatctgcaaagcaagagatgacacatatagcaccatcagattaggcagatgcaaatattcatattctaacaaaaatttcccctgaaaaacatgcatatatacaacttcctcagaaaaaagtgcggaaagtgagaaagcattgcaaaagcaaccatttcttcaaagtttgtaaaccccagcaaccattgcagtgttcatcaagcatgcaaaagcaaccatttcatttgtttatattaaagttctagtggtaatattaaaaaagcatataatgctgcattgggcaatctaatgagactacaaaacaaatcagggaaagcagaacactaccatctagaattgtcattaaaaaaataatactgtctatgtacagcctaaacaaggtacaatgcgtatacgagtgacccttaaaacaaaacaaacttacccctcctcttgctgactgagttacactttgaaactgggttgttgcctcgccagtgaaaacattgacatacactgcaggagctctcctggaaacaaacattacaacttgtgaatatttagttctggacattttcctaattaacatttcgatgcaactatgcaaatgaaactgaaggaacatacttgtcgacgattttgtaggcactccaacagggatgaagggtttttttggcttgatcaccatcaatacccttctccaattgagacatccagaacagagcttccttctggtatggttttagaacggagacaagagtgcttgggggctctgcttcctgtattccacagattgtttaaaatcataacattgttcatatacaaacattccgatagtgcagagtggcaatcaaatagaggtcttgttcttacctccaagtcatatgtttcagcagtgccaacaattttgtttaatgcagcctctgaaatagcttgctcatcagtgccttgctcaggaaatgtttggccagctgtgcgtcggttttccaatccaactatagccatgggttcatcttcatcattgtcatcaccctagttcatgtatccaaaacaaaaagatcaacaaaaagcacataactcggaaaaagatattacatgctagcagaaattatcacggtaacaattcataaagtaatttagatcaatgccacaacgaagtacattttgttttagcaatcaattaagtatatttaatcaaaggcttgctcttctgtactacatgctacagagacatacgattgaacaaataatcacagttcacgattggcaagagaaattgaagctcacccttagattccgcggtctctttcctgcagcaagctcctcaggagtgatatcagcctgcccatgacacaagcattagcatatacaatcatcaggatcaagagcactacaagaactgaagagtttcagggaattgacatgagtgctaccttggtgaatgcccttagcttgagcaatctgaacagcctgtaaagagggttagtggaataatcaacatttgcaggagcaagcaggtcccatgatgagttgttgccgcttgcggtgaatacagaacggtggatgtagaagctgcagaaaaggaaaaaaaaaaaacattaccatcaacaatttaacacaaatcatcacaatgacacaatacacaaactaaaaaaaagaagaaaagcaaacatgcataatcaaccattacctaacatacaacaaaatctcctgcatcaatctcaattccaccgtgggaaacacaatcttcccctgaatcttcaccttggatgagcttaccagtggcacgaggcacttggtccattctgtagatagcttcccaatctacaataacaatgaaaaataacagaaattaatacaatttctcacaaataaatcaaccattaccaacaacattattagaaatgaaatgatagcatcacaagagcagcaaacctctccagctcgattggtggagaagcgcacgatctccgccaaagcagccgccttcttgttcgacaccttgatcccaccataggtcctctccaatgaggggaacgagaaatggacgagctcgccggcgtccagcctccgcctcccgcggttggtggacaggccggtgacgtacgacctgccgacgaggaaccagtcgcgctcctcggggaactcgccgaactcggcatcaggcggcgccaccaccatcctcagatcactcgacggcggaggcggcctggcacgcacacgccgcgactcgagcatctccatggcctccggtggcggcaccgcccggatcggcctcgggttcaggtacggcaccgggtgggtcgccgtgaggtcgatggtgtccgcctcgtcgtgcacgcgagacctcttcttcggcctcggcaccaggcttatgccggcggcgttcgccgtcgccgcgcctcgcttggccgcgacgccgtcttcctccttgacccgatccggcatcggaggcggcgctttgacgagcagctcgtcctcccgctccttcttgaccctcgcggagcagccgttcgattcttggctccccaggggctcgtcgtcgaggacctcaaccttcaccggaggcggcggcggcttcggggcggcgccaccagcgtcgcgttccgccttcaccggaggagcagccgtcttggcacctttacccttcttgggctcgggtttgtcctcgacgccggcggtggcgtcatcgaggagcgcgttgatggcgcgctcggcgttgcctccgcagcgggagattgcggcgacgacgcgggcctcggggaggcccgcgccaagaaccgcgcggacggcggcgatctcgtcggcgtagagcacctcctgggacggcgactccggccagtcgccgtgcatgtcgtcgccgccggcgagaacaacggaggcgggtggatggaggaagggattgaggcggaggcggaggaggaggaggagaggattggggatggagaaatggcggggactcgagatgggtggtgggttttaaaggaggtttttcgcgggaagagaagaggagggaacccggaaatgtttttggcgcgagaggcaaatttttaccgcggttttttgagggagtaaatgggtgggagattggaaatgacagcggcgttggaaattgcactgctcggcctcggtccatgcgttggagtggactggatttgtcacaaatctgttcgaatttctgttgaatttttatcgcccaaatttagagcttcccctcacaaaaccgcccagtttatttttgattttgaaccaaactcacaaaatattgtgaaactcgttatctcgtcttgggtgttgttttctgccacgttgggtgggtgaattcaggttgttacatgttcttaactataaaaaaaatattgaaaaataaactacgataaaaaataatcccaaaatctaatccaaatttaatgttgaaaatttcaatttttgctgataaatagtataagcataagctaaaaatgaggccaaatgtctttagtgcgcgtgcgaaactattagtaatttatttgtctttagacctttacacatgttgttaaggatatccaggtagcacatgtgcatcttattatcatagtgtcattcagattccagttgactggctacttggttagtttaggactttaggtcagcggatcattgtcacgttgacttctcgtctgaccagtgaccacaaagggaaagaataataagggcatgtgtaaaaaatacaggaatataataggaatgcatgtgtaaaaaagatgattgaaaaatgtagaaaatttgtatgagttgatgttcggatggagtataccaaaaacacaggaatttttgttagataaattgaggccgttagaacaaaacacaggaattctcaagctaacgagctattctcagttgtccccatgcttggatgatgtgattagcagcttccccaagcgaaggaaatcaaaaaaatgagctgtgagtagatgggaactttcctgtgtttctgccatcaaatccgtagcaaaggaatattgcctttagtattcctatgactcgttccagggatgatccaaatgcggatagcctgatacagtgattcaatccatatgaatcaaaatcctacacttattatccttcattccaaaggaggcctaatacttgtacatgttcttgtgcaccgcctagcatatccagaaacatgaccacggtggattaacaatgagatactccctccgtccctaaatataagggatt

SEQ ID NO: 17876 - DNA, 14431 bp, Oryza sativa
atcccttatatttagggacagagggagtactatttaaagataaattagcatctttcggctgataaactgatgtatgaagaaataagtgtgtaaacatgttcacaatgaatccaaacgtaccgagaggtatattgggcaaagctcttctgaaaatgaagatccacttcaactttttctgagcggttggttcagatccaatccaacaaaccaggatggaccccaaaattccagttagagagttgttgccgaaggagcacccaggccatgatgccgttccaaacttactttgagaagaagaattggacacaataatcgaatgaagaatcccatggtttccatatcaaacttgctgatgcaggattgatcatctcccaaattgcacatggtatgcagaattgcagactgtatccccaaaggcattccacttccatctgactgtatcctcgaattgatccgccaaggacaagggtactttgcaaaagcagtttccaaatgctgagatatacggtcagaagattacttgagagatcatgtcaaatgtcttccacccgttgctcatttcgcatcgcacaaaagaccatactgttcttccttttttgagtgtttgtatggatttggctccaagcttttgaatggtcgcagtccggtccaatttgattgcaaaaagattgccttgtgactacaatgacaacatctgtgggtgcagcaaatagagcttggcttgtgtgattgtgtcattgcaaggagtcgatgaacctactgatgggttgtttcgagcacctcattcataccactaggccaagtggatctggagagctctagcaaatttctccaaatatggtacttgaagtcctccaaattccatacatgagcatgccttctgccaattcactttacattttccaccatgaacctcctcatcctcagccaataaaagtgccttctatccttgctgactttccggaatatggccaagacatgggccaaggaaggcaaaaactctacttttgccaacagccaagttaatacaattctaagaatgcgtgaaaaaaatggcatgacacctgctcaatgtgaccatctagccatgcagtcaagtttacatgtctgtctgtttaccagagtcaggcgaacaagcagagcaactcaggtgaggatcatcaaacagaaaagatactatacatagccctcaagcagcatgcatccatttacctccttgtgctccacatccttcagtggaaatgactagctcccaccaaacgccaggtgacctggccctttgaggctttttttagagaaaaggccgaaacgaccctgcttactgcttatatagaaagcaaaatttgtccttgctggggtttccagcttacatcaaagtgcatacatcaaccaaaggggacccctccggcccaactcaacaggtttagacaagagcgtatacagcagacatagcagacccctccaacaaagtaccagaccgtaagaaactctaactaacccaccccagttctagcatttcgcagttcagcacagcagtcctttagtcttcttgtcagcaactccagttcatcagtctccgcaactttgaagagtggcctccactgcattaacaaagaagtgatttggaaagggagtattagtggggagtaggttattttatcacgaaaaaccatgttatttctggtaatccaaagagtccaacaaacagcagcaagcagcgccaatttaacattcatgtgtttgaaaacagttctgagctgagctaaacagaaaaaatcatcgaagttgacaggtatccggtcccaacccagcacatctctacacaaacaccaaacaaaagtagccatagggcatctgaaaatgatatgttttgttgtctctggctccccacagagtaaacacaggactgaaccactccaacccttttttgctaaattagctgaggcttgaattctatctctcaaacctaaccagatgaagtgtttaatctttagagggcaaggagcactccaaagctgttgtaattgggtgtctatcatccccctgaaagttaaaactctgtaaagggactgggtagtgaaggttttattatcctttagagcccatctcaaagtatcataagtctggctagtgctaatgttctcaattatgactctcagctcttcccattcatccatctctcttgggccaaaagatctcctaaaagacagcccctctatcccagcctgtttgatttcagccactagtatagattgttgattgcaaatctcaaaaagtaaggggaaagatgtttttaaaggacaagggtgaacccagacatccttccaaaataaaatgtgtctaccatctcccactagccattctgttcccagtttcacccaatctctagtgcttagcactcccttccagaattgggagccctcctcagctctgcactggaacactccaccctcttgaaggtatttgttccttaggagggaagtacacagactttgatccggagattctagtttgaaaatccattttgccaacaaagcaatgttcatagctctagtttcagtaaagcccaaacctccaaagtcttttgggaaagccatatcctcccatttcaccatatggtatttcccatttattttgtttccagcccaataatatctccctctaaccgaatcaaatttgtggtgaacaccctcagggagggaataaaagcccatagcatatgaaggaattgaagataagcaggcattaatttgaatagctcttccagcatgggataggttacccatccatgttcccagtcttttttctaacttctgccctttgaggctttggtcactgtccagataggcaggagctccacaacaaccttctgtaccagcttctcctcctgaaagtttttcagaagatatgcaaagtctcctccagcctccctaaaatccaccaacacactacatagccctcgctgggcgagaatttcaagaatgaactccaagctcatccgatcaaggactaaaacttcaactcctggtggcttcacggtgacaggactgtcagtcagaactactgcctcagatgcgcattcttctctgagaaactgaatatttaattgggaatttcctccctgtgctatgatgatataaagaggctgctttgcaccagcttcatgggatgtaggcaaggtagtcatattgaccgaaatgcctgaaattatgactccatcatattctttcagtaactgtgagtaataccctccgggttgatcagctccagtcccaatttgatttacgacgactccattcacagagagcgtagttctgttattcatgtggcagacaaaccatcaccgaattgcacactgtatttcaaatgaaagggaaaaaaacagcatgatatgtcgtggaacagaagatgacaattattgcactaacatagcttaatcagttagcatcctaaatttggccaaaccacattgtagaagaactatcgcggtagatatgtaacattgtttgcttgcaaaaattagctacaatataatacgcgttagcagatccataattgcaaaccatgtgtactgccattacctaattaaataagtgcctcaagaaaaagaaaaagaaataggaatatggttgcatatttacctcaaagttgcaaaggccttcccagtaagcatgcaatggatataagcctcatttaggttgcggcataacgcttcttcctccatacacaccctgacatcaatcccagcactttggagcctttcaatccccttggatgccacaataggatttggatcagtcatcccaaccacgacatccttaagtttggcattgatgagtgcttcggtgcagggaggtgtcctcccgtaatggttgcagggctccaagctcacataagccgtcgcattctctgctaaatccctagcatctctcagagcaaatacctgcggttggtaacactactatgttagtatactagtatcaacttcgttataaatcagcattaagttttctaagtaccaaacggacatttttcttttccataatcatacactgtgcactggtttttacaatacagagctgcaatttcgctcgttgtattaatatctactaattccttaattttttcatacacacatcttacaatgttacagatggtgtggcaaaaatcaagattaggcacaatattctatcacacattgtgcgtgatgattccatctggattgaacggatgtgaaaaatctcgacattcttaatcttgcacgaagcaacactaattaatgaataataatgatataaaaaaaagccattctattattcatgtaccaaactctaaaatgagagttcgagaaaggggaggcaacctcggcgtggggctggccggcttcggggtggaacccctcgccgacgacgcggccgccgcggacaacaacgcagcccaccatgggattcgggctggtgtggccggccgccttgcgcgccagctccacgcaccagcggatgtagaccccgtcgtcgtccatgtcggcgcaggccagccgcggcgcacccgaccgggaggcgcgagcggcgaagggaggtggaggtggaggcggcggggcgcggggtgaggtggtggcggcgcgagagcgagacgggcgaggaggccatggccgcggcgccgaggaggagaggacgccgttggaagtcgccgcttccggcgaagggacgggcggacgggggtggcgccgcggcggaagcaaaaaaagaaaaattacgagacctgccatttcgttgatctcctcctctcttgtaatgacacgtggcgtttcacaatcttaaagcaaaacgccaacctaagagcaagtacagtaacgggctacaaatcggtaataaccacacccacacggggttaccggtgaaaaatcacgcactcgattgtcgatttccttccacgcgcaaatcaatcgccatcccttttccttcgcaaccttcctccgcacatcgccccatctgcctcctctgctcgccgcaccaactcgtcctagcgccatcaccgattcacctccagctgccgccaatccgcgctcgcctcaccgtagatcacgtcaccgtccgttatccaccgagacttcattaggtcatcgtcacaccacctcacccctatccccgccagtctccgtcgcgccgtccggtccgtgggctcgctctcacaccaacaccgtttcctataccggccctcacgtccggtctccatagctctatggcaagtttgcttctgctgtccagtttcagtttcttctccctcccagttcattattttcttttgcctatttgattttggctacgatgaacgagagcaaaactattttgtcctgcacaggagatgttcgattgagtgccgcataaacaatcgccaacactcttagtcaaacattttgttgtcgatggtaggacaattttaagggcatgtttagtaggtgaaatgaaaatttttgagtgtcacatctgacgtttaaccggatgtcggaaggggtttttagacacgaatgaaaaaactatgcaattagtttttctttttatctatatttaatgttccatacatgtgtctaaagattcgatatggtatttttgcaaaaagttactggggaatttaaacagggcctaagtgtccgccaccagtgatgtgcactagggttcccgatcttccaaaatgttctgataaacaacaatttgggcggagtcgcaacacaaatcgatccggcttcttgaacgcacacgctcttgagccccgcaatcgcagcaccacgtctcttctggttatcacccatgtcgaaacgcggatgacctcgccgagaaggctaatccctgtttgccaatcgaagaacacaaacaagaacgagatagaaaacaagcaaaattgcacatgaatgattaagctcacgagttggggtcttacaaaccgatctagcggtgaaactgttctcgacatattaatctaagcaaaacccaaaaacctaaagatggcggcgggtactgatatatagagtttagggtcatgcaaccccctctcgacacaaccctaatgggttccaacacgataaataggccaaaggcccaaatacggtgacgcagcaccgggacagattctggacgtcaacttattcggtcaattcccattgactcggaaagaatttggacgtgcgaccaaaaccaatggaaatgttatcttcttagctttccatccatataaaaaacgccccaatccgagcacgtatacgacctggcgcccgttttagtgtagactggtcctagactccgaattacacccgacgtcgacttggtttgggcctccaccttgacttggacatccttgatgatcctccatggctctaagtccttctccaagtgtctccttgttccctccattgtttctaatcataatataatcattatgtagcaatctagtctcgaattcatacaaagaggaacataagaacgagctcacctctaaatttaattgtcgcgtacgagctcttgttatcggtctttgaatgaccgttggaagattgttgtgtgtatccgaggtagtgatgtccacatcatccagaatgttaggtcaaccaatttctatgaggaatttgtcaacaaataaaaaaactccaatttagtctgcattacttgtgttgagcatgtttatatctcataaatgcagacccgcaagaggtttgctctgattgtgacaacacgtcagtaagcaaggatgataataaaataaaaataaaagcctgataagttccttgtgttttcatgaaagtattttttaaccaatataaggatctagccagatgcaccaagatgaataactaactttctaggcagcagatctggtacacacaaaagagatggttagcaaaaattgttcagagaaacataaagtttgcaattttgcccctgtgtttttttaaatgaagaggagttttgccgctggcttggatggctggtttttccacaggaatccggcactcccctcccctctgctggtgggcgaggaccgaggagtatatcgatcgcctcggattcgcacggcgtcacctgatccacaaatcacggctaggcggttttaatttcctagctaattgcgttggtaccattgcaaacaccagaacgtgatcaccacctgcaattctgcatgcccattgcatgcaagccgctagcaacaacctacaaagaacaaccagctggaggacgcaaaagctctcgtacgtctcgtttggcgcaagaaacgcatatatacgcacagctagcacacataaaggtctacgaaaacatggggggcgacgcaactgcgatcaaactgcaatcaggtctctctctcatgcgtcccagctgctacttctgctagctcgctccaatccgcgtatgtcgtcgagcccgcgcgggttagcacgccgatgggggagttggagacggtatcgtactcgctggaacccctctttttaattagtaccataccgtgaatttttattgtgttgaagccacataaaagagggcgtatctcaatcttagctgcctggtctggtagtgcggacttgtaaccccatgctttggggggcatggagttggcaattgtgctagtcgtttcctagtaacaaccaaatctaaaagtcccttaataagggagacaccctcattttaagggagcctgcaagggttcgaccccacacaaagtaaaaaatgtgctggcgtcgtaaatggtttggaattgtggcagcaagtcagcccgcccaaactggatttcggcctcctagctagagaaaacgtacccagcctcttggtcaactccacatttttttcttctctctgtcattcataaacttcttgggtttttttaatgtcttcaccagcaagctaacccgctcaagaaaatgtcaactccacattttttccttctctctgtcatttataaatttcttgggtttttttaatgtcttcaccagcaagctaacccgctcaatatgtcattcataaactttttgggtttttttaatgccttcaccagctagctaacccgctcaagaaaatgtcaactccacattttttccttctctctgtcatttataaacttcttgggtttttttaatgtcttcaccagctagctaacccgctcaatctatcattcataaactttttgggtttttttaatgtcttcacgagctagctaacccgctcaagaaaatgtacccagcctcttgtccacactgcattttcttttcttgactagctgtcattcttggatttcttaggtttttttaatgtcttcactatctagctatctttcttgggatttgttttgccgccttcgctagttgttgttagggatttaatcacttaggtttttttaatgtgttcactagctagctgtggttcataaatttcttggggtatgttttgccgtcttcactagttatagtcaaggatttaaatttcggtttgaaatttcaccgataagcagatatctcaacctgaaattctcggccaaaaagaaggaagagaacgaaaggagaacagaactcggggcagggttgcgtgtgcgagccaagtggcgtaggtgcatttaccaacaccaaaaatttggtgaaggccaaatggtgatagcgctcacctgatacttggactcgaaggggagcaggtagtgtctagagattttttttttcttttctgccttattcactcaattcatttcatgttgatagctagttcgcgtggacgaatgaggtaattcctctccatatagtggcacatcactagcctttccttagggcctatacggcaagagaagggaaagtgaatgggagtttgaaggaggggattgatggtaggattggtcatgagagttacatttttagtccccatccttggttttgttttcgcgtcgaattccctccgagtcgcacgaattaacatgcccttggtaagggatcggtgagagttggaccccttaattccctatcccaaaccctctcaaattcccatgtcttccaaccaaattacaggcttaaactctcagataacctaaactcccattccctatcaccaactccctccaaccaaacaggtgatgtgcgcaagggtgtcccgatctttcgatgagagggataagacgattggatggagcgacgttggcgatacgactacaactatccagggatgttgtgccttagcaatcgttacaccaactccagaggtggtcgtgaatcttgacggatgcacaatcacccaaccacgagggtatttgttcctgcaagcaatcgagaaccagcaagaacaagatgaataagcaactcaatttgcgaatcaaagatattggaatgaatcaacaacagtaacaagtggggttcagtaacaagcaattcggcgatctaatcgatcacgagatcaactcagcaaagtagcgacgctatactttgatctaaacaaaaccaaagtgttcttggcagtggctagaggtataagaagaagggaagaacgaccacagggtcgtgctcaaaccctaggacgtgcccctaatgggcccaacttgatacacaatccattgggccaaaagaggtgacgcagcaccatggacagaaaatagtcgggagtaaaataaaaattgcggccgctccagaatagatatggacatgtggctagatccatttgaaagtagacctgataagctttccatgaagtacttgcatgcacaaatcggagttcgcatgaagtcctggcggccgtcagaagttagcgttgtcctgcagtccgaatccaccccgcgcgaatcctctcccctttggatcctctccatcgttcctaagtaaaacaagagtgcacacgtctccggggtataaagaagaggaacatgaactcaagaaagaactcacctgatagttaagttgacgtgtacgaacgcgggtaataggaccatgaagttgtacttgtggggacgtggatgtatcgatggtgttgatgtcctcaacaggttgttagggttgggaactttttgtgacaagttgacaagcacgatcgcaacacttaaacgccttgcggtgatatggagtcgccaaccacctcggtctagccaaaaggccaaatcaagatgggtttttgtagaaaacggctaaaccggctagtgaagctgatttagagatcaaaatcagcctctaggccaatttagatcgatatgagataactatccatctcgtgggcaaaatggaaggttttcaggacaaacctacaaagaggtgtcgcactctcgtggcggcggcggactatttacggcgcaaatcgacaaagatggactaaaactatgataaaatagaaaatatggctaaaaagtaaaggtaaaagaaaaagcgattcaagtggattgtatgttcggggattacaattgaaccggccttatcccttaaataggggttggttttgccctctacaggccctcctccacatccaactcagaatagaaaccaaaggaaacccgaaaatacctttccaagcaagaaaacccaagacccgatgaaaatagactcgggctcgaaccctgacggtctgcccggccacataattgcggtcagaccggagttcaggccgcagtcagaccgcccatataccggcggtctgactggccctgacggagcgtggggctcctcaccgggagaccgcgcaggcccccctttgccggttcggccggggactcagggtgagattctaagctctctgtatgtggaaggttcgcgagacaggaaacacacaagacacgggcgatgtatacaggttcgggccgctgagaagcgtaacaccctactcctgtgttttgggagatctgtgtatgaaggagctacaaagtatgagccagcctctcccttgttctgggttccccctctcccccaaaagtccagtcccagtgggcaaggtcctccttttatatcttaaggggataccacatgcaccatttctctcttttttgtggggacttaccccaccttttcataaatggacggagatttgtatagttgccgtccgagtcaccttctgatgagacggcccacaactacctccactttcgctgggagcagatgcgacgtggaatcgtggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctggcatatatctgaccaggactaacgtgccatctctgggaggtaacacgctagctccagctggggacgtgtcacatcctgatttttgtttcaggatttataaattatttaataaattattattagaatttatattaaatgttcattaatttacaagtgaagttaaatgtgggaaataaaatttcctaaatttaaagcatggatggatttaatttttattaaattctccatggttaattatactctctggaatattctcggatttttcgaagctcaattcctaatttttaatcttacaaagagtatttcagtaattacccacatattaaattaatcattaaatggtctaattgtaatttttttaagtactttgagtgtccaagtattttcaggatttttcttgaaattatttgagcattggaagtatttttaacaattcaaagatcatttcattgattaatttaattggaaaagtaataataatcctcttcctagtcttgggccctttccagcccatctccctcttttgtgtgcacggccgtgcagcccaagtcagcccagccgagctcccccccttctctttctttctttgctttgttttcagccagcccaagacaaaaagtctaatttgcctccctcgacactgtttatcttctacctcaagcagccgaactgagaccgatttggctcggttttttctcctccaaatctgacctttccccttgtgtttttctaaaattagttgaggggaaatattcctcttatcctcctctatctttaaccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgaggtcatcatgatgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactatttatttggtttttattagtctttttctttgttttgcgtgttagcttgtcgtttccgtcgttgcgaaggttcgtgagtgcgtcaggagtgttcagaagattaattgaagaccgattattgcaaggcaagtcacacagatcctaaacacaataatcctttgagcatgttgatcctatatttaaattctctatttatttcaactgtgcatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggtcaatcgtgattggttaattaattacttgccaactaaaacttgataatggtgggttgtgagcatatggttttgagagtcgtgctcatgacaattaaggaccggttcgcgagctactgttgtgagacatttaccgtgccaaccacaagccagcgtgggcaacggctttatcttttgtatagcgtgattcattatagtgcgccagactgagaagtggcgagaagtccacgggggtcgctggggagtccatgcctctggtttttgagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgtggttatgggcgagttgagcaatgtttttcgtgattagtctcacacctctcacaataattatggatgttataactggtaataatttgcttagctcctggtttggagttagatctgtacagccgggtatggttgttcaggatggttgggcctgtgtagcatgggtgtgctgttcagtgttgattaaaatttttaattaattactctactgttttactactcttaactctttgctaaatgctgctttcgcaaatgagcctatattatgccatcctttggtatccttgtgcacttgcatatttgctgtgtggcttgttgagtatgtcacatgctcattcttgcaataatcatcaaacctcagttgaagataaaggatccagaaggagaagacgtttggcttataccccagttgagctgcctgtgggagtggagctgaagccatcgctagaccgttaattccgctgctgttttcttttcttttgtaagtgtgtaacgttattattatgatggatttgtatattaaattgtcagtttgtgtacctcggctgattcctggacgaggattttatgcacaaataagttcggaaattactagtgaatttccgggcgtgacaggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgttcagccaaaccgcaataaatatggttaggg

SEQ ID NO: 17877 - DNA, 4861 bp, Oryza sativa
ctcggcccttggggccgaggcgggtgcggcccgaccccctcggggggactaagaggagggcgaacacatcaccctcgggcccaacgtccctcgggggtgccaggccacgtgtgcgattgtgtctgcctcaaacctctagtcatgatactcctgatcccatgtcaccgacagtagcccccggcgttatgccagggcgatcgccctctttaagggaagcggtcgggcgtgacgccactcctaaggcctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctggagatatggtaacgtcgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcctgtgccctaccttcgccacacgcgctcgctcttaatcttctcttcctccggcgccatggcacggggctccgctctgctcgatggtagcgtgctgccgccttcccgcatcgtgagcgagaggcaggctgggctgccgcgccgcttcatgccggaatctgccaccggccgggagatagtcacgctgggcgagggacgcccggcgccagactacccagggcggtccgtcttctttctcccctttgcaatggcagggctggttccgccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcccaggggctcacaggggccatggtgtacggcgactacctccgtcgtcggattgcgccgctccagcgacgcgctcggggcgcctgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggccacgacggcgcaggcgggagccgcaggggggaacaatctaccccgagagggcgtcgtgcttctaggtctcgcgacaggggcccggggagcagccgccctgccgacgcccgggggaagaggaagcagggaggaacacctcccccatctcctccccgagggggcggggcggcgcgtgccagcagcaggcgcccggagggggccgcgcctacatcgcagcccgagggggagcgcaagaagaagcggccccgcaagatgggggagacagaaccatctcggggaaacctcatttcccctccaaagtggttgtttaaccgaccccctcgcaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcggatcgcctacgggaagctgaggaggccgcccaggaggccgcccgggctcgccaggccgaggaaaccgctcgggaggaggccgcccgagcccgccaggccggggaaaccgctcgggaggaggccggatttcgccaggacgaggcgatggcgacttccgaggcagcttgcgacgaggccgcgggcgcgtcgcttgggcccactccctcgggcgacgctcaggcgacaacttccggggtagctggcgacgaggctgcgggcgcgtcgcttgggcccactccctcgggcgacgctcaggaccaaccgggtccgggggacatccccgagtccggcacttccatcggcggcccgagccgcgtggcatcctctccaaggcggcttttccccacgccttctatcgccccactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccgcccagggggtgcttgacgctgccgctgcccgagaacagcgggcggcggagaccgaagcggcgtcccggcggcgcgaagaggcccttgaggcgcgcgccatggcgctagaagagcgcgcctgcgtcgtggagagggatctggcggaccgcgaggccgccgtcaccatccgggaagcaacgctggcggcgcacgaggctgcttgcgccgaagaagagttcacgctccgcctccgcgaggacgcactcaccgagcgggagcgagctctcgagggggccgaggccgcggcgcaacagctggcggatagcctgtccctccgcgaggcagcgcaggaggagcaggcgcgccgtaatctggaaggtgcccgcgccgagagggccgtactgaaccaacgggccgctgagctcgaggcgcgggtgaaggagctggacgcgagggcgcgcagcggcggggcggccacgagcgaaagcgacttagccgcccgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggcttcccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagctttgagggctcggcccctcggctcgcgttcgcccccaactccgacgaggagggcaatgccggtggtgcagacgacagtgacgacgaggccggcgatccgggcgcattgaattgagcccccagatcttcttttctttcttctaaggccttcgggcctcttttttgtatagatcaacttaatctgtaatcaaaaaatgaagaaatttttgtgttaatttcatcttgctgtgagtatgagatgaggatgatctgtgccgtggtccttttgtgtcttagcttggataagggcttgtgcccaggttctagtcctcaaaaggcgcgggtcggggctagtgcctggggagatccacatgtcgagactggccaggccgggaacgtggtgaccgagggttatgggtgacctgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttattgaaatattgaaaaaaaagaaataagaatgtgcacgtgtggcagcccccggccaaccctacacgcccgagggggtgcggggttggcccgagcccaaaacatgacactcgacccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcgtttggacgcggcgtaggacgaggtcgttgacgcagagtgtcgggcccgaacgtgacgctgatggtagcgccgcaggctctgctggtgggc

SEQ ID NO: 17878 - DNA, 6798 bp, Oryza sativa
aggtcatctctgcgaagctgattttgatcagccccgcaatacatggtagcccgaggagacctcagggtgagctcggatgggagaaccgcttccgccccgtagacaaggaagaaaggcgtttccccggttgctcggcttggtgtagttcggtttgcccagagcactgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcaatcgcgacatacagatactcaaacccgcccggggcccgcctaaacggtcccaggatatcgagtccccagacagcaaatggccacgaaagtggtatggtctgtagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacgggcctcgggggccggtcaggtgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccatcaaaatggcgctccatacgccgtacttggcgcacgtaggcgtccatctgcgggtcagagcaccggtactccttacagacttggttaacgaccagctgggagtcgcctaacaccaggaggcggcggatccccagtccagctgccactctgagtctggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtatgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtactctctcgattatgcaagatttgaccgagggggtgagacgtaactacagtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttgtcttctgtgctgatgacctcggggtcggaggataacaggggcggccttcccacagtggcttcggggccgtcctgggggtcgggggctcctggcgtcgtcggacaagcgggcaaagggccaactccggtcgtcaggggccttaggcctccgttcggctcgggggcctcttctccctgctctttcctaggtcgagtcagcacagggttagcctcggggtcaaagggcgataggtgcggccttcccacagtggccttagggccttcctgggggtcgggggctcctagcaccgtctgacaagcaggcagagggccaactccggtcgtcgggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcggggttggcctcaatgcctcgggcagagaccaagaaccctagaagcttgcccgcaggtacaccaaacacacacttatcggggtttagttttatgcgggcggagcggagactctcaaaagtttccgctagatctgagagtaacatttcctggttgcgcatctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccagatggatgacctcacggatgaatccggcctccagaagtcgcgccacctcctcgcggatgaaggcttgacgttccggggcctgccgccgcactttctgccggaccggccttgcacccggccgcacggcgagacggtgctcaatcaaccccctggggaccccgggcatatccgccggtctccatgcgaagacgtcagcgtttgcccgcaggaaggagacgagcgcgtcttcctatttgccgttcagaagaccaccgatccgtgtggtcttggacgggccgtcgcccaaggcaacctccttgaccgggacctcgtcgcctgtgatcatccgctgcctcggggtggcgggggcggaggcgccaagcctctcgtcgccaccctcggtcttggacgcagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcaatgtgacctaacggccacgtgtgccccggcgtcacaccgataattggctgggacggccggagcaccatccccggggccttgatggcgtcaaaggccgcaggggaaaggatgttgagggccgctcccccatcaatgaggacacgccccaacttcacgttgcaaacggtgggagaaaccaccatcgcaatctgccctccccgggcaacgcacggtgggtggtcggtctggtcgaaggtgagggcaacctctgaccaccgcgcccgacacgtcgcctcatgagtaggggtcgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattatcggaaggaaccgccggggatttgccctctcggcgctcctgcctcctctcctcctcccacttcctcgtccgctcagccaaacttttgactgcacggcagtccgcgaggtcgtgaagggaagtgttgtggacagtgcaccacttgccggttgggcgctccctgttgggagcgccggcctcgttctttttatctcccgcaggcctcccctttcgggtggcccgcgaagcgccctcgacggcgaggacatgaccctcgtcgtcggcatgggctgacctcttcttcttcctcctgtcacgccgccctatctgagcggcggatccgggggcggccgaagctaccacaccggaaccggaggggttccaagtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtgttgcggacttgacagaaccgctgaatgtacgagcgaagtgactcatcatcccttcgctgtactgcgtgcaactccgcttcctcacctgggcgcggatatgtgccttggaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgggcatccagttccccacgcagatcttcccgggtcggaggcgttgactaaggagtggcggccgaatggcgaacagcggctgccgctcgccgcgccctccgtcttgacgacgcggagccggtggtagcagcaccagaggccttggtggcggaggaccgcccaccagcatctaggcgctgccgtgcagtcatgaccaatttggccacatcgtccagccaacgttgggctagagactccgggtcatgggcgacgggcgggtgacgtaggagcgcgcccgcagcttggagcgcgccctggggcgtgctgccgtcgccgtatacgaggaggcgacgctccccatctcgccgcctttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaagaaaagcttggcgcacacgaaagagtgcgagagctcagaaaatccctcgcagagccccctacctggcgcgccagatgacggagcgtggggctcctcaccgggagaccgcgcaggcccccctttgccggttcggccggggactcagggtgagattctaagctctctgtatgtggaaggttcgcgagacaggaaatacacaagacacgggcgatgtatacaggttcgggccgctgagaagcgtaacaccctactcctgtgttttgggagatctgtgtatgaaggagctacaaagtatgagccagcctctcccttgttctgggttccccctctcccccaaaagtccagtcccagtgggcaaggtcctccttttatatcttaaggggataccacatgcaccatttctctcttttttgtggggacttaccccaccttttcataaatggacggagatttgtatagttgccgtccgagtcaccttctgatgagacggcccacaactacctccactttcgccgggagcagatgcgacgtggaatcatggctgtctgctgacgacatgaccggtgtcagaccagtcacgtcggtcattcttgtccaccacgtgtcagcttagcaatctacatgttcgcccttcttcacacaacatcttgcctgtaatggttaggatgaagcctgacatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgttcagccaaaccgcaataaatgtggttaggtga

SEQ ID NO: 17879 - DNA, 13180 bp, Oryza sativa
ttctaagtataatattgtttattaatgttgcataaaaccactaactcaatggcaagaagaagctgaagcggaagaggaggagcagaagaggagatgtgagttccagagcagccacggcggcgtcgagggatgagatcctctccaagattgtcaccgtcgccggtgacgggactgcccttctcccccccgaggcacgcaccgtcacggagtgctctctccatggcctcatcgccttcctcgtatcatacttctgcttcctctctcatcgacgcgtgttcgtccaggcaacccggccgacatcgatgccttcctcaccggctcattcgcgctcgcctctcatcttggcagcatcatctcatccgccacaagaatcattcagtcgcaagcctctctgttcaggatttgtgctgcttgtcaggattgctccagaagcagccactcaagctcaagaaatcggacgactaacccatggattttgttgctcaacggcttcatcgcttggacatggatgctagtactgacagtgtgccagcaaacagcaggttgaatgaatcactgcgaagtgttcttcttgacagaatcctcaatctttatctcaaggcactttctcggctaccaatggaagatttttgggctcctcatcacaggaccctgctcaaggcaggctacttgcttaggtccattgagccctgttagcaatatcatcgacaacaccatctggtatgactctttgttcctctcatcagagaatttcgaggtggatattgttggatagtcatagtataggaaggagagaaatactataaatattgacacgttgtattgaggcttgggggtcggtatatataggaatacatgtattggatcttaagtaaactcagagagatagagatggaaactaatcctatcctaccatagcaaaccttatacaatacgatcttgtctacatactctaacacccccccaccccgcagtacaagcgtgagccgtgcggacacttggattggagaagaaaccagcaaaaatgctcaatacggatgatagccctttgtaccatagtcgacgtagccgaagcgaaaagtgcgatggagccatggtcgatgaagctgtgcgtagagtagccatggtcggtgtagccgaagttgggaagctgatgttgaggtagccgagccatagaggtggtagagcgcgcaaggggcgccaaggagtagtcatggacgcaggggtgggcgtcgtggaccaaggtgcgtgaggacgctctgggagggtgcaagagattttgagaaaattgtttgtggggaatacaaactcacaaatccagctattatcaatagttggaagatgaatgataaccatctaggccttgtcactgatgactttatctatttggatgttgcctgggacgtcaagttgatccaatatatgaatcataccgcaagggtgatgaatcttgatgtgaatgaagaaatgaagcggataaaaccaatgggtattgtagaataaggttgtgttctttccccttctttcccaactcacaaacctcttttttcgtgagcacgttttttaaatttctaaacagtatttttttttcaaaagttttatgtagtaaagttgctgaaaaaattatattaatctattttttaagtttttaagctaatacttaattaatcaccattggcttttatcccgacggcgccctaacgtcgccagttggcgcttcgaaggaagaaaacaatacgagaccaccgatgtcgacgcgctgcaccagccagcgacgacgccgggttcataatcatcaaccctgcgggagctagcgctccatcccggggtcgtcgtctagatcaccttcctggcttcctctgctcattgccgcagctcggcgccggcgatgtccaagccgcgcgccaccggagcggctgcgtgagggtcactgtcctcgtccagcacacggtgaccaacgtgcgcgagcaacaccggagaggttgtgatcgagcttgaggtgacattggtgccaggagaattcagcttcggtcatgctgcctctcgcctgacggcccgtcgaagaaagtgcaatatgaatgagaaaaagaacaagcaattgcattgtgaacagctacaaatacatatgcagaaattgtattacaccaaagttttctagactggacctgccttatttctggtggtggcatgtgtgcatgaaaattatctcatggtatccatgaaaggaattgtttgtatattctaggacttgtgatagtaagacctagttcactcgcatataattgctgttgactggtgcagttcaaatcaactatcttatcggtgcacaaatgatggtaaaaaaaaaatctatcagattaaatgataaacatgcaccatgccaccatcagattaaatcataagaggaacaaatgatatgtcaagaataacggatgcaactcatgcacagcatacaatttcctgacctcacaaagcatgtctacacgatctcatggaggtgtatcctgatgcgacaatacgagttacagggttagtagattactgtgaaaatagatgttctacatgcaatgctacttctaactgaagggttagtacatccgggtcccttcttgatgaaccttctgctatatccaaaggtttccaccatgaagtgcactcaattcaccctacatcccatgacagtcttcataaaaattacctgtgaaaaaaaacaaatataagtaaatcttgtattggttaggaattcggttgtaaaaatattataaaaaaatatcgcagtttaaacttgtcatccctaaaaaaagcacttgtcaaaaatatctcctacaaaatcatgaagttaatttctgcatttttataaacctaatattggttttgtacaaatacagtggcagcaagagaatttctgaaggtcatatctttgcaaataattagaaggcttcaaaagaagccctcaagattggtttggaaattttagtcagtaaaagcaaatctattcaagctcaaaaaagagcaagaggacccatctcaggaggagcaactgcacacagcagtcaggacacaacctagctatttactagtgatctagtcttgtagctatcaataatcaccataatgagatctcatcattgtgttgtctcaactaattacatagttaaacagaaataattcttgaattatatcactgttggcgtaaataattaagaaacatgaacagaaatgaaatgtatacaaatttataatcaacgttgatcggaaaataaatccatgtcataagaaacatctagccaaatttctcgttggttcaatttagctagaattaaattaataagtagtcataaacaattaaaatggtactaatactatttctgaaaataaaaaaaaacttaaaattactgagagagagaacattgattttagcccggcccaaacttgtggcttctgctaggtacgtgcggcccatttggcggcgccctaccccaccgcggacagcaacagcgacgccctcccccaccatgagcaaaggcggtggcggcgccctcccacggcttcccacgggtggatccgatggcgatagcctctttgacgctccagtcgcctcccctatattccgcacccatgtgcgacgacctcctttaccgctacttctacgggtgcttctctctgagtctgagcgagaggcgattaaaatatgtcactacaaatatgtcattttagataaatgtcactactattcatgatatcggctgtatgccactggaatttggggaaattagaattgtgccactccgtcgagttttccgtcagaccccagacgtgggactcacatgtcagttccattttcttctatcctcgctcttctttcttccccatgtgcaattcaagttaacggactgataagagtatgagataaacattgattccggttgtaaaaaataatcggtacagaaaacaagaacaggagccaagcaaaaattatctcaagtctatccaccaacacaactcctgctttattatctcagctcctccctaccacgtgtcaaaaaaaaactcttatctctcttaccccttctctattctctctctaccttatctcctaccatccacactccacagccattctttcttctatcctttctcccttctcacaacacgcaggagcgatggcgtcctcggccttggcgagcagcaagccagcaacagcagcgatggcgttggcgagaaacaggtgcggtgtcctcgtcctccacgagcaacaggcaacaggagcggcggtggcgtcatgtcctttgcgagcagcgaacagtggcgtcggtgagcagtgggagcagctctgagcgggaggtgaagatggagatggtgggacgatcggaggggggaggcgctccggtcggccaccaggtccaccccgtcctcctcgttgtggcggcccccttccctggcgacgagcgtggttgcgggtggcggtgaggagcacgctcctccatccccctccttgtgatttcctttttgtgatgaatgttttaagagatttttttttgcagttttttcctccttttgattttccccttccttgtgattgaatctgtgatgaatcggtgaattttgatgaatcggctgtgaatctgtgagtgcaccctcctcgtggcacacggcagcgcgcagacaagccatgacggcctgagggcagcggcatgcttggcctcggatacgcagtggccccggtgatttaattcttgtgatttaattttttgggatgattttgattcattgttgttggatttgtgattttgtgattcagtttctctcgtttccatgcttcttggctcggatcggatttgatctcctgtatgcgcgtaccggacgggagcgacgcggtctcaatctcacggactgatgaaccaaaattttgggagaggatcgcacacagacgagtgaaaaaaattgcgcatacggacgaaaattaggtgacgaaaggaaaattaagaatattttaattagttaagataaatgatttaaaattggcactgtataccatgtttagaaaatgaattatatagcttagcgtttaagctgtatactagcggactgtcttgccaaacacggactagtgcacctgacaacctgcccactatgtgatcaagaggatgaaaccatcgagcacatccttgtctcatgcgtcttctctcagcaagtttggacctagattttcttgaagctgaccggtgctgcccctcaaccttcagtaactcgttttgctaaacagtcgtggaaagctgtcaaggatgttcctaaggagcaaaataagggggtgacttcattcattaccctagttgcttgcgaaatatggaaacagcgtaatgacttttgttttcaacggatcaattccaaacatcatggaggtgttgcaggcagtgtcaacagaagctaaggctatggtgcctggctggagctcttgcgctccaagttttcctttgtaggtcactaaccaaagggcactatttgcggatgtgttttgggaagggatcacgagcccttggttgtatgggtgatttgtttttccttcttaatgaaatgaagcacagctctcatgcgttttattaaaaaaaaaaaccagcctagcctttaacccgtgcatattttaactaaaatttctttagtgtcctttatatgctacaaaatcgactcaacaacttagtggttccaacaatcaaatctaaccaagataccatgctagagtcgtatatcggttcatgtgttaggaaagactgtatatttgtaatcagtacatttaccatacagttgtagatgtcatagatggatagatttttagttttacagattaatgtggggatatctagttttcggcctcaaaatttgtggtcgcttccaggagagcctccaattgttataaagaaatatatgatgtaactgtgaaacaaaatcatgctatcccttaaaaaggcagactaaaatttccacttaaaatttcctacatgatagctcaaatgtagattataagtttataactacagaattgaccaagaaataacataactgaggctctgagcatggaaatgacgacagggacaagtacatggcgctcaccagggtggagagatacctgttatgaattgtagtaacacattgcctgtgcctgaagaaaataagaatccctatattttctcccactccctatgtggacaccatttttagcccaatcttctctatgtatccaagcatcacgaccaatatcaagtacgcccaaaatctgtacaagttagggcttatgaatttgaaatataagagcgcaaaaagggggaaaataaaaaggagcaaaacaacactgcacacatttgcatgctttttacattaagaacatgtggcataaactggcaaaatataaagcacttaaataatttaaagatggatccacctatttagtgagcctctttaaatctattattctgaagtttccaattagatgacattattttatgttaagtaaattgctttcttgctttggatttcttcaattaccataatctgtcaaacttcaccaatgatttcaccaatatgcttatataagcaagcaaaagtatgttaagatacgtggcacaaaaacaaggggtatgtcaccttaacacctgaaaaacacttgttcaggatttgtaccaggttatcaactgaatattctttcagtggatttattctttggctcatgatgcacacaagtatgtagttaagatttgtctatttcccacctaaggggacattgacactccatttgagtttgccaatgtgtaacatcctttccaattaagtgctagatatatttgtatttctactagattgatactacattaccagttactacttttgtgaataataaataaagcatcatatgactataggaaggggaaatgaagtacataatcaaatagtgagattaacatatgatcatgttcattccaaaagttcccttaaaatgaaatgcatttgaacaataaggaaaatgtactgaaaatataaattatcatgtaatatgtaatgatttcattagtttgtcttacaagaaataggagaacaccagactgaagatagatgtaacttaccacaccacctttccatgggacaaataatggataactcctcgactgtaatacctatcaatattagatgagattaataacaaagaaatgatgggccatggttatcacagcatctttggtgaccatggctctcgagcggcccctcgttggacaccaagatgctgtgacaaccatgtgatggaaatgaacctatcatagaatatattagtcagaaatgaacctatcatagaacttgcaagttattttcaagaattggagtgtgcatttgtacttaaaaacttgttcacattcttagtttgaaagaacatacctctgctttctctatcggttgatttgatggaatagtattgagaaccctgaacaaaacatatgaattgttacacacagcagcacatttatagtcttttgaaaaatgactccagtggcaaacctttgttctagaactggtgcaaggcctgctgttgaagctgtaccaccaacctgaaaagccacataagcactcctctcaacttactttgaattaacagtgttgaagtattgactaaaaagacgcctggtactttaccagctgaatgctgcagaatagcttcctttgaagctcaatacgtcctgtggtcagcaggtgttagaaaagtttcaagataaggggagcaaaataataaggaagagtaaagacactacctgtcgaaaggatactactaacaatggcttctacaagaccgatgttatcaaacttttttaatctggtgggaaacatcggataattgtcccacataccgaacccaccattcccacttgagtaaagactgtcacttgtttgccatgtatcttctaacatgtcatcataatcttggaacctgcaggcagaaaaactactgtaaagtaatcaaatccaaacacacaatacccaaactaccgagatgaatcaaaatattaccaagatcgaggaggtggagggtattcttctgggacaagaacccttggataaagtagccccataggaggtacctatttaatcacaaaaaaggcatacataaatcaactaagacgaaataatgaaatgaagaccagcattgttcttggactgtagctcaactacctgtgctagtttttgatgataaacccaaaaaaggaaaaaataagcacataagagaaagagaggagtaaatagtaatggattacattcagagccgatagctttgttttctgatgaccaactgatttttcatgctcatatgaatgaacaacactgacagcatcaaaacttccactctgtgaaaaagaaaaatgtaggttgagatcatggttcaggtgcgaattgtcctttgaaatatatatgtaatccctcatatacgatctcttttgttttgttgtttaacataatatagctctgtccattttattacactgttttcaaacaagtgagtacaagatatgtaactagaatctaaacaagcaaccagatccatttttatgttgaatttatttttgtgctgttggatgatcaactcatgataaagaaaataagactacagatatgcgtttgtgtttacatattcatgaaagtcacggaaaaagtaaagggatgagccgaaaactgacaggagacaagactaatagtaactcatatgatacaagctacacaaatataccactcgagccaaatcaccgactcattgtcattctagagatttgcacctaaagcataacaggaattctataccgtgacattagaaaccattattcaatgctactggtgttatatttttattgttcttttttggtggttgttctgaagatgttgaatttcaatctgctatacactggagatggaaatgttaactggagcacacactacctctgccatctgttgcccttattagaatgaatgcaaataagtataagccacttactcttatctggctgtatgactcttttagtttgttgagcattagcatatctataggcttgttcactggatcagtttggaagtttggccatgtgcaatgacgacgttgaacccaaagaaggcatctagatatgtcctacaaaagaaaaaggatagcaaagctgatgtgtaatgtattaaaaagaactcagactgccttgccgcaaggaagatgataagtaaatactgattagaccaacaacagtgctatcaaataatcatgtcataaataactaattgaaaagacaatctcaaattagtgctaactacaaaacccctttaaaagcagggacagaaaaacagaggcgatctcaaattgtacaggaatttcctatattacttgactaagaaacaaaattcccagatgcgaaaaattatctagatggtttctggtcatatttcaaataccaactcaatatcctaatccatgtttcagcagatttttcactggttactggcagcagtgaaagaaaaacagaaccagactagactcgctgagaagtttttaatgtctactttcagtttcaaacactgatatcagactaaatcgctacacagaaactgcacaaacgcatattttttgaaataggagcaaataatagctctaaaaaagtaaaaacaaagaataacaagtatagatggcgttgtggctagcagcattggaccagaccatttagcataacaaattggagaaagaaacacacacaaaaaaaaaaggaaaacttgttaaccaacactaaacaaaaacaatataaaccaaaggcagaagcaaacttaatatcgtaacaaacttaatgctaaagcttggtcttcctagtaaattattgatgtctacacagattgcatgaccatagcgatatactctaaacaaatgatataatgtgatacaatacaatgaacacaaacaatgaattttcatagtaatgataaactattaaatagaatgaacataaaaggcggatatccaaagtaactaagattggttgtgtaggtcaaacagtataatttagggcatacatctccaccgtatggaagcgccagggctgtgtggggtaaagcaacaccatcctgcatacatcaaggaggacaatatattggtacgtaagcagtatctagaaagctaaagaaaagctattcatattacgacttaagaatacaaccctcatttctcaatggctagtgaaagaccaaagaaaatgctacggttattacctcaacacaaactacttgtgtaacttgcgcgccaatgttgaccacacaagatgtcgacaacccatttccaaatgctgcagctagagcttcctatcaaagcatatacagaagaaataaggatgttcaatgtctcaacttgtggatcatcaaacacataacttggttgaatggctattcttctacaagccttatacagccgtgcaagtaggaagttccctaacctaaccggtctcaatttgtagttccgcattagaatcattaaacctgttgtcagacaatcagtcaataactactaaaagaacacagaaggtagaatccaccagctggtcccctagctgagccagcgtcaacttaagatttcgagcacaaaaaacaagttaaatcctagcttttagatgtgaaattctgtcgttcatatagcccaagaatatgaaacattcatgggtcccttattttgtgcgctggtgaagtatggactggtttaaaaccagaataattagcatctataatcagtgtcaagctgggctacaagcagtactttttgcagtaggctaagggcttagttccactctgggattggaccaaacattgaaatgttatctaatgaaggtacaagaaaaaactgttcagcaactatatctgctgtgctaagaaaattcctgctctggcacaaatctgaactctgaaaagtatccacattgcaaccgaaatatctcaactgttttaacaagttggccactctctcagcagtatatttagttattaacaaagacaataatgcatcaaagcataaacacaggagcacaatacaatccattcagtgaatacaaccttcattgattaactcaacaataacatcagaatagtggaaaccaccctgtggctattgaagtgtacaattctaaatgatatccctttttggagaatggtttccaagtgtacatccaagtactttcataccaattccaatgttccttaaaaatgatgcaaactttcaaaatgacaaaattctagcatcccatctttacaaatttgtgtcttgtcacacttattggagcacttcagaggaatagatagtactgtagtacatggaaatcaatttatatgtggagtttcgtttgtcccactttacgaatgaacgatccaattaattagattttccatgtaaaacagagtattcttacatccagaatgtgaaaagaaagaaaaatgaaaaatgcccagtgattggatgcaaaagctaacctgatgtatcactgctgtgctaaaacccaaatcgcaaagtacgattgacaacatttccttgatttctgaaatggaataaaataattaacttcctttgaccagataaatcagcaaaaagaaaaatcttgctcaaaagtgttatgcaacacgcattatacaatataatttatagtaaagggtaaaaactaaaaacaaacataagatagggtacatgtcaactttgtggccagtattttcctcatctgtcaattcaagactacttcaatgcagaacagtattatgaaagatcattccagattctcacagccagtgtcaagcagacagggcagagttgtggactaaatcacagatagcacaagatgccatcagaacatgaatatattgtgtgctagtagatgagggcaaaaccaccatccagaactagttcagggtttattcactttgatctggattttgtaagtttaagcatcatggtagtttggggtaaatagaattttccttatcttttaaaactttttgccaacatctaactagagaataaaggaaaagcatgtgagaccaaatagatcctttgcttatagtgagaatgttaagatcaatctaacccgcagtagtgagaccagatagatcctttgcttatagttttaaaatatttctgctaacatttactcattccgccccaaaatataaacctataacttttttacacggtctccaacgaagagctttgacaaataattcccatcgtaatatatgatgtaacaattacaaaataaacatcttatgaaagaactttcaaatacaaatttaataacatcacatgcatagaactaaacatatattacttcaattattattagtcaaatgttgaaattgttgatttttcctaaaattgtgtgcgttatattttgggacagggagtaactagagcattaaggacaaaggtacagtattggggactgcattaatatccaaaatgacaagtcaaaggaaacatatgtacttgaaagaagaaatacctcggttatcaaatgtctctcctagaacaagaattgcagaatacagatgccgatctcttggatttatatgcaatttttctgtcaatatccagttccaaatagtgcgcaaatcttctaaaacctgcactttttttaattaaaaagatggtctagcattgtgatactatgctgttcataagaaaaaagaaggcagcatacacaggtttatgacaaattcaaaataaagagttgtcacttagttttctctttggcatacaaaatatcagccatcaaatccagattttaatatttctaaaaatttgatagccagattttgttttgaacattttatatggtatgtcattcataaacaaatacatcacatcagagataaaaactgaggaagaaataacagataatttggaataaatttttaacttttgaacacaaaatcaacagtgcctaaaattacaatatggcactacaaggctgtacaaatgctgccttacaagcagcataaactgattgattaattgttttattaattatgcagaaaaaagaagaagaagaaccagtaagtaggcatggataccagaaagtgtaaataataattctagtggattcagaacgttagtatctcattctttcatcacaattgtacttca

SEQ ID NO: 17880 - DNA, 9951 bp, Oryza sativa
ttcctgcagccccttgaaagaaaaatgtgtttttttattgcaatttgctgtgtgtatgttttctatttccgttctgtagttccatactatacttgctgagtatattatactcacctgttttatttggttttaggtatccagtatgtatgggcaggaagtagcaccccttatctccacagctcacagaattaaactaaacatagttccttaatatttgaatagttcacatttggctttgtaattattgtttacttttatactgtgagagtttgtgtgctatcatgtctacgggttaagtgatgtttaattatttttataaactgtttgtcgtggatgtaattaaatacaggggagattctgccaaattttctaacagatttgtggatggcgtcagctttgttcaatacatttgagcaaatcctttctaccgaagttgtaatgcaaatcagttaatacatttttacttaataaacaatgttccaacaaatatcatgttccgttccttactgattatcttgaatgtaaccacagcctagcttaatcatttgaaatggctgtgttgtcaattacatccagaaggagcattactataagtttataactgaatgagcttaaggaaaatggcatataataattaagtcacatactaatacctgatgtaatgaataatcctgagaaatattgaaatggcctctcctgatcgggtgactcagacagtatgactcagaaggtgggattttcaaagcatcctctccaaatattatttctttatacatgttttcttcagaattaggctcagtatcgtcaggagttgatctttgcaggggatccacgtcagcatccttgtcaactggcctttctgaccaatttgagtagttcagcaaaacattgatatcataaaatagtataggtaaaacataggttacttcactattgatgcaaaactgctcttctaatctccctggaattaaacaaatccactaatacccatgctatgcccaatccaataatcttaagcagctagacgatacatgctatgtaaaaagaatgggatgcaaatttcgactaagcttccaccttttcagataacagttacaattgtttctgaagtacaatgtccacatcaatatagctactgcaaagttccaatccaaatatatccaatgggaaagaaataccataacaaaacataagagttaaatccaacaaaataacagaattagctcgctccaagctccagctaaactagccacaaatcataatgcaatggtcctacagggtacaaagttcactactgccataagctcaggcacaggccacagacattgatacgcgcatggcagcttgcataggattctgccctcttccctcctttccaacaaatgcgcgcacaaatggtttgaccccaagtttctacatttgaatttgactccaattgtgtaaacactgcccaaatccaagttaacttccaatctgaggattaccacccatttggctgggggtgttccacataaggcataacaaatgaattataatgtcaaataaaataagccatatcaaataacattcatgtacaacttccaaatggacaagcatatctacacaaacagtgccctaacttaaagtatacaatttagcttcagctaacggacaactatgaaaagagaaaacaaagaatgaagtgtccccataaaacaagcaaaatgatcagacagtaccaattggtgtagatgatttaatacttctgtccattacatctgtccatgtgaatttactatcatctttgttttgctgtgaagaaagggcatcaacacgtcccatctgaagaggtaaatgcaatgatatcagcatatagaaacaacactaggatctttattaaacaaaacaagtttggtctcaagaacattgatgtcaaacactcaaaccatctaacagagctatactgcaaaatcgaacagttgtagtcatttatagctacacccaaagatgaaaagataaaagtatctttcaaattagacaaaagaataattcaaaaataatctataaatccagaagagttggagaaagtgatgaactaatcagttcactttgcaatattttcaaagattcactgtacaatataaatgaatgtcactatcaattttctcttttcaacacaccttatgagtattttatatatttgatagcccctcaagtttttcatggatattggatatcaaggatctatttgcaaaaacatagacttaacattgaactagaattttgagcttatattaattagtgaaatacagtgttttattgtgtcaatcctgaaccatatctaggtgaagtcgacttacaagaataagcttcctgctattctttagtttctgccttcagcttagaggcaggagaggtatcattgcttacaaaggataacaagcaatatccactctatctccccattttctccctctaccaatgctatttttctttgttcactgaaaagtgctaactcacccaatcaaggcactgatgggcaagaagcaggatttctgtggcccacctgatcatggctatgcattaagaccaaagtgcccgagcatatctttactcatgaaaaggagttagttgttgtgatgtttagttccataacatgtgatcttttgtgaattgatctacatagatgtgtgcatgtcattttgttgggtcctttgtaaaggattagaagatcacatagtttacttaattgtacataatgtaacatacatttggctgctaagaaaaaaacatcaacaccaaagacataatataatgagcccatcttaaagcctttttgttccatacaagagcaaaaggacatctggatcttgcaatagggtggaactcgaatttttaaacccaataatactgtagttgatccagtagggtggagcatgtgctactatattctcagcagattcctctagttctgtagttcactctcattgcctataaccgtacaaccagataggtaagacttaaagatcgtgcgtcctaccttaggaggtaacgcctggttcgctgaaggcatgtcttcatccaaaaagggtattttgagcagcgatgcaatctgcaagtctatcacctcattagctcaagtagaaacataatccaaaaagaaacaacgccaagtgtttgctttttacaatatcatatgccctctcccgctctgcattctgcgatggagttgcatggcagttgagcatctgcaaataaacatgaatgtcgttcaattaggataaagataaattgcattgcatcacaaacctcccaatatttgcaccaccttgtctcgcacagaaagccttggtgtatcatccttctgctgagtgatatgtcgagcaatgcagtgcggtatattgaatggaacatcctgacttgcgaacccaatgcgcacatttgaagatcctagagaacacggataattgattggtcagctgaaagcaactacgaattgaactggcagcaaaactgcatctagataaggcaggcacctagctgctgcgaagataatttgtcagcacacaaccacaaaattatcacacaaaaattactttactaatacggttgcgctttatgcatttcgtccaactacttccaactctttcatccaaaagaacacatcaacccattcaaatcgtccaaatattctcgatattggagggtggaaggcatgaatctcaagaaggacttggccatacgaaatagcacccaaaagaggaggggatgaccagattgatatcaggggctagggtttccggaggggcgcacctgggttgatgacgacgaggttggcgccgcgctcggccatcagctgtgatggaaccaccgtcttgaggtaatcctgcgatggaaaatcacttgttagttagggtttctcggggatttatggctcaaaagtagcagaaaacccagtggaattttggccgcgattgagaggggagagaagccatggggagcctaccatattttctccccggagaaggcgtcgcgcgcgtcggaagggaagggaagggagcgccggagtcggaggcgacggcctcgtcggggacgcgctcgtggtcgccggcggccgagcggcgctgggagtatagctgctaaaatgggccggggcccggccacggcacgccagcccgtgggccgtgccgcgcttgggccgtcggctcgggctgtgggccggcacgcaatggcccaagcacgagccggcccaggcgggaatttttttatttatacatttttttattaaaatatttaaaaaatattttttttttagaaaatttacaaatctaatcgtccaccgccctttgggagagcgatagttgaggcaaccccccaaagggcggcggacgattagatttgtaaattttcgaaacaaaaaattatttttgtaaatattttaataaaaaatgtataaataaaaaaaattcgcccaggcggtccaacgaaatttccccagttttatcttcttttgtttttctaagttggaaaaactatactttgactccctcaactatcgcccgagtatgattcatgttctccaaccacaaaactgggtatatcgacttctccaactattaaaaccactcggtggttttggaggtggttttggttgacgtggtggtcttaaccaagtctttgtcctacgtggcgcttgcgtggcattagaataaaaactaagtcttctcaatctctccgccttatccctttctcaccacgctcgtgcgcgcttgagcgggaggcgatcggcgcgtgacggcgcggcgagttgaaagaggttggctagcgtggtggggaaggctgccgcatgcgatgctcagggcgggcggcgtcggaaaatggccgacaatgaggtcctaccggactgaggactggctgcgcaaggaggttgctgcggtgatgcagactgtggtggggagcaaggggaaaaccgacgacacaggaaggaggtcgcgttgggcgatgccgccggcggggaggagcagagaaggagtagcagcacatggaggaggttggtggcgtggcggtggggatgggaggcattgcggcattgaggaaggatgacgcgaggaggagttcttcgcgggggcatctgttggcggccgagaggaggcgccctcgtggcgctccccaccaccacagctgctgccgaccgccgccgctactgccgcctctctccgccgccgtcgtccgagaagagaaaggccggggggagagagagatataagagagagagggggaggaagaagggaatgagagggaggatgacatgtggtcccacttgttagtgggtcccataatacttttttttgtgaatgacatatgggtcccatatttgttttatttttgtttttattgataatgtcacgtaagcaccacgtaggacaaagacttggtccagaccgctatgtaggtgtcacgtcagccaaaacaatctccaaaaccacttaggaatattgtttgcaccggttttgatacttggaggagtcgatatacccgattttatcgttggatgacatgaatcatactcaggtgatagttaagggagttaaagtatactttttccttctaagttcccacatatttttcctattttctctctctttttttcccatttcccccaagtttttcatatgtgtattacctattttcatcatttttcctagttcccccctattttccttttatttctcctttgtttttccttttttttttgcattattccttttttctaatatttgtattcgtgctaatgggcctgcaccggcccacgtgccatatttgggctatgctggcacagcacgcgcccatggcctccttgggccgtgcctaggcctaaattttttttatttatacatttttttattaaaatatttaaaaaataatcttttttcgaaaatttacaaatctagtcgctacaggttagatattgttggtggaagaattctgtctatttccattggtggtaactatttttggaggatgttaaatgaaatgcaatcaatatataattaattatctatacgcagtagatggatgggccgacggttgtctccatctgtggagcgacaagtaactggtaagctcaaattgtgtttatttgttttagttgccagatagtttgtaggtttgtaacaaaggagatcaagatccaatttcaaggaacctaagtgcacaaatggtttctctgaatcatgaaattttcttcagttaaaactgcttatacatctctgatctctcccttatatggctcaatgattgatttgcttttaaaggcgcgtgctaataattgtgcatttagaccgtgatagattcataatccatacttatttcatctttgttgtgcccatttcaaaaagattacttgtattataaggaatagaggatatgtctgtaatttgaaactacaaaatgtgccacaccttgctaaaactggaatacttcttttggcagggctgaaagaaagtggtgaagcaaacttgcgagagctggatccagcatgtggaggtgctcatcccatgaagtcaatggtggcgatcgagtaggaaccaatgccccgggcctgagtgcttattcattgaggttagttgaggtcgtaagactatttctgtattttgttttttgtttttgtcaggattgaaaatcaataagaagaagaagagacgaagtgtaatcacaagcagaataacatcgatctcttccacctcccagattgtcttgccttttgtttgatctcttctcccttccctttcactgtttgattttgtcttgaaagattagcaccaagttcttatttgattgcatactctcttttttttttgcgcaggaggtgttcgattaaattctgcttaagccatgtgatactagaacgtggagttacattttttttggttgcagggtggtgttattagaacattttttctaaaaggataccatatgtactgtatatatagatggaaaattataattttggttgcattctcatgattagttgcgttgcagccaattaaggacatgtacaaaggtataaacaggtatgagctctatgctatctaaagactaacgtcctacaatagttggagacaatatggtctctaccattaatgtatcaaaatactttttcttactcttttttttcctttctttcactaccatgaaacaaaatttgctctaagaaatactaagagtcgactctaaaccgttgtcgtacataacaactatatttctctttcctcgtttctctttcttccatgtcatcaaacttacttgcatggtaacatagagagaccactaataaaaaaaaccgttgtacatgccctaatttggatcttgtagtttcaaaatcatattgttccacttgctctcctgcagattgctgatttggcgacaaattgtaatagatatatagatacgttacgcctaatgaaagttttggagaaggtgaacaggtgctactattatgctggtcctcacgcgaaccgccgacgccatggctgcccatggcccatccttcctccacacctcgcatccgtccttcgcaaccgccactccacattctttgtcactgcaaggcaagtttctgaacattatcacatcgaagcactttttggatgtttagtatagtgcatgctgccatgtacccacaggcatgtggacaagcatttgtcctgataacttgcaaatatgtgaaaaatatcaattgagggtactggagcatatctagaaatttgcttgctttgtctgaaggagaataggaactaatttagcaattagatatgctgtaaaatcatagcaggaaggctaggacagcaggatccaacaagtagatcggtgagatcaaatgtaaatcatgctgtcaaatgatcttctgtatgcctgattttttcttgtgttatatacttttgttcaaaagttcgaatgcacgactagctttttcttgtgctctctttattaccttgcattgaccatattaccttgatagtatcatgctgctcaaccaaataaccatgttttcaccttttctttttacctgatgttctgcttatttttctatttgggtacatggtatatacctagatgattcacttctgtgtatcatatattctgttgttatcatgtattcagcggttaatattgtggtaaaccgttaggccgaatcactacagtgagggcctgcttgaaagcttggtccatagatcagttggtttttttttttgacccacgaaaaatacaagtgtaatatactggtgtaaagaatttcgatgctgtcaatctacgaaaaataaatatataatctaagtaaccaatacagggtggagtccagggcagcgatcacctcagattcagagtagctgaggggacggcgtagaaggaagtggatggatcgagctgctacacctccgcactttgctgcctcgatctgccccgctgctggagccatccacttcaccatcgccgtggactgtgtggagtgacgagattctttaagtgtatagcaaatgctcaaagttaggattagttaattagcttcggtgtatattctatattacaccgattactgaatgttttatttttcatttgtgtatacgcacaacagattaatggaacaattctctaccatatttttcttttgtcctttttgtttggacatatattgcccacgtatattgtataccgggagctcggggcgctggcgaagtgggcgtgcttggcgaagaggactcgctgtccgtgaaagcggagggaatcaacacccctcccttcatcacgaccttcgcctgcctcttcacgccacttggaccacctttcttcggcgtagccttggcgatctccgctagagttttcgcccctcgaggtccgtttggcgaagcggagatgcgctggagccagcaatggtgttgccatgggaagcttcttcgcccctgctcccgtcggcagcttcgtcctcctcgtcgtcctcatcatccgcctccgactcgacgacaggcactttggaaaccttgcgggatcagatccaggcaccagggacagccttcggcaccgcacgcttgcacttcttcgacgcgctggccccctcgtctactttggcggggttcacccaggcaggcagttcaccatcatgcacctggtttgcccggccgtcaagctggcactgcagcagccagccatactccgcggttgttagaccgccgatgatcttgttggtgtcagcttctgcgtctccaagcaaaagtcgtacaaagtgaaaaagacaattaggctggtagtcagaaagaataagagatcagaaagagacgcgatcggtggcaaaaggcttacgattggtccattcgggaaaaacgagactgggaaggccgagcttttttttgtcctccttcacttcgatcccccaatcctgagcaaggggagcgatccggagcatgcaatgctttttgcaaaggtcgcgggtgctgaggcgacgtgcgaccttgcgaagaaggatgagtctttactccagcgttccaataacatccacattcggcttggagttgatggagatgtggaggtggcgaaaccggagcctacccgcgttgtcggagttggcggcgcaaggattgtcgatgtagagccatttctgcatccaatgccaatcctacttcggtatggacgtagggaccggccatgagtccgaccgctctggtcggaggttgaagttcacactgccgaagacagacttcttcggcccagcgggtgtgtgcacatctttcgtcgatgcactggcggtgaagaggagggcgaagagctccactataggagcgaacccggtcgttcggcacatctaagcgaagacggagagctttgcgatggccaaagggctgagttgcggaagcctcgcctcatacatctccaggacggagggcaagaaattgtcgcacggcagccagaagtccacgt

SEQ ID NO: 17881 - DNA, 1666 bp, Oryza sativa
tactggagtaaccaaatttggtcggtcgcccaaaaaccacaatagtcccggttcaaatagcaaccgggactaaagataattggagcctgcactcgacctgacaacttgttgaaccgagactaaaaataatctttagtcccggttcctatttgaaccgggactattgtggtttttgggcgaccgaccaaatatggtttctccagtagtggatctatttatttatttaccattcaacaaacatatttatggggtaaatttatcattcttgtcttgataaggtacatgaaggttttatatatttttaagtgtaaaatttggtacgtatgtatctctagttatatgattattttcgcggtatggaaaatttagttgtcttttgagatacattttaaaggatagtaaaatttctctccttttcttattatatgctaaaactctactcgtttattgacttattgtccatcatagattctaaactactcaaatcgcaaaagctggagaagaaggaggaaggctcggaaaaaaaaaatatatatggtcaaaacctcgtggtgcaatcgtaccaaacgtttcctcacatgcatactgaactttgaaaagtatgaaggaatcctctctcacaagtcaattaaacaactgcgaacaaattaattataaatgagctcgaattgtgttgtctctataaatactgaacgatgatggcaagcagcaggagctcatcattcatcccaatatctattgcatctgcaagagcgatcgagagagaaaaacaagatctatctatagcagctagctagctagcacaagaacgatatgccggtcttcactgcatcattccagtgtgtcaccttgtttgggcagccagcatcggcggccgacgcccagccattgctgcaagggcaacggccgttcctacaccttcacgctcgccgccgtcgaccatgcggtaatccatctcgatagcactatatatatcgcgctatacatatatacgtatcattaattgctgggttctacaattaatgttccggtgaactaaacttttctatggacggagggagtaattaagacgataacggaatgtctaataattaaatgacagtgcatgctgtctgtttctttatgtaggattttcatgtagtcctttcgtttaaaaatgcatggtgccgttgacttttcacacaacgtttgactatttgtcttattaaatttttttatataaatatcatttatttctttatgacttgttttattatcaaataaaatataatcttaacttatacatttacatatttatactaaatttttgaataagataaatagttaaacgttatgtgaaaagttaacggcgtcgtacatttttaaatggagggagtacttgataaacattctcacctcacctcacctcccatatatgcctgattttcagggcccatgctaataagcaaatcaccgccgtacccggcctcggaagaaacacgcgaatgggaagcagatggacaacatgaacacacggtactgtatacacgtataagcttcacactaccacatgtttcaaaatatagtaacctaagacggaggatgtattaagcggatattgatcattaattgtgcatatgcaaatttatgaacgaattaattgacactgataaacccctatctcaaa

SEQ ID NO: 17882 - DNA, 4658 bp, Oryza sativa
  unsure (1)..(4658): unsure at all n locations
ttcatggggtgatgcctccttcttcatgatgggagacgggatcatgagcaccctcgcttgtgttgtagcgttgaagtcatggaacatccacaccgataaatgcgagagaggtatgtgtatatcactagatttccttttctccattgtctcttcttgtggacacaatccttgatgtttctttttgatggactgaactttttgattttgtttactggtttgttttgattttctttaaaaaataaatgtgtttattaaaataatttaaaaaaaatcaaagttttacaaattcacaccccctgacatcacttagtgtagcgttttttaaaaacaccctcctaaataatattttttataacatgacacatggtcattgggatatgttaacggtcgtcgtacgaaggagctgaccatttttcaggcaacacccttatgaagggggccacttgtaaaatggcagcctagcatattttgtaagcgaccttcttgtaaccctcccaaaatagagtttctctatataggaagtggattttttcccttgagaggatgtccccttgttttgtgcatggtatttaaaaaatcatgaaaaatttgaaaaaaaatatcaagatagatcaatatatgatacatctttacacaaacatacaagttgaaatattacttatacaatttgaaaaaaaataacaaatttaaccacgaattacatgtttcattcatagttaaatttattacttttgtttctagttgtataagttaaattagaatatgtatgtttgtggagtgacatatcacatattgttcaatcttactattttttttgaattttctaatgacttttaaagatgaaaaataagaagacatccccttaagcaattaatagagtttctctatgtgtgtgcgtgtgtatataatatatgtatacatatattgcgctatcaacatgtttgtttttggatttactatgccaataatttgagagatgacaaggatttattgtcgtaggtttgttgtttatccaagaaaatatgtggaggttggcccatgaggaagaagactggatgctagttggatttgagattgccttgccctcgctcctagacatggctaaggacctggatcttgacatcccttacgatgagccagccttgaaagcaatatatgccgagagagaaaggaagcttgccaagtatgtatgcctatatctacttattaattattttgtttagtaaaattttagtcatgccacacacgatagaatataaaggataaaatccatcgtgaaagcgcccgcttgcttctctcttctctggtctctctcacaaatagctactctctccggggtgataatacttatctttttagacaaggacacggtctctaaaaagtaactttgacaactattttctattataatatatatatagaaatattaacaaatatatgattttattaaagtactttttaaactaatctacacatatggtcttcatattttaagataaatattttagaaattatttttaatcaaagattttaatgtttgactttacccttgttcaaaacgactaatattatcagtccgaagtgagtagcagatatggacttattgcatatgcccgaaacatgtaatatgtggatctatcgtatattagggttgcattactgtaaaaccattcacaaattattctccttttttgcttttcttatacagttaaaattattgtgagatttagagttatttttgctctaacatatcgcattctaacatctttttacaatgaatgaatgttttgcattcaaattctaggattccaagagacgtgctacactctatgccaacaactttacttcatagccttgagggaatggttgacttggactgggaaaagctcctcaagctccggtgtctcgatgggtccttccattgctcccctgcttcgacggctactgctttccagcaaacaggagaccagaaatgctttgaatacctcgatggaatcgtcaaaaagttcaatggaggaggtaattattgaagccgatttaccaaaatattttttgttgatttacatgcacaaaatttcagaattccataaagtatattaattaatttctccttatattagctagtttcttcttccttcctctcccagtacactgactcaattcaacactgtatctgtatgcaatgaaacagaagcgcacttctgtatgaaacagaacccctccctccgcacggaaaacggaacgatagattaacacgtgattaaataagtattagttataaaaaacttgaaaaataaattaatatgattttttaaagcaactttaatatataaacttttttgtaaaacgtgtacgtttaacagtttgaaaaacgtgcatgcggaaaacgagaaagataggctggaacccatgagaaagaacgcaccaagaggctaggttcagtagttcgtttagcttttgcaatctccttgtttgttttcattagcactactccctaacttgtaaatggtacctttactaacaactttttatatacaaccttttccagaaaaattaaataaacttacaatattattatgtttaataattacagcttacttattcattatgttttccagttccctgtatctaccctttggatgtgtacgaacgcttatgggccgtcgataggctgacgaggctgggcatatcaaggcacttcacaagtgaaattgaggattgcttagactacattttcaggtactaattaacttttaacatatctgtactaattaactttatgcacgtaggtacccaaagtgaattaattaatgtttagttgaccatatatatatataatatggatattaattatactggaacaggaactggactccagatggattagctcacacaaagaactgcccggtaaaggatatcgatgacacggccatgggtttccgtctcctccgactttacggataccaagtcgacccatgtaaatactgtccctcggttttatgctataaaatatttttcttaattaaattgtttaaagtttcactaagtagaaaattattttgctagaattttggtacgtcatccgtattagagtcagtttttaagttcgttcgcttttggaaatacaacatcgtgtttgagttggattttattgtttccttttggaagtataaaaggagtcgtacaataaatcttttgaaaaaacacgcatgctaacttcaaatgaaatacagactcctaattgtagctcataattttctaaaaaaaatccaatcgaattcccacggtgaattttaccctaactaaaccatataacaataataaaattaaaatagtatttacccgttgcaacacacgggtattttttctagtacaataaaaaacattcaatgttacatttaattaaactaatttgatgttatagatgttgctaaattttatataaaattaaggtttaactaggaaaaaatcatagagacttactgtaatatcaaaatataaacacatgtcctcggaagaaaagataaacacatggagtagtttactaaccgttgctaattaatgtctaataattaagatatccaacaaattaacattactactccctctgtttcaaataaattacttaccaatctagcaattctcacacaaaccaacaatatgtagaagattgtattacatggtttaccttcattaaatacatgacaacgataagtattttgatataaaatttaaattctagaatgataagtaatataaaatggagagagtatttactttaataattgaacctagctaatgtgctcaaacaataatgccatgcaggtgtgttgaagaagttcgaaaaggatggcaagttcttctgcttgcacggggagtccaacccatcctctgtcaccccaatgtacaacacttaccgggcctcccagctcaaatttcctggcgatgacggtgtccttgggcgagctgaggtgttttgccgctcattcctccaagacaggagaggctcaaacagaatgaaggacaagtgggccatcgccaaggatatcccaggcgaggtatgttaagtcctactactccctatgccaaaaaaaaaaaaaaaagagcttttcaggatgaatctgaacatgcatttgttcagacaatcgaaaatcaatgcaattttattaaagtatatatgaatgggatgtgataatactccattcctattgaaaatgcaagtttttgatgctaagnctaccacactaattcagttgcgtcttctaacttcannatatactcctactccctccgtccaaaacaaaaancctttcaggatgaatgatatgcatttgtctagactggaacagagagagtgcctagctagcaatggaaaattaatgcaaatttattaaagtatatatggatggaatgtgataatacttcaattcctattgaaaatgcaagtttttgatgctaagctaccaactaattcattgcgtcttctacttcaatatactcctactccctccgtccaaaacaaaaacctttcaggatgaatgatatgcatttgtctagactggaacagagagagtgcctacctagcaatggaaaattaatgcaaatttattaaagtatatatggatggaatgtgataatacttcaattcatattgaaaa

SEQ ID NO: 17883 - DNA, 2764 bp, Oryza sativa
agcataccacatatatgattaatttcttactcaaaattatttacactttatatgcaggtggtacttgaggagtaatctggagaagtttggagggactgatccacagactacactgatgacatcctacttcttagcttcagccaacatcttcgaggcaacccgagcagcggaacgtcttggatgggctcgcgtagcgttgcttgccgatgccgtctcctctcacttcaggagaatcgggtatatatgtttaaccgctatattggacgcgtgacttcactcaccaaatcgatcactcggttttgctttagtgatcgatcgatcaatggatgcaacatgagcttacctgcatgctgctttgcaggggaccaaaaaattcgaccagcaatcttgaagagcttatcagccttgttccttttgacgacgcttattctggcagtcttcgtgaagctgtaaattaatttatcaaatcaaaaccgtgttaaaacttcaaatggaaacataaatatgtgccaaatctttataaatttcgttttgtaaactgcagtggaagcagtggttgatggcatggactgcaaaggagagcagccaggagtcaattgaaggggacacggcaatattgttggttcgtgccatcgagatttttggaggacggcatgttttgaccgggcaaagaccggacctttgggagtattcccagctcgagcagctcacctcctccatctgctgcaaactttccaggagggttcttgcccaggtaaatatttatatgttaacctgaatttttatatacacacaaaacactgtccttttaatcaagttgtacatacaaatacacacaaatacagtaaaacatgcatagtgtttgttataactaaaatacatcccttatgtagtaaaatttttaccgcaagttatatcgttgtaaaatatcttatagtaaaaaacttttactaatcgatactttatagtacaatttttactagctcaatatgccatttgatgattatagtccccgctgtaaaaatttcactaccttggcttttgttagctatggcacatcctggctatggtatagtacttctacaatacacaaacatatataattgttaatttgcaacgatgaaaatatttaactttgattcaggagaatggggaaagtacggagaaagttgaggagatagaccagcaagtggatttggagatgcaggaattgactcggcgcgttctacagggctgcagcgctattaacagactaacccgggagacgtttctccatgtggtgaagagcttctgctatgtcgcctactgctcacctgagacaattgatagccacatcgacaaggtcatattccaagatgtgatttaggaacaaattaccccgactcatctacactccttataaaagagagtagtggtggtgttggttctgccacccccacctccactaccaattcccgacctttatagaataaagatgtgtcttttgtattaagtttgttgtggtgtacctcgtgtttttcctgagacggggtttaatttcgtggcgtttctgaaaggtaatttctgtgtatgatactgaacgccaacgataagcctctggggtctactctattcctgactcaattcatcctactcctcttgagctagagtcggctattcctgacgctctagcgactaatgatggaaatggaacggtgtgtggctaggaatctacacaaattaatggatttaaatttcgggattttcaacactttttggaccgatgtttcttgaattttagcataatttaactgaatttgactaaattttgaccaaatttgcaaaattttgagaaaaaaaaaaggaaaattgtggcggagataatcacgtccttggaggtgggggttggtccaaaattacccaaatttcaaaaatttcaaaccgaaattgcattatctgcacaaattaacaattcaatatatagatccaacatctcaatagacattaaatactcagaaaaagagacacttagtcctcacaaataagaaaatagcaacagaaagagtacctggcttggcttcatctccgctcccataggtatctcaactaataagtgtaagaaaggtcttctaactctatcttctcgagtgaaaagctttacttcaacgatgatgttatgttaatagcaaggtgagtatatgtaacgccccgattttcgttcgggattaaaaatcattaaataatgcattttctagaaattaaataaaagttaaatcaatttaatcaagtgaaataatgggagaattaaaattttcccttaaaaatcattggccgggaatattttgtaatattctttgtgtcctaaaatactctccggaattttccgtaaattttcggagctcaagaagtaattttaatggcacaaagttcatcgaatcaattaaataaaaaaagaaaacaaaaactccccttcctccttgggccattttcggcccaagaatccttcccctcccgcggcccgcgccctctctctccctctctcggccggcctccctccccatctcttgggccgtcggcccgtttcccctctccctcgtgaagtctgttttacgtcccccatccagctctccctccctctctccccgacaggtgggacccgtggaccccacctgtcatccccttcctccagctccaactgccgccatggccgcccgagccgccccacgacgccgccgtttccgcccaccttctccaccccgcgcgcgcgcgctcgttccggggacct

SEQ ID NO: 17884 - DNA, 26341 bp, Oryza sativa
atagccgtgcccgtggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatcccttttgcacgtctgcatcattggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcatctgtaagtattttacgctttagtcacgtttggaactgtttattacttgtcgttttgtgtaccctggctggtcctggacagggatttaatacacaaaatagtctggaaatttgggctaaatttctgggcgtgacagtatatatgatagcatctgataaaacctatgtgatcaagacatgataatcataggacttcatgccaatcagcttcagatcgtcatcaaaacaaacttactaatccttgatgagtagcccgaaggaactttaatgcccttcaagcatgctatcatatcattcttctcttcctccaataaagtgtggtaagctagagaaaggtatactctgccagttcgaacttattggtgctagtttactctgatttatcatatcttgtaaatctcggtgtgaatttagtccgttcttcgccattcgaaggatatttagtagtaacctagtcacactatcacaagcgttattctgtacatgcattaaatcaatacaatgacggtcctcgagatactttcagtatggcagccattagaatatagactttatcttccacatactcttctcatttgtctctccaagatctatgaatgatggctacagaagaaagggaaagtttcagtggaagctaaggattttgagtgtctgaaggatggagatgaagaggccaatgaacaattgaagtgaacttgaaatgaatgtcactactgaaatataaaggctggagtgacggttcacgttttgaggaatgtggtgcgatattcccggtgaaacagtagtgtggtattatgaaatttgatctatccaaatttgaaatccgactacgttctagtatttggctcggattaaagaaccaagtagtttaccttaacctaagcgcatgttttccgattacgatttatttgatgaaatggcttcttgggtaaggacagcaacaataatattggatatatatttacattgaggtcatcgctattgtcaatgttataaataagggataccccatatacctacactaatcatcatcgccaagaataccacacacttatatacggaaatatatccctaaatctctactattataaaaattaaagatgtttttctggtactttggtacatcatccgtgtataagtcggtttttaagttcgttgctttgggaaatacaaaaggagtcatataaaaaatctctttaaaaaatctcgcatgctaacttcagacgatcggactcctgactgcaactcatgattttctaaacaaatatatatccacgcgaattctcacaatgaatttcaccttaactaaaccgtataacaataataagattaaaataaccttcacccgttacaacatacgggtatttttctagtatatataaaaagtaaaaataatagagagtcatgtttggctaggaaagacggtatagtctgatttagggacgatagggtcttgtgtacatgtattctaattgaaaaacatgcgaggaggttaaggtaaactacttaaaacaaattcacagtgagtttacgccaggaggaagcccttcaggttgccgccaaatacaaccagccaacacgtcaagagtagttccgtaggctagattagcaagcttgtttcccgctttgtagttggtgtaacaaaccccaaatcaatacacataaactggagttgggctgctacccacctctgggacctggaccagtagaaacatccttatcctttgcttgcgtatactttggtaccagctttatcttacgtccctcaaataccatagtcggatatgacccgtctactaatggttttaccaataaatattctatcaggatctattttttttacataaaattgaatttattagatttatgttcaaaaatatttacttatgattgtgcttttctatcatataaatgatgtactaatagagcaactgttggttaaaaccagatcctaacggatgaaatacttcttatattttgaatttgagggagaactgagaagtacatgctattgttcctaaatcctatcatacaataaagttgatgcacactaacttctaaatattaacatgcaagtgtgccacatcattacccagtagcaattattatctagagtattttaaaacacatgcatgtgtaccacatcatcactcactaacaattattatctagagtattttaaatatcatgcaaatatgacatatcatttacagttttgttgtatttttagaactcaatgtgcaatcagagtaaaatcattatctccatatcattttcacattatttaaacttgtacatctatcatttatatcatatataaaatgcattcatccacacatcccacggcaaagcacggggtatcaactagtattattaatttgtttgtccatttccccaggacaaacaaaacttattaagaggtatgcaagcacgtaagcgaaccgcaagtacaccgacacacagtcacacacatccatcaactttgcatggaaatcggcttatatggtgatgccactagctggagatgattctttctcctcgccgttgcaccaacgacgagctccatgtcgatatcacctggctgcatcccatccgggaggctccagtcgaagtagtatagaaggcgcgccacgatgagttccagcgtggccattgcaaatatatcaccagggcacctccttctcccggtcccaaatggcaagtactcaaaacgggagcctttgaagtccgctgtgccatcctcaaacctctctggtatgaacttctccgcatcgtcccaatactcggggctcctcgccatcgcccacgaattgatcaacactctggtgccctccacaatctcataccctccgatttcgcaggtctcccgacataaatgggggagtagcagcggcaacaccggattcagcctcagggtctccttgatcaccaacttcatgtatgataggttttcaagcaggccctcgtggtcttgtgggctcttgttgtcgaatactcctcgcacctcagcctgcaccttggccatcacctctgggttcctcatcaactccgacatgagccactcggtggtagatgatgtcgtctctgtccctcccgtgaacatatcctgaatgaaaccaactacatgagcaagaatgaagattgaagaaacatatactccctccgtcccaaaatataagcatttttagacgctgacacggtctttgagatactactttgaccaataatttttataaaagtaagatgttttaaataaaaagagttgcatgttataatattttgtttagtgataaatctagtaacacgattggtcttttttatttttttgctattaatagtcaaagttataaatgcttgacttgtcactattctaaaaatgcttatattttatgatggagggagtatatatttttcagcagtaaataaatgaaattattaccagtataattgccttgacgtgtgttgagctaaaggggaagtcaagctcgccctggtccttgatcctgagcaggacgttgacaagggaatcacccggattcgactcgcactgagcgacgatcttgtcgaagacggtgtccagctgcaagcgcagtcgctccaggcggctcctcagcccggtcatggcgtcgatgaaccgcagcgacgggaagaggtcgccgaagcagaacccattgctgaacttgagcgcttcgtccagagccgtcaagaactgctcctggagctcgccgccgcacgcctgcccgaacgccgccttcgcggtgaacgtgttcgtgcacgagatgagcagcgtggcgagggtgaacggcttcttgccgccggcggcggcctcgatgttcctgacaagggccagcgtctcgccgtccctgatcggcgcgagctgccgcaccatcttggtgctgaggagctccaccgtgcagagcttgcgcagcatccgccagtaggcgccgtagggcgcgaagccgatgtcgaggttgccgtagcagaagatctccgagacgaggaggctcggccgcgacgcgaaggtgacgtccttgtcgcggagcacctcctgcgccgccgccggcgaggagatcacgacggtgtccacctgccccgtccgcaggaacatcaccgggccgtacttgccggcgaggtcgcggagtgcgacctgcggttgcgaccggaggaggtggaggaggccgccgaccaaggggaggttccatggccccggaggccgtctcttctttgacgacgacttgcgggtcagcaacgcgagaagaatgggcagggtgacgacggagacgagggtgacggtggcttctgagtttatctccatcatcgatcgatagatagaggatgtatatatggcttgatgattgattaggtttaattacttggcagtttagcttgacgaagaacagcaagaactgaagggccttttataagcttttgcccaatgccatgattaattaaattcgaagttcatatacggtcgttagcgcaaatttccaggcatgtgatttgacctggacgtagaacgtgatatatggtcagaggaactgctagtgatcacgactactggggatggtcgatgctcagttgcagcgactcatcgatctaagattaagataaaactagagctcagctaaacagttttaacttcatctaaattaagagcgaagttaggtgtaacactctcacaaaataagctagagaggttgaactagaactagtagacggcttcacagcttcactttaaacccaacttttgaaactacattgagttgaagctctactgaagattcccttaaccaaggggggaatgaggaatgagggggtcgatttagtgccaaactgccaacgacgcataggatcgttggatctaccggtgcacctcgtcgccacaggtgaattaattgcactaactgaactaaaaaaagtcagatcctagcactattgtcagttgttttggctactagcttttcagactgcttgaccatacgtttctttcacaaattttatgtatagaagttttttctttagaaaatcaaataaaaccattttgcagactgtcccatgcaagtatatctccaagagaataacagggttgggcagtacagctacaagagaagaacatggctgggcagagctatatattaggaatgaccaagccaatattgaaacacatgaatagataaatcacaatattgaaatctcgtggcatgttgaatcctatagaaaatagatgagtaaatttcacaaagctacaaatactataacaaaactacatatttaactcggtgtatcacaaaactacagatttaacgttgagtttatcacaaaactcaacatttaaaatggggtatcacaaaagtacacattcagtaacaaaattatcatataactactggtttataaacaatttagttacaaaactataatcttaatagttacaaaactacagtgttaatagctccaacataataattgtgctagaatttcaaactctaaaatctataattttgtgataacttcaatatcaaatatatggtttattatacttggctttaaatatgttaatgttttgtgataaatttagtgctaaatctatagttttgtgatatacattttaaatatgtagttttgtgattttttgattaaaatacctgtagtttgtgcaattttctcaaaacagaattgcatgtataattgctccatacatatcattgtgagctttatgaaatttactcaaaatagaattgcttgtataattgctccaatcgtgtctttggatatttcacaggaaatgtataggaattttgagattatgaactcagatggagtatggctgtgttattcccccttctttcccaactcacctatgtttttttttccatgcacacgtttttcaaatttctaaacggtgtgtcttttgcaaaagtttttttagaggaaagttactttaaaaatcatataagaattcatttttaagttttttttactaatactccatccgtttcataatgtaaaactttctagcattgctcatattcatataaatgttaacgaatctagacatatgtgtgtctagattcactaacatctatatgaatgtgggcaatgctagaaagacttacattgtgaaacggagaaagtacttaattaatcacgcgttaatggacaacactgttttccgtacacctcccgatcgcagcttaagagaagagagagaaagggaggtgttgctttgtaattctcattaaaaaataacatgacgttggagggtatatgtttaagattctttggaattaggccacacgaatgaatttcaaacgaattttgtaagcccaaatataatcctacaaaccaaacaacctccataggaaaaagtcccaaggatccaaattcgtcatttttcatttgaaaatcctcccatccagaggggcaattcccagatgccactagcactgtccagtatatatatatgttgttcatcgtcccgggcgtgacagcgtgagatccgcttgtgtacccaacactcctatactttgatggtcagtctcctcgcccttggcttgtgcaagagaatcacaaattcacaaaggcgagcgtgcgtgcgggggagaagagagggagagaaaaggataagtttactgtgcacatatatctcaaagcagattcgacggtcgaattcaaatgatgtggggtatttattgtgtaacacaagttgtgtagtaggactgtaggaagtggcttgtaaaaatgctaccgacttggccaccatctcctcgcctacatcatctgtcttagatatatattatctattaaaaattagagaaaatcctataaatagtaagaaaatattcgctaagctgccatatggtgttctaaaaaaaaattagagaaaatcctataaattctaacaaaaaaataaaacatctgtctcttgattgctgcgtaaagtgatgggtccagaactataaaccgttagaatctgttgatcttaaaccaatctaaatactagtcccacatctcctcctgtggcagcataggtagtcacgctttcatccccttccttttttcccatatatacaactatcatcggtgatatataaaagttttaaattatgatgatatataaaagttttaaataatcataattttacaaacaaagattataacatcgtataactctttgtaaatagaggtaactaaattagctctataatgtttggaaataaaattacaccactatatttttacccattaaactaataatataagatgattttcagttttcctgttaaaccggtggactcattactttgaattattattttaaataatgcaccattttaaagtaaagtttgcactattatatcattatattatttaaccattaaattaacaatttaagatctacataactaatttacatttacacttaaactaatggacccattatttaaactatcatatctatgttttcattaataaacaaagccttcgaagttccttctctagcctgctacacaacacatgtctacaactctaccttccacacgagcgacgaagtgtcgtatctaaggcagttaaggtgatcacgatagctgcaacactaccactttgccacataccaaataaaatatggataacgattagttttgttagtaacttggaaccaaattaaaggtgtgatgcagaaagagaagaagtaaccatcgtgggttatgtttttctaacacttggctccgtttaagctgaaacaaagagcatacgggttataatgtattgtatgaggtcgtatttagatttcatccatacagcccaaagaaattactatttctccatgcaggcgaaagaaattattatattataaatgtgagcataatattaaccaatatcaatacacttcttcctaagacaagagtgttataagcgaatttaaggctctttttttccctgattccgtattttggattttcatttgcatggttcccaagttcctaaatggtggcatgatgtggctcttgtgcaaagagtttttctttgagtatgaatagtgacaaagatagaagtaagaatgagaatatgaatatgtagcaaaaaacaaattaggtgaaccaatgttttttaagtagtcatggtttgttttgcgaagtttgattaactctgaagatgtaaatcatattgaacttattgatcataatttacaacaaaatggtattcttggtgtcggtgatatgggaccgggagtatcgtgaccagaggcttgaggcagacacaatcgcccacgtggcctggcaccttcggggacgacgggcccgagggtgaggtgtccgccctcctcctgatttccccgagggggggggggtcgggtgactcctgccccggccccgagggccgaggcgccccgaccccttgtggagttagcgccacatgaatgggttgggtgaacatggtaagcctcacttaactacatttattgcggtctggtcgaacgtgtcacgctgcatgcagcgtagtgcagtgcgttcctttatccggtccgtgaccagtcacagaccggtcagatcacgggttaggtggcgactggcggtctgacgcacgccttgccccttctggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggctatccactacgcctacctccagatgaagatgtcgggccccggtggccccatctctgtccatggcgacctgaaagtcgcgctcgcttgcatggagcagcgcgcggaccacctcgctgctgcgtccaagcccgagggtggtgacgagaggcttggcacctccgcccccaccgccccggggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagagactttactcttagatctagcggaaacttttgaaaatctccgctccgcccgcataaaactgaaccccgataagtgcgtgtttggtgtacctgcgggcaagcttctcgggttcttggtctctgcccgaggcatcgaggccaaccccgagaagatacaagctatagagcggatgcgcccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaagacatatctcagctctcccccagttctagtcgccccggggccaaatgagcccctactactctacttagcggcgaccccccaagtagttagtgcagcgttggttgtggagcgcgatgaagacaatcctcatttcgcgcacccccgccctgtgctgacttgacccgggagcgagcagggaggagaagcccccgagtcgaacggtggcctaaggcccctgacgaccggagtcggccctctgcccgcttgtcagacggtgctgggtgcccccgaccctcaggaaggccccgaggccactgcgggaaggccgcacctatcgccctttggccccgaggctaaccctgtgctgactcgacccgggagaaagcagggagaagaggcccccgagccgaacggaggcctgaggcccctgacgaccggagtaggccctttgcccgcttgtctgacgacgccaggagcccccgacccccaggacggccccgaggccactgtgggaaggccgctcttgtcatcctccgaccccgaggtcatcggcacagaagacgagtgcgccccgagaggccacttggacgaagaacgccccggggatgcggcccctagcgaagaggatcggccccgccgaaaggtgcagcggcttgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagaaggtacaggacgagtggtaaaatgggcaatcgagctttctgagttcgatctgcactttgaaccacgccacgctatcaagagccaggccctcgccgattttgtggcagagtggaccccggctccagagaccgtctcaatccctgaggccagcacggacccctctcagctgcctcacaccgcccactgggtgatgcagttcgacggttctctgtctctccagggcgccggtgcaggggtcatgttgacctctccgaacggagacgtcctcagatacttggtccgtctcgactttcgagcgactaataatatagcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatatacccagacgggataacatggttgccgatgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaatggaatcctcctgaaatgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaaattcactaagtggcccgaggcttatccggtcgtcaagatcgataagcactctgcacttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgtgccaatgcagaaatcctcaaaggccttaaaaccaagaccttcaatattctcaagaagcatggcgattcatggatcgaggagttgccagcagtgctctgggcaaaccgaactacaccaagccgagcaaccggggaaacgcctttcttcctcgtctacggcgcggaagcggttctcccatccgagctcaccctgaggtctcctcgggctaccatgtattgcgaggctgatcaagatcagcttcgcagagatgacctcgactacttggaagagcgaaggcggcgcgcggccctccgagccgcgcgctaccagcagagcctgcggcgctaccatcagcgtcacgtccgggcccgatcactctgcgtcaacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgaggggggggtcgagtgtcatgttttgggctcgggccaaccccgcaccccctcgggcgtgtagggttggccgggggctgccacacgtgcacattcttatttcttttttttcaatatttcaataaaagcagtttcaatttcctaagggctgtatctgtgccgttttttcctttttgaagaattttgatttgaaatgaggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcactagccccgacccgcgcttttcgaggactgggacttgggcacgggcccttaaatcaagctaagacacaaaaagaggatcacggcacagatcatcctcatctcattcgcatagcaaaataaaattaacacaaagaattttttcatcatttttgattgcagattgtaagttgatttatacaaaaaacaggcccgagggccttagaagaaaggaaaagaaaaaactggagtctggagggggcctgggggctcagtccgatgcgcccgggtcgccggcctcgtcgtcacgatcgtcagcaccgctggcatcgccctcctcgtcggaattgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccttccaggttggtggggcgtgtcattgactggcctttccagaggcccgcttgccgaccggcgcgatccaggcgggagactgcatcccagagcatgccgggccctatctcgcccgccaagcggagggcctcggcttccccggcggatgagtttagcgcgcgctgcatgtccgcgacggtgtgttcggcatctgcgaggcgggcggctaagtcgctttcgcccgcagccgccccgccgatgcacgccctcgcgtccagctctttttcccgcgcctcgagatcggcagcccgctgctccagtgcggctctctcggcgcggacggattccaaattgcggcgggcctgctccgtcaacgctgcctcacggagggacagggagtccgccaaccgttgcgcttcggcctcggcctcttcgagagctcactcccgctcggcaagcgcgtcttcgcggaggcggagtgcggactcctcttcggcgcaggcagactcgtgcgccgccagcgttgcctcccgggaggtgacggcggcctcgcggtccgccaggactttctccgcgacgcaggcgcgctcctccagcgccatggcgcgcgcctcgagggcctcttcacgccgccggagcgccgcttcagtctccgtcgctcgctgctctcgggcagcggcggcatcaagaaccccctgggcggcgtcgagctttttcttcagctccgcctcccagttcccgtgctgaaggcggagggagtcctgcgcctcgatcatcatagtggtggcgatgagggcagccccccgctcctcctccacctctcgggcgatctctgccagcgccgctttgcgggcttcaagctccgagacgtgacggcggtgagccttacggcccacctccaccatgacatccactgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcggggcgacagaagacgaggagaagagccgccttggagagaatgcgacgcggctcggcccgccggaggacgcactgggctcggggatgtcccccggacccgtttggtcctgggcgtcgcctggggaagtgggcccaggcgatccgcccgcggcctcgtcgcgagccgccccggaggctgtcgcctgagcgtcgcccgagggagtaggcccaagcgacgtgccagcagctttgtcgtgagctgcctcggaagacgccatcgcctcagcctggcgaacccgggcggcctcctcccgagcggcttcctcggcttggcgggcccgggcggcctcctcccgagcggcttcttcggcctggcgaacccgggcggcctcctcccgagcggcttcctcggcttggcgggcccgggcggcctcctcccgagcggtatcctcagcctggcgagcccgggcggcttcccgggcggcctcttcagcttcccgtaggcggtctgcggcctctcgccggtcagattcccgcctccgtgcctctgcggccgccgggtcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattaggtttccccgggatggttctgtctcccccatcttgcgcagccgcttcttcttgcgctccccctcgggctgcgatgttggcgcggccccctccgggtgcctgctgctggcacgcactgccccgccccctcgggaaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgtcatggcccttaggagcctgctcctctgaggccccgaccgccgtcataatggtcaagatggaggcacgatctgggtcgctgcagagggggaggataccgtgggggatgagggacgcctccacggagttgagatttagcacccgttggaccagtatcttgaagtcctcgggggcccaatcccatctgactccctggtgggtccgcatgaggtcttcggacccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctgacttggaagtcggaggcgcgcttcgtcggcgaggggggtgtagaaccagtcgctcttccagtcatcccactttttacggaggacgcaggggatgtagcggttcagcaccggcccccgcggcaggaaatagcagccgccgaccaccgacggtggcgataccgactgcacggtgaagaaccaccggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaaggggagaaagaagacggaccgccccgggtagtctggcgccgggcgtccctcacccagcattactatctcacggccggtggcagattccggcatgaagcggcgcggcaacccagcctgcttctcgctcacaatgcgagaaggcggtagcacgctaccatcaagcagtgcggagccccgtgccatggcgccggacgaagagaagatgaagaacgagcgcgtgtggcgaaagaagggcgcagggaagaaggagttaggacgcaagcggcgaaggcaagggaaatgatggcgaaaggaaggagacaaatcccctcctcagtgcctttatacccttgccaacgctgtgcccggctcctcgtttctcgcgcccattatttcgccccctcgtttctcgcgcccacgcttccactaatcccattcgcccgcttgcggcgcgtgagatggatatgcggttgcggcggtcgagatagatcgtatcgtgcgcgcgttaattacgctcgccgaccgaagcgacattaccgtatctccaggcgaggcaaatcggctcgcccagattcgtgcgccgctcaggtgatgtggcagtcttgaagagaccgcccattattgacagccaaattaccattaccggtgtgcatggtttgagaccgttgggtttttgcccaaccatggagaccggtcccacctgtcaccaagttttaggagtggcgtcacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgacgggcccgagggtgaggtgtccgccctcctcctgatttccccgagggggggggtcgggtgactcctgccccggccccgagggccgaggcgccccgaccccttgtggagttaacgccacatgaatgggttgggtgaacatggtaagcctcacttaaccacatttattgcggtctggtcgaatgtgtcacgctgcatgcagcgtagtgcagtgcgttcctttatccggtccgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccagacttcatcccaaccattacaggcaagatgctacatgaagaagggcaaacatgcacgttgctgagccgacgtgtggtggacaagaatgaccgatttgtgaccggtctgacactgctcatgtcgtcagcacacagccaccttcccacgacgtgcccgcctcaggcagaagtggaggtaggtatgtgccgtcccatcaggaggatgttcggaggacgaccgtgcaaatctccgtccatttatgaaaagaaaaaaagtccagtttggaaagggaggggtgcatgtggtatccccttgaagtataaaaggaggaccttgcccatagaaaaagaggttggttgattctttccagattcagggcctagaacaagggatagatcggctcacactttgtagctccttcatacacagatccaccaaaacacaggagtagggtattacgcttctcagcggcccgaacctgtatacatcgcccgtgtctcgcgtttcttccgagctgatgatctttccacataccgagagagcttgagatctcaccctgagcccccggccgaaccggcaaaggggggcctgcgcggtctcccggtgaggagccacgagctccgtcacttggtataaccggattacatgacagaaatactccttactataagacacttcattataggtactgcatactaattaaatttatataattatggtcttattccaaacaaatattgttcatagaaagtaataaaaatctataaataaatctaattaaaaatattgttgatattctgcactaccaaggcaagctaagatccttcaaactatggagaaaataagaaattgttgaacttctacaaagaaaaaaatatccaacatttaatttggttgtcactgcattatacgccttcatgagaccatttaatcacaagaaattcgagttgctctttccatttgcttgtagctatactgcacggtatgtatatagatgatatgtaggataattagcttgtggtagtttattatttactcaatgcaaaagatgattcaaaactcgcatgaacttaatccatcttctattcaaaagttggtgaatgattttttagatatttaatcaaaatagatcccttaagttatattatgataaaagtatattatccgatctatagtttcctctcaatgtacaaaacaaaatttttaaacaaataatgatcataccttttaacaatataagtgcccacacatgcacgcgggccaccttcctagttatatacgaaaagtctattaaatttcttacaaatactcttaagttaccatatgacatcctacaaacgttactaagccgccacgtagcactgtaataaattagaaaaaaaacctaaatactatgagaagaaaggcaaaacatcttgtcattgattttcattaaatttagttggcacattatttaccaccattatatttatattaaaaaattcacctcccaaaccagggcccacctaggcctgtaggtacatgtgtacatacggttactgatgtacatccgcacccgtcttcccttaattccttcttcctctttgtcaccaattccttctcctatttccatgctttattagttagagaagcaatttttttgttaaacaattaagaaactataacatctaaattgtacaattatttttttatccattaatatgtttatttttttatgactaaactgatattgtatgccatttaaacaattaaaaatattaaattataataatattacatattttatcatcgcacataacttcataataattaaattatatataaaatcataaaagtaaaatgtacattactatgaataatgttcccggaatatattacttagaaagcaaaagttatacttaaaaaaaatcaactatgacatctaaatcatacgactaatatttgatttgtttgtgtatttagattattttgcagttaaagattcattttcactagaattcaattttgaaagaaaagtatgtcactttgggcttatattctatgactttttcatgtcattcaaatcattacaaaattattaaaaatataatgatatagaatttattatcatatatgtaacttcataattaaatagatctataataataaaattaaaatgaacctaactctctatgtattgtttgaaagaatcactcccccattacgacattataataagtcaaaacaacaatactccctccgtccaaaaaaaaacccatcctaatatggaatagggcataatctattacaacaaatccggacaggagtatgaccaaatttgttgtactatattatgtcgcatcccacactagggctgtattcgcaattcctggatgggaactcattccctccgcaaggaaaacggagcggtccattagcgcatgattaattaagtattagctaatttttttttcaaaaatagattaatttgatttttttccagcaactttcacatagaaactttttacaaaaaacacacctttagcagtttgaaaaacgtgcgcgtggaaaacgagtgataggtgttgggaagaagggggtgccgaacacagcctaggttggggtttttttaggatgagggagtagatttgtagtgttcatattttcaatactactatgaatatactacaggaaaaagacgaatcttaatccatcaatactgattttataatattttaagttaataaagtaattgtaaatattataatatatgcacgcgtactctctcccctttgactatttcttccaatagtctcttatttatgttcttcatcttctaatttttaactaattaataacttaatataaaaacgataaacaattataaaactaaatgactataattcttaagttatatctgatttttagtttatttgaaggttgttttatttataattaaataaataattcaagatccatattaccatatttcattttataaatataaaaatacgtcatttgaatatagacacctattgtttgcatggtaatcaaataaaaaaagggaacattataaaaaaatgacaataactattgtatcaccttaaatcattatacatcctctctatcgcacttaagtcgttacatattacatcttaactaaaaatagaaccttagaaattgtaagaaaaataatatcaaatcatcggtttccacttaaaaaggtggatccattatttttaactagtagatatagttttgggaaaatcttaagccaccatgtcttatgacttaaaaattagaaaaaaaataggatattggatattctgaaaaaaattggccgatcggttcacttaaatcacatagaaaaaatagacaaaaaaaatgcgcctccacttcaacctcctgtcactgcacacaacacagaacccgtcatgccctctcttggctcaagctctccaccctccatctatcctcactattttgtatagtgagaaatattcaataatattaaaatattcatattttttaagctacacatctgattcctaatctaactattgatgtattcataatcaaaccaacaatctaaatatccagaacgcttatattttaaactggtataaaagaaaacaagaaatataaaatatcaatagggaagaaaatctgacaagttcgtaaaaaaactggttcttacttttcactaaaattacaacagccatggcatgttccattttcataacaatttttaaatgcttggatgttaatagtcttacatctatcatataccatagcattatgagtttctcctcgtatgattgcatatataagccacactatgctagcggtttatagtttattgaaaaggtatatttgttactactagtttaaatttttggactcagtattttctttttaaaaagatattataggtcacgcatatcacaagaaagcaaggtctattatatatctttattaatttgcatataagtatgtaacaacttgcgtcaatctgaaccaactataaggatgactaacttgatggtatgaataaaatatatttattaacaatgatagttaggtaggatttgttagaaaagaacccactaaactttcaattaaactagacaaaacaccttattttcaatttagacttaatttgttagacacgtttttcaaacaaactaaatctaatataagtacgagatcatagataattatttataggatctataaaatattgtatatttaaaaaactagcaaatagttatttcgaaaagattatctaagcaataccgatgaaaaaaattatggagaaatagcacttttaaatcatggcaggtgtcatccgtaatatttcgccccgcagctgggcgagataggaggatgcagttggatattttttcgacaatatgagtttttcaaatgcaatttacaatacatgcatgcatgcatgcgtgtatgtcaggctaccttcctagtttacttaaaaagctgaagaatatgtgtcctagtttgaactgaaaccgaatttatttagcagcataataagcgactatgaccagaaaaatcaaacaaaaaacaaaatgttacaagttctttttttttaaaaaaactaaaagttactacattgttactaaattattatgtaactataatataataactatactacaacttctaaattacttatgaatgtaaagttatatatgtattttctaatacttatatgcaaattacataagagtagttattataatgtagttgtagcatatatagttagtgtaattatattgcaattatactatagttaaaattgaatgctttcaacttaaaaagtttttacagtaacttttttataataaaaaaaatgactcaagaacgcacaaacgtgagtcgaagaattgtgcacatataattagggatgaaaacggagcagatacggacggataatgctcataccatattcgttttcatatttttggccggatacggaaacgaatacggatagctcgaatacggaaacaaatacggactatctcgaatacaaataagaatcgaatatgatcggacacgaatacggaaacaaatttttctcggaacacgaaaaccaattcaacttctaatagaaacaaatatcaacatatataattagctcattttatataaaatgtagtataatttataaatatttttaaaattttaaataatattaataatctggactagtgttaagagatgaactactattaaaatataaaaaggtatactgaaggtcatagagttataaagaaatggggtatgtcttatggcttctgcggatatccgaataacactgtttaccggatatcgttattattatccgtatccaacggaaaccctgataccatattcatattcgtattcgagagaaaatatccgtatccgaactatccgatccgaaaggtatccgcattcgtttttattcggagcggacggaaactatccgctccgttttcatccctacatataatacgagctagttgtacacgtgttctctacgcattaaattaagacagaatctttatgaacggtctactattcaacgtactattcaacgctacaaaccggacgtcaaaaaacatgccaggaaaaaaattgcaccattcaaacggaaccttgaagtcgtgtcaacttgttggagatgagaaaatccaaccgatgtgtattcttgttttttgttttttattggtgtgtgtatatatatatatatatatatatatggccgggatcagtaacaactgaacttattttaagaaagacagatgtaagcagctgcataaatccggtcatgtcagaaagacagcttggaagagtgcggaaaattaaggctgtgtttagttggatccaaagtttggattttggttggaattgaaaataatgtgactgaaaaattgcgtgtatatgacaggttgatgtgatggaaaaaactgaagttttgatataaactttggatctaaacacagcctaagtgagtcgaagtattgtactgtacatgctactcagtcgaagaattaagtgagcttggactagttgtgcgaccgtgtgttctctacgcatgcgcaccacaacaaattcaaattaaacgtcaaaacacatggttgcacaaaaactgcaacctgtagtttgttcaacggaaaccagtaagtcaatgtcaatgaactgatcattctatcgcgcataagttcaattcagtcagtttatcaacgacagcaaaagaaaagggggaagataaatacttcatttttgaagaccgaatatgcgacgaaacactgatagaaaacaccacaaacataacggttttataggtgttgctatgcataaaaccggcatttacaaggcgttttcgtctaccggacgatttcggtggattaataacaaaacggttaaggattaatgagtttatctaaaatgtgtgcagataattagttttaaaaataaggtatttaggtgttcttggagacccctataaacataatgcaatgcgcgctatagattgcaagcgggccgtaactagtcgcttattttcacatggagctcattaaggcctagtttagttcccaaattttcttccaaaaacgtcacatcgaatctttctacatatagatgtagcattaaatataaataaacacaaaaactaattgcacagtttacatggacatcgtaagaaaaatcttttaagcctaattagtccataattagccataagtgctacagtgacccatatgtgctaatgacagcttaattaggctcaaaagagattcatctcgcagtttctaggcgagtcatgaaattagttttttcattcgtgtccgaaaataccttccgacatccggtcaaacatccgatgtgacacccaaaattttcttttcgcgaactaaacacactctaagatacttgcatgcaaaaatataatttcgtaaacacaccacttaagagcctgcatgcaaaaatgaccatattttcccgtgcggtcctattaagtggccacatgccaaaatagattttcgcatatggacctcttaagtggtccgcatgcaaaaatgcccctcatcttctacatagatattttctctcctcctctttcttttccctctcaacactttaaattttttccacttgacctctcccctcactctcattttctccactccctctgtttctattcctctcctctcctctctctctctctcatcgagcaggagcgggcagcacggccaatgagaaggcgccaggagcgggcggtgccaccgcgcatagctcagtgggcacggactccggcggcagccgcaggcgagggccacagcgagggcaggcgtgggcgacgacggtggcccttcctcgcccagatccagcagcggcggccttccccagctacgatctgtcggcggcggcaattcccatcccaatctgctagcgactgccctcccccgcccgaacccaccagccaccgccctcccccgcccctatgtgctggtgacagccctcccccaccccgatctatcggccaccaccctcccccacccggatccgccggcaagaagagaggaggattacaacgagggtggcgacgatgagaggaggacgacatcgacggcggcagcgataggaggatgaggacaatggcggtggcagctggaggacgatgacaactggaggatgaggacaacgacggcggtgactggaggacgagtacggcggcgggccgatagcggggtattttccgatttttggaatttttatttttcttgcgatttttccttttcgcgtgcggtcgggttaagcgccttgcgctggccttttcttccaagcggcccgcccatccgcat

SEQ ID NO: 17885 - DNA, 467 bp, Oryza sativa
ccagctccacccccgtagttcattttctaggagtagctctgccaactccactccaaaaaaaggtgaatctggaccgtttggcacagctcccgctccaggtaagttggagttgggagctagagttgtgccaaacggggccttagtctctatatttagacactaatttagagtattaaatatagactacttacaaaactaattatatagatgaaagctaatttgcgagacaaattttttttaagcctaattaatccataattagagaatgtttactgtagcatcacataggctaatcatggattaattaggctcaatagattcgtctcgcgaattagtccaagattatggatgggttttattaatagtctacgtttaatatttataattagtgtccaaacatccgatgtgatagggacttaaaagttttagccctatctaaacagggtcttaggggctgtttgggatgt

SEQ ID NO: 17886 - DNA, 582 bp, Oryza sativa
tgaacaggggaccgaacggggccgaggggggttcggccgaacccttggtttggccgaaccagggagctcgccgacgggctccagattcgcgcacgggagcccgacaccgtagcaaggggctgcgcccacagtgcattcaccccttccattgtatagtgttccactgggatctattgtttcgccggtgttggctctccgtcaagattgtaggtagagttggaggaggagccaatgtatgggatcaaggacttgccagccattggtgaattggaagtgatggagcaagggaattgagatgagatggagaggaggattgcaaaagtgggagagaggaggaagaacaggtgctctgggtctgatacgactaatctacctccgaaagctcatcacaacggactgcaaacgagcgggggagactgctattcaaagttggggctgatcgggtgccgcttttatttggctgaaccctggtgggtccgactggccgccaactttttcctaggcccactaaatcctaagctaagcacaaaaatgacaactttaccgggttttaagcatgcattagatgagaccattatggtt

SEQ ID NO: 17887 - DNA, 280 bp, Oryza sativa
cggaccattgtcagttcggcggtcaaaccaacctgatggcccagtcagaccgaccgtatggctgcggtcagaccggccgtatggctgcggtcaaccggccagaagacctggtcagactggccaactgcgatgagctggtaccagcttcggattttttgcttgaggactctccaacttcatctccagaaggattggcacatcatgagaccctactttgatggtaatcacttccgaagtccttgcctccaccttaatgcgctttccttccctcctttcttca

SEQ ID NO: 17888 - DNA, 1259 bp, Oryza sativa
tcctgcagcccaacaaggagccggcggtagtggcggtgcacagggcagccagcaagcgacacggcagcggctgcgctaaggttagagcaacaacggcgacgacacgaccgagggattgaaacctaacccgaggggacacggatagaagtctcaccgaaccaaagcgatcggagagggagggtcgacgtttacgatccggcggcaacacacggagacgacgacgacgctagacaaacaacggattagattagattggattaagaccctaggaaaaaatctacaccggtgaacggcatgggagcggcggttgccggtgaaccatggcacaataatgcaaacgggggcaccgggaggtagagaaggcgacggcgattcttaccaacacttacgcgacgacagacggcgacggaagatggccggtgacgagcttcgaagggcggcaaggtactgtccacggcggcgacgattttccggcgacgaacgacggcaacagaggggtggacggggttcacttcgcagctgcgatgccgagggaggctgcggcgaagcttggcgatgacgggaggagcagcaaggcctcaccggagatcaaaacgcgatggcgaacttcggcttgacggcgacgatggagctccggtggatttcggcttcggggaaccggctgccgggcttcatcttgctcctgcgaacccaatggagtcgatggcgacggaaagcggcggctaaggcggctgctagctgcggctggaggcgccgcaaaggccgaaaccttctggttcgcgtcggcaagcggcttccggctggatttggcacgaaggaaccaaaggccagggtagagctcgactttgcggagccgagggaagtggcggcgctgaccgacgacggccggggcgacggcgcacggcggctggagcggcggccggaggtggagagagagggagctcgcggggagagtgcttccggcaacggcggagagagggagaggtggcggccgaaagaggagaaggagggggctctatatatagccatgggagcccagggatcgagcccacgacgacgggaaaaactcgggaaagtttaggatttcgccggaaaaaggaaagattgaaccacgaaattggaaaggatttccatagaaacttttggggatttcttggggaaaaggaagaggagattgagaggactccactcccgcaactaatttggaaaaaggagcaacgaggtggccggatttcggaaggggatcggcgacactgggc

SEQ ID NO: 17889 - DNA, 737 bp, Oryza sativa
tgtgattgattaccctgaggctagtgatagtgaagatgagggtgatcatgatatgtatgctgctgaatggtcatggactaacaaaaaaaagccttttgtttgttctaacttaatgccgactcctcgcaaagatcggcaaagtgaggttaaatatagttttgatgtggccaagtgtgataagatatttgattatcttttacaagaaaaaaaattagattacctaaaggccatatcgtaccatctcaagaagaattgaaacgtcgagcttattgtaaatggcatgattctcattctcattccactaataattgcaatgtgtttcaacgacaggttcaatcggccatagatgaaggacgattgaagttcaccgatggctccaagatgaagcttgatcatgatccttttccggtgaatacaattaatttcaatgacaagaaggtgttgatttggccggagcaagccgaatctactaaaggaaaaggagtaatcattggtgaaccaaggccaaagatgatagtaccaaagaagccggaggttggtgtttggaaagagaataaaagtgaagcttcaacttctaaagctcctaggaagactaaagtgacccttgatatgcttttggagaaatatgaaaagcagggtggtgagagagctcacaacaaggggaaaagaccaagatcacctctttgggagcgatttgttcactcgctaagacggtcgcattcacctccgggggatcc

SEQ ID NO: 17890 - DNA, 759 bp, Oryza sativa
ttcctgcagcccttaacaatatgaaaagttcaaactgttcccctaagcatgaaatttaagaattcttgaacaaaaacatatgtactactcccctgttatttttcctttttgatgacttcatttccaaattgaaaaggaaattcatgttgctttttacaaattgaaaagcaattactagagtaatatatgagaaatgaatcacttacccaatcaccaacaacaaacaggcttacaagcactgggttatgaagatctcttttagtttgtaatgaatagatatccagacaagcaagtccaaaactccaaagaagctgtagacccatggaagcaatcaagtagctgaaaatagggagatcacaatatcgtcaattatgtatatagattatatcacgtatgcactgttgagctcctgctcaagcaattctgaatagtagtaaacaattttcatactttgcccaacttggtctcaaaacattaagttaaaaatggcacccatacaataatcaaaggatgtaacatgttgaatgttgacacattcatacacaacatctaatggaaaaattctcataagatgttaagttaaactttaatagtcacaaagaagagaacagataagcacaccaaatcattgggcagtcctgcctttttggtttaagacagataaataaattgtttttggtcccttcctggcatggaactgaattatatcaggaaaaaggccagtaaagaaactgtgagaaaagatcaaaacatcataac

SEQ ID NO: 17891 - DNA, 230 bp, Oryza sativa
gcatttgaagcctcttgcagcaccaatgaccaatgcatcacatttatttcatcacctacacaacacaggataacatgataccaacaccaacatcaaacacagggacaaaccacacaactacccaacgctcagaagggaagcacgcggacacctgcatgacggaggtcgacaaggtcgctcgccggttcaggaattattaacccagcggcggagtgaaaaagtaaatgtcg

SEQ ID NO: 17892 - DNA, 838 bp, Oryza sativa
ttcctgcagcccgtcgcttaagttgttcctccccgattctattcccaggccgcccacactattgggccgcctcatggaccacgtgtacgcgctccgtatggaacaagttcactttaggtcacttcagctgaactttttttatttcattataaatatattttcttaaagagctcatatcatataaaactaaaccttaatcttataaaatttttatatttgttataattttaattagccgtcgcaacgcatgggcattttttctatgtcaaaaaaaagaccacgacatacaagtgagagatatataccacacacacccgcaggctcatgtttaaatgaactggcaacatattttcaattataggtctaattgttttatttaggtgattaaatttgttttcatttatataattagtttgctctatttaagctttttaaaaattgctaaaaatttgagaataacttttcctacttcgtattatattatttttagctaatggaattaatggaaaattaattatatattttttatcttttttatcaaaggttactgcaattttatttcattattattattattattattattattattattattattattattattattattattattcctttatatttttttcccatctgtataaatgattaaaattacctttacccgttgcaacgcacgggcacagtaaaaaacaaaatcactctggacaaggtccggcacggcccggcccggcccattgctatcttccgttccacccgctcccgttgagctcaattatctctctccgatccccttccttccggatccatcacccccaccactacatcaccc

SEQ ID NO: 17893 - DNA, 1083 bp, Oryza sativa
agatttacatggatttgtttctctaatggaaccgtgcctaagatgagaaatatatgattataggttttgctagattccaatgaccatagagcactaatcttctttctttacagttgtaggaatccttgataaggctgatggcttcgatggatgagcctctttatcccatcgctatactgatagatgagctcaaaaacgaagatattcaattgcgtctgaactccattaggaggctctccacaattgcacgagcacttggagaagaaagaacccggaaggagttaattccttttctcagtgaaaataatgacgatgaagatgaggtgcttcttgctatggctgaagaattgggcgtgttcattccttacgttgggggtgtagaacatgctcatgttttgctaccaccattggagacattgtgtacagtggaggaaacctgtgtccgagacaaggcagttgaatctctgtgccgtattggagcacagatgaaggaaagtgacattgtagactggttcgttccagtagtaaaggtaagaagtttattaatatttaattgttttttttctgtagagttgccagatttatcagttcgctgccaacttcactatgtaggtttcttgttactttggcatacaattgtgtgatatttgtgtttgtttcttgcctgtcaattgcaattttgttatatattgttgattgttctccatagaagctattttaacacattgcaattgttgactggaaacagtgccacaatggcattagttatcatgctttcattttccttttccttagtccattccatctagcaccactaatgaatactttatggacagactattttacactacatcgtgttgtattcagctaaccatgcattactcttttcagaggctagcagctggtgagtggtttacagctcgagtatcgtcttgtggacttttccatatagcatatccaagtgctcctgatcaattgaaggcagaattgaggaccatttatggtcagctatgccaagatgacatgcctatggtccgaagggcagctgcatcaaatcttggaaagtttgcagccacagttgaa

SEQ ID NO: 17894 - DNA, 1113 bp, Oryza sativa
tttgttgatccttttgctgcttatgagactgctcgagacattgctagtggtgagggtccctctggcacttctcgtttcttcaatgaggagtcctctcactccgaggagagcagtgatgatgaggagtcaaatgcccctaccgagaatgttcttacagatcccgatgaggcagtggacgccgccgggcaagacatcgactctcctcactccggcgacaccgagatcattccttctgatggcgatgatgatgaggcttgatcctcttcttcccttgtgattttgtctctttttggtgccttgatgccaaagggggagaaaattgcaaacgaaggggggtcaaaattttgtttttgatgcttactgcctgctatctgtataatccggaagttccggatcctcttatctggaagttccggacctgacagctccctctccttattgtcatgtcagcttatccggaagttcctggtattttatccggaagttccggacctggcaatcctttgacccctattcttaagaactcatggacatgttctaattctctatttgtgtgaatgtaatgtctattagatgctcttagccgccctttatttatactgctcttcatttatgctatgagtgtcttatttgttgtttgtgttatgatgttgattttatcctcttgagtgctcaccatgtcgtatcttttgcatataatatctattcttactgctttttgcatcccatgaatgagtagggatgaaggaaactctcctcggttgctcccttatatatatgcatatgagcttctctcatatcttccatatgcatacattaagggggagtttcatttacctttaaccattcaaaacaaaatttaattcaatcttttgtaagctttaaccatgttgtcatcaatcaccaaaacgggggagattgaaagtgcattaatccccctagtgggttttggtgattaatgacaaatgtggttaagggactaatgagttcattgagtgactttcaggtgcattagtccaaggtgtggaagatggatgcttggagacccccaaaaaagtacaaaatcaaagcggaccggaactcgagaagggcataggatagtttatcttttga

SEQ ID NO: 17895 - DNA, 1625 bp, Oryza sativa
gggtgatcggttttgcatagttaatggacctcatatatctggttttgtggtttgaggacgtttttgtaactcgatgacaaattgagggaccttcggtgtactttttccatattttgggctagcgagatcgcttatggctccttttgtagcccaatccccgggaggaaggccagcgggagaaaattcaacgggccaaatcttcttgtccatttggaagcctacaaggtgggaattttatggcccaatccgcacagaatcgtgaggtcaagaaaatttcctctagctcgatacattgcgccaccgcttctccatctcgcgattgcgagcagacgatgccaccgagcctcctccagcgagatgctctcaccggtcctccttattcggtctacccctaccgctctatccctctctccttagatcttgggtatgcccttcttctttcccctcttctcctagagtttccgggtttcctatttgacaaagttggtgatgagccgctctgtcctaaagtgaacaagagttatgttatggttggcatgtctctatcttaagaggatttttccattggaatgggttagtttatctcttagatttagggtattttatataaatagatggccatattgaaagggtcttgagaatcgttaattttgcctagaggaggggtgaacgggtgctttgtgatatttcaaaacttgcagcgagattagaactaactagacaaaccgacacaacttccggtagtccaactatagatgagttggatagttcgactgctgtaggacaatccgattagtgcaacgataggaaaaatgataagtgacccgattgtccaattgctccaggacaatctggttaacacaaggatagaaacttaagtgatatagtaagaaacaaactagaaggtccacttaagcatgctttctacaagggcaagtgttgacggtcattatcgatcagttgcgaccgtcaatattaccaaaatagaggagaactagttatgcttgcaatacatatacaagttagaataataatattccactagtattgggtgtactaaccttttgcagagaataaccataaagtggagaagaattgatatcagcacatttcataaatctatcgcacgatgtcgagaatccaacttatgcatgaatgggccaagaactcagaattgacataatgcattgggccaaaattcccaagtctaagaagtgaagtaatggaggaggccacatacagaattcggccgaaccccctagcaccgttggatgcagggtttattttggatggcgtggatcactccccaatgacggttggagagcaattctgaccattccaactgccaccgaccatccccaaggagttcactctattcacttcaacacacacctcaagcaagagctctctcatattctctcaagttagtttagtattcttaagctagtggaataggaatatagtagaaattaagtatgggtttaggtggcttccttttctttttggtaagctttgtattttattttagaataatttttctatatccatttatggtattgaaatactttccgagtatatgaatacgttctttacattatgttcatgttatactgaatatactgcta

SEQ ID NO: 17896 - DNA, 1255 bp, Oryza sativa
ttttaaaaattgctaaaaatttgaaaataacttttcctgcttccgattattttatttttaacctatggaatttaatgaaaaataaatattttatttttaatctttttaatcaaaggtacctgcattttaattccataataataataataataataataataataataataataataataataataataataattcctttatattttttccccatctgtataaatgattaaaaatacctttacccgttgcaacgcacggcacagtaaaaaacaaaatcactctggacaaagtccggcacggcccggcccggcccattgctatcttccgttccacccgctcccgttgagctcaattatctctctccgatccccttccttccgcatccatcacccccaccactacatcacccatccccatccatctctcccccctccctttcctcctaaacttcagcggccacacccctcgcgagcccctcctccttatactcctccgccgccgccgccgcgtcccctcggtgcccccctctccgccgcccgccgatccggccccgagaggtgaggatccgcccgtcgctccccttcccttcgctcccgcgcgttagatctgcgccgccgaccccaccttgactggcccgcggcgcccccgatcggcacccccaccgtcgaggatgaggcgcgggggttaggtttccggtggccgccgtgcggtgcgcggttcgcggctgcttttttttttgggttaatttatgttgccgtgtggttcatctgctttagatctgcgccattttggttggggggaaacgttggttttgacgcggttggtacgaatcctgcgtgttctccttcggggctgtgattttgggggcggattgggagggcttattatttgccgtatgtgtgggtgcttctagtgggatgttacgtttgtgcgttggtggtggtggtattggtctcttgtggttcgatttggttcttctgttaccctgatgtgatgaatcactcgccgcacatcaaatttattcttctgcgttgctattttgtggttcaatttgtgcctggaaaggttgcaatttgtggttttgaaaatgtgcctggaaaggtgaaaaattatgttaacgatataccataaaaagctgagagggtggtccttgatctaattcgaattaagttgtctgagcttcattcaccagctgaaattcttctgttttaggtatcttgtttttagatctgttgacgacacagggctgcaggaa

SEQ ID NO: 17897 - DNA, 737 bp, Oryza sativa
agttgtttactaccattgcttcacgattgttggaaacctgacttgctttgtttctggcattctgtaggaggctacaatcgaacaacttcttcctattttcctttctttgctcaaggatgaatttcctgatgttcggctcaatataatcagcaagctcgatcaagttaatcaggtgatgttcatgtttttttcttattgaaatgaatttatcttatcttttgtgatgttcatgctgtttttattagcgtgaagtctaatttactccacctcaacaattattttagtctagaaatcaaccctcaactatgacaccagacattttatacacacttcgactatcaaaactggctagaatacccctcaagggcaaacctggttatttttttaaaggattctcactctctaccagcctaaccttgaggtattgactacctgcagtgtttagaaaacatcagtcccacagctcaatataacatttcaattttgcttccctaatgactgataaattccttggtcatagaaaattcattactgagtccttttgatctttcaggttattggaattgatttgctgtcacaatcactgttaccggcgatcgtagaacttgcagaggataggcactggagggttcggcttgcaataattgagtacattcctttattggctagtcaattaggcgttggatttttcgatgacaagctgggggcactttgcatgcaatggttggggggtgcag

SEQ ID NO: 17898 - DNA, 1912 bp, Oryza sativa
ttgtaaatttgttttattttgaatttgatttgaaatttcagtttaagttctcaattgccatataatataccactttaatatttttttccaaattcaaaaaaattgcaatttaaacatatcttttgaagatagtatcagagacaaacagaaaagaaaaaaaataaagagtgagagagagaagaaaaagaagaagaaaaagaaaaaaatggttttttttttctctcgactattcactcttattctttacaaaatgacagtttcgtttgtaaatttaaagagtgtgagagagaagaaaaagaagaaaaaaagaagaagaaacagaaaaaaaaaagggagagatggggggtcgaaagaagaaaaaacggagaaaagaagaaaaatggatgaaatgggggatcgaaccctgctccatagggttagagtagaatcctactaccactatgctatcgttgagttgatgaagatgaatgcctccgtagaaatttaaatcatcaagacctcagcgccaaatatgatgactcaacaaattcatgccacctcggatttgagcttagcgccaacaaaagttggcgctgagacgttatagctcagcgccaaggtccatggcgctgagttcacggcctatttttggttgaagttttttgcagggactagtttcgaaataagtttttaaaaaagactaatttgttaaaaaaacggtggttgtggcggctccattttggggaattttttttgacttagattctaatttgctacatcaatgtctgaacccaacaaaccaacgtaggtgtccatcaattcatctagcaagaaaaatcatagcagcatacaagtggtaaaacatgttgaaggatacaaatatattacattgtgaatctatcaaatattaattaagagagccatcaatgcgagcagtgcttttgcatacgtagcaggtcgatgaccacatccaccaccctagaatccattgccacctctagattggtgcacccttcctctccactaccaccattccgccatggctccaccctcattccgccatggctctaccctttgaagccctgccactaccaccatcgctgaaaaaaaagtaaagggaatatagggactcacctacgctggctagtaatgatgacaatgatggacgaggcgttgctcggtcgatccggatggggcgggagctccgtaagaagagagcaacaccaaagttgttgtttctctttccaagatagcacacatgctaaatttaaagatagggttggtgcatctactagattagctgctgatgttattgctgttgatgagggacgaaatagataagcaagcagctaggaatgctctaagcccgtaagtgtcatgattagctggtaaagaagctgatgtgttatccgtgagtagaatgatgggttttttgtccggaaatcatacgttacaaactgttttagatcttggtctaaaaacaagctcaatcaaatttttgactaggaaatggtgcaaatcatatcaaaggttcagattgttcctcaggataatgaggacaaactctattggattcctacttcttcaagagcattacttcaaaaagcaattataagcaggtttctaatatttctcacttccagttcgtttccactgcaaggagcggataaaattttggatattctcggcacgcttttcaaactactaaacagtgtgtttcgtgcaaaaactttctgtatgaaagttgttctaaaatatcagattaatctattttcaagtttgtaataattaaaactcaattaatcacacgttattaccaccttgttttgtgtgaagcacttaatctttatctttatcttgtctcctctaacatcacctctttacagagtaatctccttttgaaaacttggtccactaaatacattccttctaa

SEQ ID NO: 17899 - DNA, 2032 bp, Oryza sativa
aaatagctgactactagtctaaaaaagccagagaatctaaatatgagttagcagctctaaattaccaaaatattagtcatgcttgtaataataatacttgtcctacaaagcaacttatgcaagctactccttggaaagacaattgtgtatctcttgtgcacattttccttctaatgtttaaataaaaaattactaagttgtaaaaacactgtttttagagcacatggcaaaccgcttttctgcagaccgaggagtaaaaagactatcactgacagatgggacccaccaaccattgtctctcactctctcccctcgcaccgcagcttctccaatccgtcactttccccatccctcccgcgaaaagcagacagacgcccacaacccaccaccacgtctagggttccgccgctcctccggccgccgccgccgccgccgccgacccccctcgatctcctccccgagccgccataggtggtggcgggggcgggggagctagcatccgtccgtcaacgcacatcgtcactgctgcttcctggtgagcatccatccgtttcgcatatcctctttctcatccctctctacccacccactttttcccctcgaattcgcgtcaaccctagcttctcttctagatctgaaagctgctgcttttctttcaatttgctattcttaatacgaataacagtttcgtttgttccccaaaaaaagtttgggatgaatccccatgtcccacgttagatccgcccctggttttatgtgcggtattgttgtttgtggtatgggtaccaacagctttcgttgttttcaccttttgcagaaatctgccaccatgtccgacatggagtccatggctacacttatggagtccacaggctccaagctgcagcagcttcagcgtgcatttgcagagctcgagagccagagcgctgtttccttgaacttaaagtggaagcaactggaggaccatttccatgggcttgagcagtcgctcaagaaaaagtttgatgatctgaaaaggcaggaagaggagttcgaggagacggttgcaaagtcagagcagatgctggagcaacaagaggctgttgtcgtggcaaaggaactgacttctcttgaaaaactgcagcagaaaagggatgccgcgttggctgtgatctttggcaagtccaagctgaacttgtctacgcctcttatcaacccaatcagcaaatccgtgaataacaatgctgtgtttaatggaaacatcggtggtagtctttctgttaagtggcccaaacctgcaactgcgcatggtgcatacctgcaagatgaaaacactgctgtgaagcctcgttctcaacttgttgtcctctgtgaagagatgaatgttaacgggcttcataagttcatatcagacaatcgcaaagacttaacatccatccgtgaggaaatccccgttgcacttaggggagcaactgatccatatggcttggtgttagcttctctagaagacttctattttggagacaatcttatattggatggcaaaaaggatggaaaccttctgggtgtacggaggacgtgcctcatgttgatggaatcacttgctcagctgcaaactgatgctactactggtttcatatcggaaggtcaagtgcttactgcaagtatcaaggagcgtgcaaaaaagattgctcttgagtggaaatccaagttggatagccttgactttgatgctagcaatgggaactgcctggaagcacatgcgtttcttcaactcctggctacctttggtatatttgctgaatttgcacaagatgagctgtgtaagctacttccctcagtcagtcgtcgtcgtcagacacctgagctttgtagaatacttggattgtcccagaacatgccaggtcagtgctatcatcgattaataatgcagcttgttccattgagcatcaataataaatgggattttctatttccctttgtcactcagatgtttagagaacacattttgaccacttcaataattgttcatatatctatatagggctgcagg

SEQ ID NO: 17900 - DNA, 793 bp, Oryza sativa
taggttctatggctgtcaagtcgtatactgtaattgttcactcacttatttgatttatttatcctggaatagttaaagtacggggtttgatcatatcataaagttagcaaatcatttagccaccaatcagcttcaatgtagaagctgcagtgctgttctgaagaacttgaataataaagagctactttagcttgcaagatactattcagctatagttgcttgctaccttttctttcttgtgtggggtaacaaatattttctcttcttgctggtctgtacattttttaagcatatctgcgtgcattcctaattaattgtgattgtagtatatctgatgaattaccatattattcagaatgaaatgaatgaacgagagctgtctgccttgaaagctgctattaagtgtatcgaggagcacaaacttgatgagaaatatccgattgacctgcttcagaaaagagttatccagctagagaaagctaaggcagacaagaggagggctgttgaagctgcaaagccacagtctaagaggcctcgtgccaatggatccgtatatgcgccacatactagctttcctgacaaaagcttctaccaggctgctccgccgcagaggcattcctacccttacgagaggcagtatgtgtatggtgctgaggcccatcaccatcccacaatgataagctcagctccctatggcatctcacctgcccacacaacatattatggtaatggctatcaggttcagtaccaggtaccatatatccactgatggagagagcgggctgcaggaatt

SEQ ID NO: 17901 - DNA, 706 bp, Oryza sativa
gcactaagataaatcttgatctaatgctaactgatctaggataggatctctccttatatagatggagaactccttatcctaatcctaacataccatgactctatccaactgagttgtgttcatactgcaaaaatactacatgagcgagagcctaccactgctcctcgccagacctcctcctcgagctcctgcctcctcccgttcaagtggttgtgacgatcgcggtcatctagacggggatgaggttgatgggccttcttgatgatgcattttgaggagtacggtccaggtctcgactagggtggggaccgtgggcgtcctcggcaacttcgttctccgttactctgtcatcggtatgttgtcggggatctcgagcaggaccttgcggggttggttcggctgcggtcaagaaagcagagttgaggttggctattgtcgactatatatgtctgacctagttgtccgcctccgggaaggttactgggtcgaacggagtttacctcagtagagagttgaccacgcacggtgaagtgtttggcaggagttcgaaccggctcgactggttcacgtggtggaacaggagctcgcggttcatctccaaaacgaatctcgccctcttcgtgtatgtcctcgacgactctttcgatcacattcacttcgcatggggagttggatcctgaagattcctggtcatctaagttgtgaa

SEQ ID NO: 17902 - DNA, 1099 bp, Oryza sativa
ttcctgcagccctggccaagtggaggaaggtaggaggcagtggactgggctagggctaaaaagtaaaaagaatgagctttcggcccaaaaccaaggatgaattttgattaactttttcaattataatgtatgtagggatcccaatattacaggaagaaaaccctttacctatcgattttgctatatatttgtcgacaaatttttccccaaaaatttgacagatgtaattacagtataatcgtagtgtaattacactgtaacttgcatgtaattatactgtaactatagtataacttgtatgtaactttcaaaaatctctccgtaacatgttatttcggtaaaatggaggtcgtgggaacaaattatttcacatatgtgtgtgctatgatttattttcttcctcaccaaaacaaatcttgtaatagatctaacgattcaaaattatgtgtagttacatgcaagttacagtgtaattacatataagttacagtgtaattacactataattgtactataattatatctgttaaatttttggggaaaaatttgtcgacaaatgtatatgtagtctcatgcgagtacttttctaagattaaactggtaatagctaaaaagttaagattaatttcatttattcaacacaagaaaggaaaaaaaacgtgtagaagccatcgtctctctcttccctagcaacaacaactcattcctcgcttgctggctgctgctccgtcgcctttcccatctccaaccaccactccactccacctcctcctcctccgccgctgccgccgcgcagatccgcgggcaaggggctacggtgcggcggcgccgccctgcacccccacgccgccctccgcaccgcgcgcgcatccagcagtcggaagagttggaggaggaggggatgaaggatgtggtggggagcccggggacatggagcgggatgtcgctgcgggtgtcgcaatgcgtcttcgccggcgcctccgtcgtcgccatggcctccgcctacggcttctccaactacaccgccttctggtaccctactactaccgcctttccacgtctctctctctagcctcctctttccccctggggctgcagg

SEQ ID NO: 17903 - DNA, 1747 bp, Oryza sativa
catgaaaactacatgaatcatgtccaatccagacatagggaatcagacatagggaatcagacataaatgagagtatgacatgaaaaaaattgcgattgtattagatcttttagggaatcagagatgaaacactggcaatatgggttgttttctgtcagtttgcgatcaattttataccctttcagtaaaaaataactaatggtctagaattgtgcagtaaaatacattttttagaatggatacacaaaacatatgtgtaggtttctgtcgataacttctttcattatattataacttcggtgttccctttcattcttgaaatattaccgtaaattagtaatcagctgcatttccggtgccatgtcaatatccatgtggcacttgtagctagatggggtagtatgccaaggttttcatttccctgtttgatcacttgtttgacccttctttcttgaagtgctaacataatttagcaagagggacattaaagaacattatatttggatgtattgcaggttacagcgattctttcgtttgcagcagcttctgcttctgctggtgtcactattctttttgagagagacgtgcacttctgtaggatgtacccgcagctttcgtgtggtcgttacgagctttcagttatcttggcattcatcacatggtcgttcatagctacatcagctgtttccatgttttggttactagcttcgctttgaatcgtatcattatcgctgtcatgttgtgctaaccatcaggattccatcaaatgtactctgcttgagacatttagattttagatttctgttaatgaggaagcatccaaatcattctgagtaggtattatctgcttggctcaccaatctttggtttggaaagagtttatttgacaaaagtcgggcagatcatgagaacagtaatggagccaagtaatgttgtcacctagaaatcttctgtattaaggtcaagggtatgtatatagcatcgaaaatgaagggccgtgttgcaccttcatgtttggtgaagttcactctgacgaaatttgaaagaggtattggccatatctcttcctgagccacaccataccgtatgagatggagaaaaatggtgatcacgtgatgcaggcttggatatggattgtgcaaactgttcaagtgtcaactactgaaaaattttgggttttggagaattagatgcggtttcaaatgaattgcgttcagcactcagcagattggaattggactctgattacttggtaacttttgcggtgtaattttagtatgaattttttgcggctcatttttcgtccttgataaattcagtttgaatacacaaaatgttgacacttcattccgatcatactcttgcttggaacaaaatcaaaaattgtgaagcaaacgaaattgccactggctagatgcatttaggggtataagtggatcagccgcaaacccgtttattttaacttattttaacctacaagtccgtttattttaacttattttaacctacaagtggatttcatgggttagccatttacacccttagatacattcatgttgaggctagagaatcttaaggtttttacctgtgtgctattaaaaaagatgacccttgcctctatgccactaaaaagtttgagtctctctctatgctattgtcgaactttatcgcgtcctccacaccattccgtcgctattctgtttgggtttaaccatttggcagctctgacatgtgggcccaagtagga

SEQ ID NO: 17904 - DNA, 678 bp, Oryza sativa
aaacataccattagtataattacatcgcaacccagtaggattagaaagggtatgtataacccacataatttttgcaactacaagatgtttcttaagagtgatcaatgagcaacattagttttttacaacatacacctttgtcatctcgcagatcggtgggctgctgtccagcaatgatgtcgatggcctccaccaccgccagccccttttgcccttcacccatgcccagaggacgcaaatgcacagttcgagttcaaggtatccgtctactcaatctatgcagtactctgtaatctgatcgatttctgatttcttttgcttaatttgggggtacacagctggagctgccggagcggatgcatctgataagtcgctcgagattatgcgcaaattctctgagcagtacgcccgccgctccaacaccttcttctgttccgagaagtccgtcaccgccgttgttatcaaggtaatggaaccaaatctattttctacttctctcttgaatcctcgttaaactttacttttaaaaaaatctcactgcgtgcacatacaaatcaaatactagcaaaaatcatcttagccacaaacaaattcttctatgctgctatttcatgtgttctgtacctgcagcttgataagaagattattacgccctattgctgctgttgaaagttgatg

SEQ ID NO: 17905 - DNA, 683 bp, Oryza sativa
aagattacatgctgatgacggttcgcgactccaacccgtggtatgcaaccatagtgaattacatggtatccaaatacataccaccaggggaaaatcaacgaaatttgaagtacgaaagtcaccgtcatatatgggatgagccatacctatacagggtctgcaccgatggcttactaagaagatgtgtgccgactgaagaaggacttaagatcataaagcgatgccatgcctcaccctatggtggccattatggtgcattcggcacccagggtaagatttgcgcaaagtggcttcttctcgccaacaatgtatgaagattcaaaagaattcgtcagaagatgcacaagctgccagaggcaaggaggaatcactactcgtgatgcaatgcccctcacatacaatttgcaagtcgaaatattcgatgtctggggtatagacttaatggaacctttccctaagtcccgtaactgcgagtacattctggtggcagtcgactatctctccaagtgggttgaggctatgccgtgcaacaccgtggatgcgaagcatgccaaaaagatgttcacagaaatcatcttcccaagatttggtacccctaggatggtcataagtgacagaggttctcacttcatcgacaaaaccctccgagacctcctacgagatatgggagccaaacacaatgt

SEQ ID NO: 17906 - DNA, 389 bp, Oryza sativa
tggagttgagatagtcccagtactgcagaattctggaattatgtgctctgcttggtggaattatccactaattcctttctgttgcacttgaaacaaaattgttgtcccaaatctttttatttgatgatggtagatttttgtattttacgagttcaactgcaaagctttggatctactatttcaatgagtgtgcctggagtccaatcgactcaattaagtaactgttagttcatattgaggttactaatcaaatacagaaaattaatcatggtagaatatcagatgacccctggatagtatagtactatctgaccaatcatgtcatttaattcctttatttttttgttctgtacaacgccgccaaacattggcgttgagttcttatttgg

SEQ ID NO: 17907 - DNA, 568 bp, Oryza sativa
cgcagccaaatgacgctcttgcccttagccatgtttcatctagccaaatggcgctgcggcatcatcatcagcatccgccggcgccgcctgagctgcagctcctcccggcatccaccacggcgccgttggccgccgcgtttttgtccaactccaccggttcctcctcccacgagcaacacgtgacgacgctgcgacgacgacggggcggcgccgcgacgacgacgacggggcggcgctgcgcgacgacgacgacggggtggtgctgcgcgacgacgacaacagcggcggcgctgcgacgatggcggcgacggcggcgttgcgatgacgacgatgatgggagcagcgctgcgacgacgatgacgaggcgttcctccgcatgccccctcctcctcctctccgcctcgacctcgccgctgtccttccgccgcgggcccagctccgcgtctctcagcgccgcgagcgccgccgccgcctcgtcgaatgcctccttccctccgcctacgccgccggccatcacggccgtcgcctcctcgggcgccgccgccacgggggtcgacttggccatggg

SEQ ID NO: 17908 - DNA, 2960 bp, Oryza sativa
aagtgaacttattcctttccacgttgtacgatcttttctcagaaacaataattaattttttcctagagtgatggaaaatgttaaatgcatctgtaattctgtatgcacgagcaatacgtcttctttccccaccgaatatttcacaagcgttaaactatgtactcccacaataatgtatggggaatcatccagcatattttacatgtgtgggccaacagccgagatggaacaggtgcaacaaatagattagcatctgagaaattttagcacttataggattattttgctatagaaggcaagttccactgctgttctggtggaaaaggtacatgtgtgtttgcacagatttttttttattgataatggaagatttcatttggtcattggacgagtacacatatgatttcactctcggaaaccacctgcctcttagttacatccaaaatgcatgaccggtgcacatctcaacatggtgtaacatatgatatcttaaccaactttgcacaattaaataactcctaatgataaccttaattaattatcactcacttcattgtcctaaatcaatttccattagcatgttgatgccttttgtccattaggcaataattatcaggcatttgtgagttacatccaacatagtgtatcattcattcgccttgtcatgctattcaaatgaaaaccgcaccacagtatgcgacaaacataaaagtgtaaatcatggagcctttaggaatggagttaaatgccatcatatgtgtggcatatttacatgaatgccaccgtctattctgatactacctcctggtaagttgataatacttattcttttggataggataaggacatggtcttgaaaaacaattttaactattaatttttattataacatatataaaaatattaataaatatatactttttgaagaattttttaaaaccaatctctatagatgatcataattctaagaaaagtattttagatgctatttatagttaaagtttttaaagtttgattataggctttgtccataaagataataattattaacttggagatagtagttagtagtgcgttatgtagctttccattaagatatatattagcattttaatattatgaatgtgttttcagtagaaactataatgacacaattttctagctaactttaaaactgtgaaggcgtagattccatctttttaccattagtttttgcaaattcttatggtttaacaacatgcaaattatatgcataaaagtatttcccatggtgaatctaaagaaaatctgatgatattatactatatgagtttttaaaagttaatggttaaagatgaaaatatttgacttcagatgaactagagtgtaagaaaatttgaaataaaggagtacacgaaaccaaaacacacattgaacaaggacggtccagtggactcttgcccgagaaaactccaaatgctgtacatagtggcttaatggtaatttacctcgtagcaaatggccacattggggttcagaaaaatgtcgtcagcaggcccctcgaccagctacaattgtatatcacttggcctctggccagattggtggagaaaggcaagttctcaggctgcagaggaagcagagctccaatctgttcatgccaatggctgctggcacctgggtgaaggtaatttctcttgcttactcatacatatgcaattgattgtgtactcccttgatctataccttttcataagaaaggtttggttcagttttgggggaatttttttggctgagatttgttcatgttgcaagagtatttggctatttgctgcttcgagtgatggttatggacatggattagttgggaattggggcttgtttctgaaggttgttcatatattttggggagggttgtggattgaccctgctaggatgaaactttgttctaacccaagaattttgacatttggggattttttttttctagagcagatcactaaggaatcagaacatgaggcttagaatttttgtttttaaggaattagacttcgaaaattgagtagcatgttcagaagctagggatttcagattataaaaggttggggtttaattagcgaagaagtttcaggttgtgatgctatgctgcggtgttgattgggtaacagtgacggattgatagccatggacatgaaaatgagttgggaacttgggttttatgttggtgatagtaactgtttgaagattatataaagggtcaaatatcttcggtgtatcttgttgattccagttttccaaggtttgttgacaatgaagattattcgggagggcgttgtcagaatccatttcagtttcagctctctggagttgaccaagggattttgattccaaatttccagggcgatagcaaaatgctgacttcaaatttatgtgtcaataacatttccagtcagttttgagaagtacaatttgtgttattcaggtgtttctgaaaactgtcgactgtcttcaatatcagatgcacaaagaaaccctggaaatgcagaaattcgggccattaggctcatgaacatatgcaaataaaaagcgccgccacatatagacatccacatattagatgtcacttaaactaattagtgaattcctggaaattttatagaaattacaatcctgtatagaacgcaagaatttcatagcaaatactaataatcttcgaacacaaattgctcagcgagagagtagtaattttctttgcagattgcagcatccagttttgtctaatttgattagtaattgacatcagttaattaattaattaatcacgcgcagctagagcagaagggagatgggccgggagcaagaagctcccacgccatcaccctcgtcggcggcacggcgtacgcgttcggcggcgagttcacgccgcgcgtgccggtggacaacgccatgtacgccttcgacctcaagtcgcagtgctggtc

SEQ ID NO: 17909 - DNA, 689 bp, Oryza sativa
ccatgttatatattttgatactactagttgaattactttgctattactgaagagctgttctgaacttaatttggtacccttcccttgagtacttttggttagaaatatttcaaattcaattaaccatatcatttactttgatgcaggccaaaatatccatcaaattttgatgcactactaaaaaactatatcagccttctaagaggttcacttttgaacttagtttagatcttagctatgcatctatgttatttatccttttttttttctgatggaaattttacttatagatctttccagaaagatcatgcaaggtatagccttggcattgggtgggccagttgatgcttttgaaggtagaaccgcaggagatcctttttgggtttgcaggttgattggttatcctgtatcaaccgatattctagaagagcatcgcactgacactggctggtaagcaaaatgtatctatgtatttatttggtagtatattgtgctagaatgtacttactagattcatctgacaccgtttttctcttatgtcacatccgttctgcgatcaattcagtggagctcacacagactatggttagtacttagtacatatctttcagaagttcctttcgaaatagacttttatatatggacaacacatacataaggtgctttgatgcattgtaaaaagtttcacg

SEQ ID NO: 17910 - DNA, 627 bp, Oryza sativa
agtagttattagattgcgtagacgcggtgtctgggtaagaatttctagtggttgctgcgtatcccacagttcgattgaggtaggtgtagaggtggtgacagccctcaagagcacttaagtcctctctgtccaggtacatactatagcgacatctgggaatagcggattgccagtgcctgaagtattacgttaagattaaagttaagctttccctagacattgtttctcaccagtaaatcctctctatcctggcctatcatttccttggtgtccttgaatgaaccagaggaagatctgatcacacacgttcccttggattcgatacccttggaatactccgtaggggaagtgctatatcggtatatccgtgcgcttgcggattttatctgtgatcggtaagaaataccaacagcagcaaaggtggaggaggatacgctgctcccgctgacacgcagtggcacagcttggggggctccccacgacaaggggaattgggggatggctatttctagatatttttccccacaacacccctgaagtcatactagtcacattgggcctgtttggttgctaccctgagcaacctgcctgagtattttccatccctgagggctgcctgagcttgct

SEQ ID NO: 17911 - DNA, 754 bp, Oryza sativa
tcaccttgctgcagaaaatcgtggcaaagaattgggggggctttggcaatctgacgcgcacagaggaaaggagagagttagaaattttgattcccttcagatctggacaaagtactcttctttttctacttacctgctagctctcacggtcagagctacgctctaacagatcaccaaatgcaggacttttactggaaaaagaaacaactggccaccagatctgcaagttccttggtcaccgctgctggagccatggaagaatcgatgggaactggtctccgcaagaaccctaggctagcagtgaggaggaggaagaagtggtctcgttttcactactgtatagaagagcggtgattttactcaggcaggtggagcgaaatgctcaggccacccattttgtacgcctgactcaggcgagtacactcaggcaagatttatcaggctagaatcctcagggtagcaaccaaacagatgccaggcgagttacaggcatgaccttaggccaggcttattatgccaacgaatcgttggatcactagtacaacccactactatagcatagtacggtgaaccataaaggaactctatctttagtgttaagatagcccctaaaatgtagcaaattatagaaatgcaacaagtgctacaataaaatttcacaaacagtattattgataaatgatgtgatatgatcttggagtgcatacacgtttgttttttttgttccgcaaatttatttgatgaagggctgcag

SEQ ID NO: 17912 - DNA, 696 bp, Oryza sativa
aacggctaggttatgatggccacctaaaaggatattaggccgtaggcgacaaaaagcaatctagtccactagcaatggttgtgcgcatgggcggatttaccatacaaggtgtgggggccctggaccccactcaaaaattactggcgccaggtatatcactaattgtatgacatatggcccccagtccaacagataggaggaccccatttttgttacttgcattgaatccatgcgggcgttgaggacttgaggcgtcgaacgtccactaccatcctcttgttaatcccgcaaattagctcttcaaattaggaataggggaacggaaagcaagcccactgtcatttcgtccgctacgctccggcccaagcctcccggcgacgggcctccgctttactacggtagaagctagcatttattaagtgcaaatgaatttgtatcacaactcaacagattatcttcaagatttgtgctagtatttgcttttatacttggagattaaactatatcactagtggataaattattcatactaattacatcgtacttacactataattacatactgattacatatgtaaatttatttgggacttacatatgtaattttgcgacttatgtatataaatatgagagctacattataaatacactaaaattaaatatgtaatttaggaacttacaatataaatacatacc

SEQ ID NO: 17913 - DNA, 516 bp, Oryza sativa
ttgaacattgccgaaccgttgacaagtttcacatcctctataatatttgaagcaatcatcaatcatcctcggccaatagaaccccgctctcctaagcaaccaattcatcttgtgggccgattgatgagtcccacaaattccttcatgtacctctcccatagccactttagattgatcttcatctaagcacttcaacaagacaccatctatatttcggcgatataaatcttcatcaagcaatgtgtacttgaatgcttgccgtcgaattttccgatcaaccttaagcgtgggatctttcaaatatcgaatcaaaggaatcctccaatcttcttctgtttcttgggcacaaatgtccgaattcacaattaattcggccttaaaattgattgaaacgtgccctccagcgctctgcctagaaccggtcagaccggccataccaggtgtcacaccctgaagttctcctcctaagcctaaaattgaatttataaaccagcctaagaaaatgccggtgcaaat

SEQ ID NO: 17914 - DNA, 650 bp, Oryza sativa
agagcaacttcacataaatgatgtgtagtattaagatgagctaggggattaagcaagtaatatacctcatagaaaaaggcaacagatacacggtaacgaggggaattgttaacaactcgatgaagtgttggttgatatattccatttgaccaaacctaacccaaatatgacatgtgataagtgtcacaagtttgatgacaataaaaagatgacaatgaaggtgcaaacgaagaaaaaaaaagaccttcagcatgtcaccaatgttgcagacgaaggttcccgggattggtttggcataaatccactcacctgattggtttttgacctgaaatatattcaccagatatttcactcaaatcaaaattgtttgcttcacccagttaaggctaaatatgaacagtgggcagcaactgtaatatggtaattacataattacttatgcatcttagaacatgcttagaatgttacagaagtgtagaagcatctcatgctagatcatccagtgagaaattctatataaccatgcacagctcagatgtgctctgccatgaaaaaaaatactgatctttaaaataattaaaaagaaactaaaatcaaggtctcatctttgatctgtattagttcccctcttctttattattataaggaaa

SEQ ID NO: 17915 - DNA, 692 bp, Oryza sativa
tagtcccggttggtgtactaaccgggactaaagatcaaatatgcccgttaccctttttaaccggaactaaagatcatctttagccctggtttttattgcatccgggactattgtggaattcgaccgaccgacgaaagatggtttctccaccggtgtttcaaccgttgcggatggcataccctaagctagtccaaaagtacatagtatatatagctgaagatgaaagtccctggctagttgcttgtatatatgctgaagtaagaagtgaactgtcggtttgccctccaaataaatctagctagcacacctcgagattcccaattaagtcaatcagtaataataaataattatgaacccctaattaagaccaataagaaaaaccaaacacaggaggaaggaacggagcaattaaatataagagtgaaagcgacagggcaccggagcgtggcagttgcgtaaattactccaaccctttctctccatgcatctcacctccacagcgacccaccacccttctttctgccatgccttacatttacatacatacccctcctctcaggctctcactcgcgctgcatgccacactgcttcttcttcttctctctctctagctagctagctagcttctctgtaggctgtagctgcggtggcaatggcggcggcaaggttgtgggtggttgcagtggcggtgg

SEQ ID NO: 17916 - DNA, 734 bp, Oryza sativa
tatcaagctcactccctatttttcccatacctaattgcatgattgatttgtgggcccttgcatacgcacttatcagtcatcactcatcatgaacacaaatcacagaggatccatcatccacgattaggttccccatccttctctggaaaaaaaaatatgatactcattaattaattgagccatcctggacagatcatattatttgtcaatggagactcaacgtctattttgtcatatggacagatcatatttcacaattacaagaataccatcttagtctgaacacaaaaatgcatgccctcagtattatttgctttcggatttcggtgttgatgaagttcaaagataattaatccaattttctactactctttaatttgtgcttttgaaccaattaatgaagtttacagccagtgtttacaaattttgttattttcatgctccacgtgatccgtccatttgtaatacaattaaataataatcacgatgattaattaaataataaccacgatgatgaattaattgaaatgaatgaaaataaaattgcatgcaggcgacggggtcggcgccggggacgacggggtacgtgaacatcacgtcgcacaagggcgggaagatcgacttcatctcggaggacgcggacgagagcgcgaagccgtcgaggtacgtgaagtcggtgaaggagatcccctacgacatctccgtgctccaggtgagctccggggctgcaggaa

SEQ ID NO: 17917 - DNA, 674 bp, Oryza sativa
tattcaaaatatcctaattaatagatacaattgcctttctgagagcttttctccatcgtggcaatccttgcgaagcacgttgatcgattctagaagcagttttacaactgtcttcatcagaatcggctaataagctgtgtcggctgtcctctgtccgatccatctcagccgatgccatcgcagctgatgcatactctgttctttgaatctaactctttgccgaatccactctgagtccaatgccaaacctagttcatatcttaccaaatttggtcgttaacactaatatggatacaaccattgctcacatcatgaatcaacaataatacatcaagatcaagtccttcaagtgctggaatccgattcagccaccttctacattgttgacttcaaacggccgccaaatctacatacgagctctgtttttggcccatgagtatttggtggaatgctcttggagccctctttccaaccgatctagcctcatctccatattccttctctgacagttgtaatcacagaaacaagatgtagtgtcacctatattgggccaatgggcttgaaattttgtttgggaccccagcccaagtggggcccatgtgaggtacgccccaactaggtggagcacaaacctagggacccctagttcattctcctacctccttaaatagcta

SEQ ID NO: 17918 - DNA, 611 bp, Oryza sativa
tggacaccatatcggttagaaacagagattcatattgatcaagttgatgaggtcgatggccgatacagccgatacgtacggtttaacttgggctcggtataggcctagattggaatgattgtcattgccaattaaagatagagctcgattaaggcaattgtatctattaattaggatatttaagtcggttttcgttagatttggtaagaggccaccatatatggtcttgtttgtattttatctttagaaaggtttgagtcatgtccataatggactaagtctgtacttggggtataaatatgaaccccgtacaactataatacgagagacaatccaatacaacttcagcacatcgctaccctttttgttcttattttcggcgagttttctcaacaagaggtaacccgtctcaatggcttgtgctatcggggctattatgtcattttagatgttctagttcttttatcatgaccatctattatcatatgtcttcgttaatctagccttagtatctcaatttagcctatcggctggttctcgctttagggttcctgccggtatcgtctaaattgccttactagattagcttagctaaggcatcgggctgcagg

SEQ ID NO: 17919 - DNA, 600 bp, Oryza sativa
ttcctgcagcccggtgcgacaggcccaaccatccacctatactatccaatttcaatagactaaactagggtgagactaatcacggtgaatctggttgaccgcccataaccgcgggcatggctattcgaatagttttactctgattagaggtgtacaactgtacccacaagacatagccccacgacacatttccgtgtgccgacatgccaccacgacataccggaaagaggccgtgacaggacccttcgcataaccccctataaccaagcacaccacacctcaggtttcacccccagtcctcgcaaggtagcgggcagtccctctcgtgcctaggtgaatccggaagcgacagaggccgtcgcagggcccgccccgctccatcacgcccacccttgcctggatgcgtcagctagaggaaagctacactacaagcccagccgttgcccaggctggcttgtggtaagtacgataagttcttccagggcatcccgcgaaccggtccttaactgccaagggtgcgatcagcaaaaccatgcacccacagcccaccatgtgattcattttaattaaccaacaccaaagcggtggtactaaaccaac

SEQ ID NO: 17920 - DNA, 1656 bp, Oryza sativa
attcctgcagcccgaatcttgcgatcctactctccgttgaggagctccaaagagctgggtctcaattaaccccttgcctcacttgtgcaaaaacccctgaggaaatccacagccttcaaccccaaacacccctaggcaaatttctagaattgagtgaccaccaagatccaactcaacctacttctagaaatccaccacaagtgtgggttgctctacttggaaagcctctagaatctcagcacaagaacttcaccaacttacctcgttccctttcggaggagaggaaatccttcacaaacttacccgggacatccacaatatgcaacggattctcgcgggcgacacctaaccatctaggagatcatctccaagagtaataagcaccgagatgacagcccacgagatattccaagtgctcacccaagatcctagtcttcacacatctccaaatcttcttctctccctctcaatctctctttctcacaagaattaggctctagattgagtggagaagacaagaaacacttgggagaggctagcaatagctctaggtttgaaaaatgaaagtggaatggccaaggaacgagctggaatcgagctgtatatgtatgacggctaggtaacgtcatctagccgttactcacaaatttgaactggaaactagacaggaagttccggacctgaaagaccggaacttccggactacacttaggaaaatctttttcacaagaccggaacttccggacctggaagacaggaagttccggacttgcatttttggacagatggagtatttgcaaaaatgactcctagggaaacttgacacttggttcacactaagagcacttgatatatctcagagcatcacctggaacccctcttaatagtatagtttttcctaaaaactcgatttcaaaagataaactatcctatgcccttctcgagttccggtccgctttgattttgtacttttttgggggtctccaagcatccatcttccacaccttagactaatgcacctgaaagtcactcaatgaactcattagtcccttaaccacatttgtcattaatcaccaaaacccactagggggattaatgcactttcacctacatcccgaagaagctcctcctggcccgcgtggcgtccatctcgatccactccccctctccccacgtaggacatgggcttgataggcggcggcgttgggcgggagccagagccggtgttagaggagaagcggaggagcgagaggagacgatgcggctgggggtggtggcggctagagtgggagaggaggaggcggaggtgagccatgcgatggcggggcgtggcggcggctggctttgggcaggccggcgccgccagccgacggggcgaggccgagcggcggggagttggcggcagcagtgtcgacgtggcctgctcgccggagcgctgcttcgccctcgcgtccctccgcgtcggcgtgcaacgagctgcacgaggatgcgaggaggtcggcgatggcgaactccctgggcgcatcgcggcggtggagggcggcgaccacatctgtcgcgccgtggcggcgctcatccgaccgtccttccaccaccagcgccgccgcgctgccttccgccctcacccaagccacctctccgccatgtccgtcgccg

SEQ ID NO: 17921 - DNA, 1374 bp, Oryza sativa
gtcaaaacatcttatacggagggagcaacaaagatgcatgtgcgttacaacaggtaaagacaatttcacgattgataaaaactctaccaatttaaacgacaaaccgaaacaagacaaacaaaaccatggcaaaacaaagtcagaaatcatatataagtattgagcacactagcttcatgcatcatcatatgaaggatccttcatgtacactttcccatagcctcacaaattgatcgggtggctattctattatttgacacgtgtattttgctatacctcattgaccgaagattgtaattttgattattcaattagtgaaattattttactgtaaatggaaagtatttgcaaagtaataaacttgccgcatacacaccttaaacaattataatttcaaaagaaaaatatttatgagaagagaaattcggaagagaaaagaaaaatgagaaaatagacgagattgaaaggatcggaagagaattaggatgattgggagaaaaaagaaaaatggaaagagaaaaagatgccgatcgagggaggggctagtgcggcgccaagtgggggtgaggatgaggatgaggtgacgagatggtgtggactggttaggttgggctggtataatatttattctagactcacctcgaatcagaaatgtcgaccaataatcaaatcaaatacggaaaatgtatggaaatttcggacggaaatgtttttatttttttataacttagggataaggaaagaaacagagacgtagtagggattaggcgattgaacagtagtgaaaaaaaaaagaaaagaggaaatatctgctggccaaaatcattgtgtcctcgcctgagggtgtccccatcccatcccgtcggctgggcgtggaggtggagtcccgtgtcgcgagttcggccgccgctgccctgcgccgatctccatccccgtcggttgtcctgctgcttccgccgcatcctggtgagtatccatcctctttctcgttcatctctacccacccacttttttccttgaatttccctgcgttaattctagcttctcttccagatctggaagcttcttttctctcaattttgatcaccttacaaataacagtttgtttgttcccccaaaaaaatttacatcacagtataccatgtcccacgttagatccgtccatgggtagatgatgttgctatgttctccgatttgtgtgcaatagcgtataaaattcccttcaatgttccttcatccatgcgcaggaagaaattaaccgaaccattttagtgagatattgcgtagtttcgatgaagtttttgctgtactgtgcggggatttgtttgcagtgctatttgggttgcgcgaaccaacagcttccgggctgcagga

SEQ ID NO: 17922 - DNA, 291 bp, Oryza sativa
cacatcctataaaaaacatcatgactacaacaagaccgctcgagcttcttcatatggatttatttgggtccgtggcctacataagcattggaggtaacaagtatggtttcgtcattgttgatgatttttacgcttcacttggggtgtactttctccatgacaaaagcgaagctcacgatgtcttcaagcgcttcgcaaagcaagcccaaaacctctatgatctcactatcaagagggtgcgaagcaacaatggaggagaattcaagaacactcaagtggaggaatttcttg

SEQ ID NO: 17923 - DNA, 680 bp, Oryza sativa
ttcctgcagcccttatattttaatgatggaatataaaattagataaagggtgtagcagcaaaccatggctcaatttcaggaatctcttccttctgcttttgctttggaggcctcccaggagcaacttcaatcaagttcgggttcatgactacttctgcctttgcctttgcaagttgagcttgttttactttaagttctttagcttgtgcttcaccaaattgattctagaaggtcaaattattagggtaagtaaaaggaaatatgataagtaaatacattttgaaaactaatcttaaaagttgatccttacagaccttaattctctgcagctcagcttgccttgaaagttttccctcctcaataaactgaaatccaggccttctagggcggaggagcttgttttggttgatgcccatcctttcatcaaagtgtgcacttgattttgcaagggaatccaagtctggtttgattatttggaaagcttccttcttttgcttatttatgttaacctacaaggtataaccaaaagtgacagtcattgcacagaagagttactgataacatttcatagtattcatgctagtaaaataagagatttacttttagagtgctcaaattggttggcttggtcatgttgataacattcccatgttcatcaatttccctaccctgagcatcaa

SEQ ID NO: 17924 - DNA, 2305 bp, Oryza sativa
ataggaacagatgatggcaccacaacaggtgcagcattgagcggttgttgagcaccagcctgaaaaacacagaaggtgcatccaatgagaatatacaggaaggatattaacttcttatacatctcaaacaatactgaaacaattgagcatgttcttatcagtaaatcagcagagacactgaacaggtacttccaaagttcatcatcaatgcaaggaaaagatctaatggctagttggctcctaatgttggatcaagttttcctaataaagcaggaggcagtattgccatagctgcattactctcttaatcaaggctaaaaatccacctagtaaccagtagtatcgctcatgtcaaccaacaatacaagcttatcccttgaaagtattgtgcaacttgaacaaattggacaaaagcactaacgatcaatctatcaacagaaacatttcgtaagaacagaactaaccctcctggactcctgataaaaacccttcactcccatatatttactaaagaattggcagattattcaccaacataataccatataaactacagaaatgtgactaagatgtaatctatccagttaataagttatccaaaacaaaataaagcaatcatttcttagataattcttgacttcatcactagaaaagaaaaatatggagacagtagcaacacttacattgggcaccagaccactccgggaatctccatttacagcgccatggtttgagttatccttatcacccttacccctctcatcgccatgcttcccattcgcatcggcgtcctcaaacctccgtcgctcccgcctcggcctctcctccttcggcggaggcggctccacggaagccctcgcccgcttccccccttccgggtcggactcgttgccaccaccctcgtggcccttccgcttccgcgaagaaggcggcggtgcctctcggtcggccgagtcccggcgctccacggagtccctgggagcgcggctcgacgaccgctcccgcttcgcggcgggcggcgggggggactccgacggggagagggaccgccgcccgccgtcgcgatggtggccgtggcggcgggagcggctctcctcctcgtcgtcgcggtggtggcggcggcggccgccgtcgtcgtcgtcgtcgccgccgccgccgcgcttgtggcggcggtggtcgtcgtcggcgtcgtggcggcggcggtggtggtcgtcgcgggagcggtggtggcggtcgtcgtcgtcgcgggggcggcgggaggagcggtcgcgatccatggaggcggggaggagggagagggagaggcggagacgatgggattagggtttgcgtcgaggtggctactatgggagattgggaggggcgaaaagcccagcgagattgggatctgcgggcgtggccgatcactttacatatgcttaagagcaagtttaagattacagctaactattccaaatcatctgtaatcaatttaatagtcaatttatataatagttaccgataaatatatactacactattaatatctggtctcacctatcatacacacaatatgtcttaaaatccatgctcatgctgtagctatagcccgctgctcatctctctcttcttctaacttcttaatatgtgtttatagcttgtttatagtctgctattatacatgctctaagcaggctttagaactgacaaagagtgacagactcgataatttctatttcttttgctgtatttattgactataatttcttaaccaaggatagcatttaatcttttggattaccaacataaaaggcatttttattcatacaatttgattatataacatttataccatataattattaatgttccagtttttccacttatagttttggacatcgataattcacacgattttaccattttttttatttctaatatcctaaaaaaatggttactcttggattcaaatttattccacaaagattatcatgccatatttaaatttctttccgttctaccctcaaacatcctcccctctcaaccatttctcacattctactatcaacaatcatttcctctcaaccaggagtaaatcatttaacgcattgcatttttttcatgaaccttaatctttgcttttaagagaaacctagaataacaatctcttaagaaaggtgatagtagcaataaaattattgaaaatataatgctaactttcgaaaaccggaagaagaaagcaggaagaagggaaggggtagagaaggagagagaaaaagaaaaataaaagaaaagaaatattccttgacatgtaggtcctagagtg

SEQ ID NO: 17925 - DNA, 841 bp, Oryza sativa
tgatgcagaccattcagctggagtactactagcttgattcaacgagtaactataagccgacacttgaatccatagacgacaggtgcacgacaaaagaccatcagactattaagaacaggccattcacgcaaggactccacagagttggaatgaagaacgaaccaggcagtaccccctccattttatattagaacttcattcatatcaaagacgttttaccttttttttctaagtcaaattttaactttgataaagttcatactcccttcattttgtgtctagattctttaatatctatatgaatgtagacaatgctagaaagtcttacattataaaacagaaggagtagaaaacatggtatcaaaatatatttaatgttaaatttaataaagccaatttgatcttctagatatcaacatatcggtgtccacatcaagagccaactcgtacgatgcaagtactacaccgttaccaatagctacagtcaaaaatcacattgcagtgttggcatccattaaaatcacagaaaccaaggcccaaaactaccatgtaaacaaacataataatgtgtccgatcttgctcaattacaacatcatcaacatcaaacacagagaacgaggggtcggagccatacattatcatcttgggaagtgtttggtctgttactggggctagaaaggaactcttcaaactaaagtgcaaattacaaatattccaaaatttggactaagagaatcaagttctaaatactggacaggaagacagttagcttgacatcatgatttgatcgcatgcctgaagggcctggtttgcatagtatcctacaaccccgggggatcc

SEQ ID NO: 17926 - DNA, 692 bp, Oryza sativa
tcgcttcgtactgcagatcctggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggtacttcttggactccacggtcagcaggagtctgccacgcgacatcagtcgaagatcctgtatggaaatgggcgacgacagctccaggacattgatctgggaagagggtttgcgcacacgtggaatct

SEQ ID NO: 17927 - DNA, 58248 bp, Oryza sativa
  unsure (1)..(58248): unsure at all n locations
nnnnnnnnnnnnnnnnnnnnnnnnnnnnnnnnnngttctgcagacctgtcaccatcgagggagtcagctagttttgttcaatggattaattacactacgtggtatggctggcagtggcaaatccatatgggttcctttttccaactgtttttcaattagatccatgccaattatcaaagagaagaaatataaaggcaccctttggagaagtttttcctgtcctttgaaattccttcgaattaattctatataccaaataagtaacatacataggagttatttttttggattaattggtttttactacttttcttaaaaaaaaattcaatccaaaggagccttaagagtggtggcatagtgctaggagcgtttaaatctataatctgtttaaatctataatcttacgtcctctgtctctttgtttggtagccgtttatgtggcagcgctgcggcgatgtatgttgtgcgcggctgtgttgcttgctactgtagctggttgccctgccagccgaacatgccttagctaatcatcgcatcaaaatttgtgaaagtggaaaataattatactgaatgaaataaagtgagaattagttgcattgagatttaataaagtaggggtattttattttttctattgatacgagtgggatagataaaaaataaagttatttaggacagacggagtaactcttaagatgaataggaagtgtttatatgtgcctaatttgaaaagctttgaggcctgaacctacaaaaggctagtcataaaatacttatattagacttgatatatataataatataaggtttttcttctccataaataatcacgtggtgtgttttttaatatgtgtgtgtcagctctatgctgtcatttgtaccggtttgtatgtgtcaaaaagttatcatctgcatgtctatgtcattgtgaaatattgtgtgcgtccaaagtactgccaatcaactggtacggattatgatttctctagaagaaatcagcaattattaccagataacttattcgcctcagtgtccggtgaattcaagcaacatggctcttctttcattttattgtttgaaaatatataggcggtgctaaactttctttttcagttgaaggtggtgataactctaccacaccataaatctcaatattataaatcacaaatggggaccatcaaggaaaaacaatcgagaaatgtaagaaatcaagttgaaaatttgtgggctttgatggttacctggtgctggaccaattacattattgggctgagcttcccatgccaattcaataaatgcaaggcccaattagtataattttattttatgtcacagtacagtggataagtacagttatctggcttctcaagatctaggaacatttctccggtccttggaaaaggagaagtgagcattcgtgtcttccaaattccactcatagatctcaagattcaattcttgaaattaagtaaagcctatggcaaatccttgtggctatgtgtggtggaaaccctggggttctacttcatcccacattcatcgaatcagatgaataaaaatgggtctaaagcagctagctatgataaaagtgatagaaagtaactttctattggtgatgtaaaaacggagctccaaagattggtcctgagacgatgaatgtgggtagtagagaaatataataccaatttttataaaaccatttttccatcgaaggcggagttgaaacacatagacacatcacacatggtataatgtaatgtgccgcaaactaaaaataaagttgaaagatgttaattgaggaatgcaaagctagcaatgaggtcaaatatatcataccaaaagtatatgggcccaatttagagtttttttcccaaagagtcgagtgattttcttacaattgggcctgttggctctattatttttagtaacacaaacaaaatggtcggtggtatagtgctgggagcgtttaatactattaatactttaatattaactcttaagatgaacacaaagtgcctattgtacttaatatgataagtgtggaatcctgaacctacaaaagttgtaaaatgtttatattagactttagaaaaaagtccaaataaccctctaaactttggatggaagtccatctaacaccctgaactttgaaaccggacatttaacccctaaactttataataccatttatataactcctaaggtggttttgcatagtggtttttttttctaacttgtatataagttggatgagtttgatcacatgcttcttattggctctcacttataaacaagtaccaacttaataatagcatgatatcattgtataaggataaattaatgacttataactgatgatatgcaaataagttatattagttattcaaaattggtcgtttaagctttcaaaacatgcaaaaccatcatccaaaacccaaaccaccttagggggtatatggatggcataacaaagttcaaggggttggatgatgtccggttttaaagtttatggtgttaaacggactttcatctaaagtttaaggggggatatttagactttttcctagacttattccttctccataagtaatcgtgcgttttttaaaatatgtgtcaatgtctatgcagtcaaatatttgcattgtatgtttataaaagttatcccctgcatgtatatatatgccacaagtatttgcaaatcagcgagtaaggattttaatttctcaagaagaaaactgcaattgttagtttgttaccatataacttcgcttcatcatccggtcgattaattcaagcaacatgctatcttgcgccattttgttgcataaaaaaaatgtagtgacactaacctttaaaaaagatttttaaaaagtaggtggtgatggtaactctctaccaccatagatcagtacgaaattattaccaatgggtacattgcaaatattaaaagaacaattggagagagagatgtagaataaccaaacagataataacaaaagcattttcactgataggtgcaacgacgaatattaaggaatggcctaataccaaataaatagaaggggtgagacttcgaatccagaccaatgagcttaccacaagttagccagaaaaccatgggtgtttctcacgcattactaattgtaatggataaaaagtttattgaaaagcaagctgagcagatggaagtcacaggcgtaggcatttatttttgaagcaataacacaataaactactaaccaggtacaatatggactcatatatacttggaaatcatactaacgcgatagatggttcatgcaaatcacaggaggcaggagcaagcattttctttaagaaataatacaataaactaactaactaatttttttttgcggggaaactaactaactaattacctgaggtagtatctgtattcatatacttggcgatagatgatagctgaaccaaagctgtctttgatcacaaaacttcacggatattttcccccccggtcgctctcgcgcgggctgctcgggggtgacgaaaccctagctgcccgcctccacttcttccccccacctcactgccgccggagctctcgccggcggtgaggccttcctttcttcgcggcgactcactcctcggcgcgacgtggacagggcgcgcgacgaagcctccaccggctttgtccttggcgacggcggggaggtgtagggaggcggatccggtgccccaaagcccggatccggccatccctcgcctggatccggtgcggcggcggctaggggcggcttggcggtgtgcggccgtggtggtggcggcgtgcggccagcccggggcgcggacgcggtgggcgtctgggggcggcggcggcggctcagcggagggcagcggcggctcagcgatgcagcctgggcgcggcggccggccgtgtcctcggcggctaggggtggcaccctagccctctgctacttgtccttctcagccacggtagagcacgcccgccacgtgcacaccatgggtgctactgccggcgtgcggcctcttgctccgtttttgctaatgccgccgcgatggctacgtgaggtgcggcggccgggctacgggggcgctggtggccagatggcagtgcaaagggagctggcggcggttggtcgtcttcctcgttgccggtcggcaccctcgcctttcctggagctcctccccttctttgcggggagtttctaggctggattgaggtggctgctcattagcgggggaagctcagggtaccgaagcagtgccacccagtcccgggttctccttcagccagatttggcgaggcggccggcgggtggtggaacggaggggtcctgggccagttctcagggtggcggttcgatgaagtcggccaacggaggggcgttggtgcggtgtggtggcaatcttgttgttggcaggactcgaagctagccaggccagctctcagggtggcggttcgatgaagtcggccgacggaggggcgtcggtgcggtgtggtggcagtcttgtcgttggcaggactcgaagctagccgggccagctctcagggtggcggtttgatgaagtcggccgacggaggggcgtcggtgcggtgtggtggcagtcttgttgttggcaggactcgaagctagctggcggaagggcatcggtcgggtgtggcggaagccatgtgccactgttgacgcgatgtttagatggtggattcggattgggcgacgaaccacggcagttgggggttccgagtgaaagcttagcgcaatttctttgggccaacagtggctacgccttcaggcgtggtgtcacgcccagaaattcacgaaccagaatttctaagctgaatgtgcattaaacccctgtccaggaccagccaggatacacaaacgacaactattgacatacagatccacgttttacaaaaatataaaagattacaaatgcagcggaaaaagataaaagcgagctgagcctgaagacttgactcctgcagcggacgactccattccacaggcatccttgacggcagcgacgaaaccaacctcttcgagacatcttcaactgagaaggacttcaactctggtgtgggggaaaagagaggaagactgagtactacccactgtactcagcaagtcataccggaagaggaggtatgatgcaggatataaccaaaagaggttacggggttcatttgcataaagcaggcatttaaaaccagtagttgaaaacagtaaaaacagttgtagtaattaagcagtattaacccgtcactgtccaacgctacaccacgttgcaacaggcccaaccaaccacctgaactacaccagttcattaagctaaactaggggtgagactaatcacggtgaatctggtcgatcgcccataaccgcgggcacgactattcgaatagttttactctgatcagaggtgtacaactgtacccacaagacacaaccccacgacacgtttccgtgcgccgacatgccaccacgacataccggaaagaggccgtgacaggacccttcgcataacccccctctaaccgatcgcaccacaccttagggttcgcccccgtccccagcaggcaacgggcagcccccctttcgtgccgcagtgaatccagaagccgatcaaccggacacctcggccgacccaactccatcacgcccaccctcgcctgggtacgtcggctagagaaaagctacactacaagcccagccgttgcccacgctggcttgtggtaagcacgataaattcttccagggtttcccgcgaaccggtccttaatcgccatgggcacaactagcaaaaccatgcacccacagcccaccgtgtagtgtattttaataagccaacaccattacggtggcactgatccaaagctattgccaataattaaagtctatgctttaatgtgattccctttttgtgtactagtagaactaagcatggctaagcatttcccaaaccaacatctagtcattttaatacccgagttagcaatggcataaggtaaacaatatatggctgagtagtaggactcatcccacgtgatattgtaaaacgatgcaatatttaatagaaaagcgggacatttgtaaattgggtacaatatgatcaattataatgcatgacttgccttgctctcgcactgatgagaccacagcaacgtcttcgagaaaccgtggatcgacgaaacggccgaaatctacgcgacaaacaaagcacacaagcaaaacaggctataagactactaaaacaggaaacaaaaccatttttaatggattctatgcatttttatgaatttactgagacttgaatggacttaaacggagctcggatgaattagttatgatttttagaaaattctctgtgtttttactattaaagaaaagccttaatgtatttattgcgcaatattgccccagggctgacgtcagcagggggcggcgccgatatgcgggccccacgggtcagcggctcaagagagagagagggaggggcgccggcacgtgggccccactggcagtggcacaaggcgggaggggcgcggctggtggctcggctcggcttcaaagccggcaggccaagcatggcgagcgacggcggcacgcgcggtcgccggcgacggcaactggcggcgcggacggcgacggcagacggcgcgaaaagcggcggcggtggccgaagacgatggtgcgcgcgcggaggacggcggcgcacacgagagagagggaaagagggaggagggggagtttctcaccgagattggccggcgcgagtggacacgacggcgaacgacgacgacaagcgacgggaggacgacggcgacgggcagacgatctccgggaccttctagggaacaaaatgggaaggattagagggagaggggtggntcnntacggcgggcggaaaccatggccgaaggcggcggcaatggtggtactcaccggcgcgcggggagaagcgggccccgacggtggatttgccgggcggatggtggacgcgacggctcatgggatggtgaatgcggcggcgtcgacggtgaggctcggcgcggcggctagcgacggctagcggcagccggagcgcggcaggagggcggcggcgagtgtagcggcgagtgtagcggcgcgggagcgatagagggcacgagagggagcggtggaaagaggaaaaaggtggaagggagtgcggggaagctttattggggctcgggagtggcggacgtggccggggtgctcccgatttcgccggctacgtgggaggtggagagagagagggaggggggattcaaaccgtaccccgcccttgcggggcacgcgcgagagcgggaggagcggagagggggcgacgacgtgggcgcggcacggagtggggaggagtgggcgcgggaaggacgggaaacggcagcagcgcgcgcggtttcggcggttgccggcgtgggcggatggaggaagaggaaaggactgacaggtgggccccacctgtcagcgcccgagagggagagggaggccgggtgaacttcgggagtgggagggaggagcgggccggcgcgggaagaaatgggccggcggcccaagaaaaggaaaaaggagggaaaagaaaagataaaaaggaaaaaggattttcctaggaatttaatattgcactttgcttattttaattggttaaaattatttccaaggctctaaaaattccactaaaaatcctgttagcatattttgacatgtagaatccaagaaaaatttcacatgccgattccgatgattatttgcatttattaattaaggattcaactctaggttaattcaacaatttatttaggcgatttatttaacaaattttaaagctaaaaaggagaacttcagggcgtgacacgtggtaaccctcctgagggcattgttgaggtacccctgggcaaggagctctaggtaaaaaccttgtccagttctttggacagatgacgatggcgtctttcggcgtcgtgacccttatgagggcgtcgttttagagtcttcttgtcgtggtggtgttgttggtctggtggcgatcggtctcgcataacgatggcctgttcggtgcttggtttccctctctgtatcgtgtgtttgggcagttggcacatggttcggggcgtgtgttatggtgcacatccttactcgacaaccagttgtcgatgtaaaacttttcttgtaactttttcttcctatcttaattacattgaattacctcctttggtcataccggcaaaaaaaaatcacaaaacttctccacagcttgcactcagccattcttcatatcaacagcagcaatccatgcctccggctgtctctcacgcgcggtggtggtggtgctgctgccgctgtggcggccggcgacggcggtggtgtccaagaggatccaatcgggacgccgccggggttcctccattggattggatggaggcgacggcgacctaacctgatggcggcgctggtagcagcgggaatgggtggcccagttacattcttgggccgagcttcccgtgctaattcaattaacgcaaggcacaattagtgtaatctattgtaaaagccaaaagttccattttaacttcttcaacgaattctggtgcctaaaaataatacgaacatgctggtgtgttttcaagtttcaagaggtttagtgaaatcagggatatactactggtttctgcctcttagagtgggggtgtgagtgtggtgttatgtatgtagtgatgtttacgcgtgtacgcctaccgtgtaataaaaaaaatctattgatcgaatttgatatatatactttaaccgtaaaattgggtatatcatctccaacaaacatataaaaatagcgcaaaatgatttcctcgactattttgggcatacctgtgcaaattgtgttttgcagttttaatatttaagggagatggtatacccgattttatggttaaataatatacaaactaaaattggccaatagttgatggagccatgatggacattttcctcgtaaaaaattattcacagtaggacgatcgtccaagtgataactggtaacatttccatttatcatctttcatgcaactgtatacaccaactaatagtataattttctcaccctctcaaattgattgtagtctaatgattacaagagcctcagcctctgtaacaccttagattatagattcgactctccataggtgcgaattttccaggatttaacaacattgtgctttcagtggtagacggcgtatccgtcgacaccgaggtggctatggtgacttcgttaatctctagtatttgccggcccagtcttcgaagatgctcataggggtagggtatgcgtgcgtgccttcataagggtgagtgtgcgtgtgttgtgagtgtctacgttttactgtgtaattttaaaaaatataattagctacttaatcactagtgaataccaactatgttgtgttttagtctcttcaattattttcctctttcctttttgtggctgaatgatgggatattaggatcaagagcttacagcttatttggtaacttgagggaagatgatttggagtttacacaagagaattatggtgagattaagatgagaatttaatttttaatcccgatatcttctttggtagaggtggtgaaaattgatagggagtttagttggagattaggtcattaatgaaaacgagtggttgagatttgtttaggcaaagtaaacgagaaattccctcccaagtcccaattactagcccctacccaggtattaaaaaggagagagttcatttattaattccccatccctatcccaccaaaattttcatatctcctaaccaaacaaaacagttaatagcctcatccctgcaaacttccaatcccttattagaaactcccctcaaccaaaccggccattagtgaaagcgaccgaagaaggagatgacgttgttgtagacgaggtcacggtgagccggttgccatcgtggccgtggctgcggcctcgtcgaggaggagggcgacgtacgtcggcgcctcggcggggccgccggccgtagatgaggaagagagggaaccaagccgggatcgccgccatgtcgtacgccatctctcatcgctgcgtccaattaaatctcagcgcccgcatccaccgcatccatcgtatccaccgccgtcgccttccatcctccccgccatcgccgtccccccaccacgtcgccgacccagcgccgccatcgccgtcctcccccacccattccattcttcccgcaccccctcccttcaccgccgccggctgccggctgtcctcgtcacgcgatcccgaccggcgcttccttcacgcacctcccactttccctctcccctttggatcttcccgtcctcgctggttcgccgcctccacgccgcccgtacaccgatcgcgatctctgtcgtccagtccgccgcccctacgccggtcaccatcgccgtcatcaccgcgcccctcgatccgactcgaacagaagcatcgccattgccgaggcgccgacgggacacgaagatctcctcctcagccaactcaccggtgacgctgtccagatcggaacgccaaccctctgtccgtcgtccccatcgctgtgggcagccctccatgctgcgcatcgccatgggtcatccctgccggcgccaggaatatcgcatcctcctcaccggcatcgtagacgcgaagatctcctcctcgggcaacccaccgtcgctgtcgtgcggccagcgctacctctgtggagttagtggttgagtggcaagtccaccgccgctgctccaagccaaacggcacattcaacacctgtgactcccacttcaccgccaccgccacggcggcggagagagaaaaacggaggccgctggcgctggcgccgatctctgggcgaacttcctcgacgtcctcctcagccgccgctgtaacatccaaggtctcctcctttccctctgccatgtggagtagtgtgagcaatctacagagtggccgcttaattagcaactgggattacgattttgagtgtcctgatcaatggctgggtttggctttggatttgttcatgccagtgcctctcacggtggaacaaggggctccggtgaaggatccattaattcgttataccaggggatgccgttgatggggcagagcgaggtccggatcctccattggagaaaaggatttttcgtaagagcagggttgttggcactggctcttagttatgtgtgcaaaatttcaggccatgcaatcatgatcgaggaaggaggtgaggaacttccacgagaagctggttgaagaaaatttctaccttattactgaggtacatagccatacattgctatgtcgatcactattagtgaaggggatgctacaagcactttattttcttctttgtggtgagtttgatttgagccaccctgagagattgtagaagaaccaaagtaaaatggatcataacagtttggttgtgatttttcttgcttaaaattttagacaaataattaatgtggttattgtcttaatatgtacctttcattaccaactttgttggataaagatatatgaaattcatgaatttcactcatggagtgaataatgcatcgctattctagccatgactcttcctgaaaaggccacctgtgtacagtttgatgcttatattatgttctattgtgatatccaggctcacatgcactattctgtacctacattatataacctgggagacaatgcacacttccttggcttcattcatcagctcatttcctaagttacagaattagatattgttccccccaatacttagttcaacaagggcgtgtacctgtgcttcttctgaaacttaacgaatagctgcctccactgcttgaggtaaaaaaactcttagttgttgcttttaaaaaaaatctatgttgccatcaattcttgctatcacggtgaaagggccagctagcaagaacagcacttacatagatgtattatactcaaaatcctttcatgattgtttgaaaatcatattcatggttattatttgacttgattcttattttcatggttttaaacacaggcactaaaatcagcttggaggaatgggatataagcaggagtttatgtatccaaaatatttaatcagactctacaatatgctgtaaatttgagctggtctgcctctgttcatgggttaaaagtcatggatgctggtgttagcccagacgaaatagcatcattgcgctctactgtattaggattttccgttgaatcctggatttgctattttgttttgcctccctcaaacaattgtttctgatgttatgatctgatatatcatagtttgaacttgatacacaggtatagtataagctgcagtgccaaatttggacatcttcaggtgtgggacttgataaagcttggagatcatctcagtgaatgggaggatgttgatccttgtagggttgggatcactggtgaatcacttagaggtattgtatatgatgaattcatgattgcatccttatattgaagtaacatatggacccttgtagagcgtataaaatagttgtgatagcattataagatggatcatttttttaagtaaaagaataaaattaaatcattttgaatgtatctgaaatctgaatttacaactgaaaaacaagctcttaatgattctctgtacttgacatttccctgaaactgaatgatatttatgtaaataatatcgacgacaaatctattaggtgtatacaatatgattgctctatttgaagatttgttctatttgtaggaccctatctgtatatctccaaaatatgggaactacattattgcagatacaaattagtaatgacctgacataattacataaatcaagaggaaaaacaagaaaaaaaaggaatttcctttgtctttgacagattgcttttgtgcatttaaaaagataaggaactgtcaaactaattcctttttgctacagctttcagtagtgcctattaaatcttatgtgcttctaattaatcttatacaatatacacaataaactaaactttcagcattttaagcaccgtgttatcagttttcatttgtagaataaggaggatctaagtctacatttaattatagttaggtatgatgagacattgtaaataaaccttataaaatcaatacacgtaggggcttcccctaatattttatgataaaaaaataattggtgatataatcaatatatttagttgggtgttgtaagtacacatgtagatagtgataacagaaaagtgtataccaatcaaagaactcttgtgggttcccgatgacaaaaaaaaaaggacagtgtttagaaggaattctaaagcaaagtttcacagcaaggtgtgttgaaaattgaggagttggtaaaaaatggaagaagacgggaacatatgtactatggtctatgggactttatgcaatacaacacaagtttatatagtatagaaaacttttagggattggctgaccttttctgctccatctgattgtgaatgaagaatcacagttgcatgccaaaaattaagtggacaatatggatatgcatatctcaaatgtgtgattcttctttgtagagagaatcattgctctgcatctgactctgccactgaacgctgctacccatcttgtttggagataaggcttaatgtatactccctccgtccaaagaaagacaaactgtgggtttctgtgccaacgtttgaccgtccgttttatttgaaaaaattatgaaaaaaattaaaaagataagtcacgcataaagtattaatcatattttatcatctaacaacaatgaaaatactaattataaaaaattttcatataagacggacagtcaaacgttggcacggaaacacacggtttgctgttggcacggaaacacacggtttgccttttcttgagacgaagggagtatgatttaatctgcgttgtgcatgcatcgatgcaagttacctttaattaaaatgacaaaccatattttaggtaaaatgcttggtctcgatgtaatattaacaacccactggccatgtgtttgttaaaactctttagatatatttttaatttattttctattggttatctcccctttttagcaaatgggaacatttcaagatattattaagactatttaagcagaaaaatccgtgataaaatgaactttgtcatcatcatatctttttatatgtgcatttattattatcttcatcacttgtggtcgtttgataaaatagctccacatggtggcgaaccttccgtgccaatctgccaaaaattgattatcatgctcacacatatattgtcattactaaatatcgccgtagcgttagcatgggcacattactagtattaatagaagaggtttagttacgtagccaaaggctgaaaaaaaaagagagagaaatgattgtacacgtctgcctgcaaacatgcttacaagttaatcctcatcattccttgaggcaacaatctcgcaatatgctagatacggctctgcgttggtgaaggcagtattttattttaagaatctattctatgctactgagtttattacagttcaacgatttgccattgacattgtctctttctaaaatataccgacggctttattaattgttctacaatacaccattgggataagcctcttttcaaaaaatacccaaaatacccttagagatatacatggttaacaattaatttatctcattagaaagtttcaaaaaaatataaaatattttatatggcatccttacataacagagaagtatgtacatcagtttcaatttgtttttggtatttttaatttttagaaaaaaatatttttgtgtggtatatcagagagaaatagcttacacaaaagaaaatagcaaaaaatatcttatgttgcatatgaaagataatttaaattaaaaccaacaacacaaaaatattttatatagcatataacaaataagttatatttaaaaaatagaaatgaaaaaaattgaaacttatagacaaacttttatacctaaggaggccacataaaagttttattttttccttaaaacttctaatgatataaatcaattgttatacttgtatgtccataagggtatttttgctattattgaaaaataagcccagcctaatagtgtattgtagaacaattgataaagtcgccagtataatatagaaagagagaaagtcaatggtaagttattaacctatgataaattcagtggtatagaatatgttctctctttttgttttttccggtgaagaagggttgagaagaggccaagaggggaggatgacatagttattaactgttctgaaacaaagggagggagagagaaagatcgtggagctctccacttcatgcatggcgagctcgggcaaagccatggcttccatattgtggaagcttggaaggtggatggatatactctctacgtcactaaatatttgacgccgttaattttttaaaacatatttgattgttcgtcttatttaaaaattttaagtaattattaattatttttatatcatttgattcattgttaaatatatttttatatatacatatacttttacatatttcataaatttttttaataagacgaacggtcaaacatgtttaaaaagttaacggcgtcaaatatttagggacggagggagggagtatatgcttactcatggggtggcgaggggagatgtgctggtcgatggtttcactcctttgtctgctacttgttggattgaagtaaagagagacatatgaagaagcggaagagaaaacaagaggaactatatggagtacttatttttaattttttaattgtatcaactcgatgtaattgtttaaaatcaataaaactctctttaccttaaaaaaattgaacaagcaaagaaggttattaatttgagcaaatactacagtagcttcctgactagttaaatttatcttgtctagtgtttgtagctcaagatcactttgttttcaatttttattaaatctgacaaactcttggcttttaaaaattcttcagaatttgtatttttggattcttaagcaaatgcactcatgatccattctttgaatttgtaaaccctgctgactcctccgatatttcaaaaccaatctaagctcagataaataccaattttccatcaaaaacaaaaaccacacaaattggtttcacagtagttctataccacttcatggctagcgttgcttcttttgttttgtataagatatatataaccaacaacgaatactccagttaaaaaaaaaatcgaatgctcctggtaacaaacttatacggattgaatgacaaagttacattttgctgagacaaaaggtgcaccaatcaactcatacacatccatcgcgtcccctatattcaatcaccaaacatagtgtacaacaaccttttccatatccccccagcaaatcatacatatggcatggaacaacaacttaattataagcaaacaacatacttaaaacattctagacaagactggcaagtctggcatcatggaatacaatgacttctgactccggaggcggacggacggttatcatgcaatgacttcagacttcgcaggcacaggtagcatacatacgctgttaacacatagacagccaatccgagctgtataacatggtaaaacaagacaagtttccccgcaaggtgtccaagcctgatccacttccgtttgggagacagtaaggcagtctgattttaccgtagtaatgaaaccatctagttccacctcctgtggtgagcggattgccaatactacctgtgttactgtcagctgcagaatcagtattgtggtcatggccaccaccatacaagctgccttcttgccactccacatgatcttctaagtgtgtggtttgctttgtttcttttgtttgagttgtctccatttatgatcaatcttaacccttttataggccatcatggtactgccttcttgtagagcagaaaatgcaatatggattgttagtattataaaatgtttcaatagtacttccctgatttatcttttgaaaactagtacttccctaattgacttgtactttaaattaagcaacaatatgaaattatcacataacaagagttgctaggaattatcttgattgattggttgataaaaaggcttcaataatgcaacatgcagttaggccgtacggggtagatttgaatgtgggacttaattatcttagtcaaaagaaagaatttgatgtggacttatttttgaagtaggcctaacaacagtaataccgcttgttttacctgtggattgcaaattaaaaacaggtatgggagcaatctaatacgttttgcacttttgtgatatgtctattttacccaagtgcgcctgctgtggaacatagcatgcatgctttgagaaaaaaaaagtaacacttcgaagaaaaaaaataatgaaaaaattttctggatagatgggtacgtatatctgcatacacatcccactactgctggagaaaggggtattagtcccggttgataaccccctatagtcccggttatgtaaccaggaccacgaatccgggatcatctttagtcccgggtgaaataatcgggattaccagccgggactaaagatggagccaggctaggtccgattgctagttttttttcttttttcattgtttttaacattgaatattgatttcactccatccctaaatcatccccaaatcgtgaaaacctaaatagatcatcacatatcacaaaacaaaaggatatctccaaatacatcacaaattctaaaaaaattacatcacaagttctaaaaaaatcatcacaaatacatcacatattcgcatcacacacaaatcaaatacatctcagatccagaatcacaaattctcaaaaaatcacatatccattgctgccgcctcccgcctcccgccttcccttcggtagagccataggctgccgcctgccgtgcagccctcctcgctggccggcctccacgcggccacgccgccgcccgcagtccgcacccccgcccccgcccccgcccccgcccgaccgcctgccctcccggcgccggcctcactcgctcgctctcgctcctcaatctgctctcaccgataggaagaaggagatgataagttcggctttaaagaaaaggataagagagaggaggaataggaagatgaggagtttggggggataagtcctagggattatatactatatatggactaaagactaatttttattcttggttggtcacaccaactgggactaaaaatccttgaccccctaacagcctcggacagaaaatgaaccgagactaaaaatcatctagggctgatagagttttaaaccgggaaaaaaaatcatatttagtcccggtttctattcaaaccgggactattgtgatttttggtcaacccagcaaagatggtttctgtagtagtgcatggtttcaaatatatccgtcccctatttttatgttaatagcatactatcaatgcgttgaaacgtttttttcttaaaaaaaagatcataacatatatcttcaagtacataaaaatatattgtctaataaattatcgtaatgctaattttgttgtcactttctaagtatatgttaagttggtcatagggacagataaaatcttttctcattgttcgtgggttccatatgatagttggatggtggtgataacaaagggtgtgttcggaatcccctttcccaactcacccctctcttttcccgcgctcacgcttttcaaactactaaacggtatgctttttgcaaaaaaaaaagtttatatacgaaagttgcttaagaaaatcgtattgatccatttcttaaaaaaatagctaatacttaattaatcacgtgctaatggaccgctccgtttttcgtgcggagagtttagttctaaactccccaccagcgaacacagtcaacaccactactatcatcttagcattttttaagataatatagatgtgcagtttctcttatcaaatggacttttatgcattataaacagggttttcgagaagatgaatagcttatttctcaccgttcatgtgcattataaatagggttttgagaatatgaaagcttatttctcaagggacagacgcaactcatatgtataatatcgtgacgtatcacacatgattctaacactaatgctcatccgtgctgagtagttagattagatgagctgaaaattaagatttgtcatatatagcatactttacataggtcttaattagtttacgtgcagtgtaatactatgagccaatgtttttttaccacggcaaactttgtcgaccactccatcggtcctaaaatataagcacctttatactttgtcatagtcttcgagatgctactttgagcaacaatatctataaaagtaaggtgttttaaatttaaaagagttgcatattataatagtttgtttaatgataaacctagtaacatcaattttatattattgatcttttctattttttttattaatggtcaaagttaaaaatgtttgacttgatgctatgctaaaaatgtttatattttgggacgaaaggagtacattgtacgtagctaggacaacctgccatttgtaggttttaaaattaagacctatgaggagttaacctaggttttgtctgtccaaggtttagcttccttattcccctttatttctcctcaccactactgtcacttgatgatatatagacgtatgtgctagcttaatttctttctgtcatgttgctggtttctaaatcatgattcttgcaaggataccatagtttcacattgactaccataaccaatcatttgcatttgtgataatctttgctgcttggagattacattatggttgggagcttatcatgaataatgtctaggtaggaaagcatgaggtcatttttacgtagggagttgtttatatatagttgacgaaaacgaaatctccgttaatttttagtttgttgtgtcatgttaattgatgcatggtttctaaatcatgattcagtactacataaaaccactttggtgcgggttgaaaaccggctttcaattcggtgttagattcataaccagtacccgtaagacgacactgatgtggcattttacaactggcacctataacaacataaatgtgcctattgtgaaaaatcggtacctctaggtttttataggtaccctttttaaccgcgcggccacacggcaatactcaaaggtgacaattattgttgatgatcatttccaatgtatgcatggttggttttcctgtctttcagtcatctatacattttataaagttacaacccactaagactaaagttcaacatacaaccataccacatcatcacccactcacaataataattgcatatttaatctcatgcaagtatgcaacatcatatatataatctatttaattctataaatcaacatgcaaacatattcaatcgtcatctctcacatcatttccacaatattttaataaatatatcttttttataatatttaacttatattaattagtatgttccacattaaagcgtgggtatcatttgtttgattcatgataattactgataaactctagcgtttgttttttttaactcctagctcgattatcgaaaaaatatattgaaaattgcttagaaattcccgcaacaaagtgcagagaatcacctagttgtgtctataatagagacatacaataggatagaatagataatggtattaactattcaaatacattacacataaattaaccttacataattcacacaataaattgcttcaataattcacgcataaacactaaattaatactgtcttttcggtcaaatcttactacttcctccgtttcacaatgtaagttattctagcatttgtcatattcataatgatactaataaataaataaataaatatatatatatatatatatatatctaaattcattagtatcaatatgaatgtgaaaaatactaaaatgacttacattgtgaaacggagggagtagttagtaagctatgagatgacgattgtattctcggtgaatgcttgttgaggttgtaagcgccaactaagtctaaaacataattacggatgaactcatagagcttgttcgtcgtgtagacgaccttgtggcccatggtgaggttcatgtcggaactgtggacgaagaaaaaaaaaagattgaatattagggaatgacctaatatcaaataattataagaggtgagacttcgaacccagatcgtttagcccaccactttgtgaagctagccggaaggcccagaaaatccctaggtgtttctcaactgtggacgaagagggaggagtgacacgtgggtgcgtgagggaaagggatacgctgatggtgttcccgttccggatggtgtctcgcggtggtgttgttgctgctatggcagttggaatgccgacgttcctctattggattggatggaggcgtcggcaacaacctaacctgatggcggctccggttgcaacggggatgggtggtgaatcatttttctagatccgtcactgtgggtggtcattcttgggccaaacttcccatgacaatactataggaaaaaaaatccattgcagctccctatactataaatttacgaccttcaacaacaaaaccaactataaatattcactcagctattattaaaacctgatcaatttaggtttcggtagttttaattattgtttcatgctacgaggcgcttgcttagcacttagacctggtcgtttatgtatcgcagcgcctatgtaacgtttacatggcattcatagtttggaaaaaaaaaataaaattaaaataggcaggacccgcattgccacatataagtatcttagaaaaaattaaaaaaaatcgatatggcccaaatgccatctctctatatcttattctattgtaaaattttggtcccatttccatttatcatctttcatgtaactgtatatcaactatactagtatatataattttctcagacctccaaattaattagctacttaatcactactagtgaatatatgccagctatattttgttttgatttattcagttctttccctttttttagtgaaatcgacggaagaaggagatgacgtcgttgtagacaaggtccttggcgcagacgccgatgacgaagtcggcgtgggcgagctggggaaggtactgcacggtgagccggtcgccggcgtggccgccgcggcggaggtcgtcgaggaggagggcgacgtcggcggggtcggacagcgagtcccggccgccgtagctgaggaagatggggaaccacgccgggatcgccgccatgtcgtacgccggcgggtcggcctgcccgtacctggccacgttcgcgtccggcatcacgtagtcgtacttggtcagaaccccgtctctcaccgctgcatccagataattaatatcaaattatcatcaaattaacatgattttggtttggttaattagagggtataagatgactgatgagactagaatttgattggtttactttgagcgagatggatcaaggtttttgtggacgttggctggggctcgtacttgaggaagatgtcggctgctgaattgttcagacaatagttttttcctgacatgtttgcatgggagttagcatggagtgaaatgtaatgtagagcaaattaactcaggtaggtaaaatactaatccttgattaattaccagtgaaagatgtgaggagatcgtagcagttcatcccgggcttacgacagaacgttctaaccaagttggacacttgaggcctgcattagacagaagtgaattaccaatatgtcagctccatagcaaccggagacgattccaagctgtaaaaatgatttttatttgtctgaaaggcacgagaatgccggccatacgatgctgggttgaactcggcgatgccaaggagatcagagatgagctgcagttttggaacatatagttgatcagagcagagttcagtgtagaaaataaaatatgtctgtaagaacattgcaattgcaggatttggattaaaaacattggttggtcaagaaggatttttaccttttcaaggaaaggctttagttaccccaaggcattggaagtggtaatgtaagccaaatacgggccagggttgagcagggcagttgatttcagcttgtcaaccatctgcctttggaaaaaagtgccaagcggccacaagcgttccctggcaaccaccaccaccaaaaacagagtactacgttttcaacccaacagattacagtaagatgatgatgatgatgatgatgatgatgaattctcctttaatttgccagcttagtatataccattgaatggccaacgtagtgtggcttctggccggtgtggctgcaaacgtagtcaacgattgcaggcatgtcgttgaccacgatgtcgtcccatgaccagttccagtagctctgacatgagaagagatggtcatcagttacttcagtcttcagtgtacatgaccgtgttgcaatgcagggttgcagttaatatcactacatccggtttaaaatgctgctatctttattcccaaaaaaaaaattgttgctatctaggatatgatataagattactttgtagtacaagttagaacatatcttttctgattagcaagcagtaaagagattcagagtgtgattaatggtgaagtaattacccggcttttgggatcgagtgagacgtggcggctgctccagcgggtccccctgttgttggcgatccagacgtcgaagccctggtcggccaagatgtacggcagcgactcctccggcgaccccagcagccatgtcatgccatcctgccactcacaaagatatttcagctcaacaagatggagtgacagttttcgcagccttacatcattacatggagtattcgattgaacgatgtaattgttgggctgcttatgacactttttgtgtactatgaaaaagattgtttttacttagatttgtacgtcctttcaactaattaacgtgggacggttttagcattaatgttttgtcacgaacaatttattatattccctgatatttggtgtttagtacagggtttggtcaacattttgaaatcttgatcttctataattaatttctcaaatgtttaatttaaaattaggataaagaagtatgtgtatatttatcctgaaaagtactatactaatatcataaacttattagattttataaatttattttaacataaatagatggtcaaagttttaaagttcaaccaaatattatcttaaatattaaatatttatgaccaaatatagtagtgttttaggtgatgcgtattttgacaattttgaaatttatgtgcccattgttcatgcatgaagacaccggataagagagacttcctccgtttcaaaataaatcaatctattgggatgagatataatgtagtacaatgaaatttgggattttggaatagagagagtagtgatgttgatagccatactaatcaataatcgtaccacaccacagatggagagtatgttttgattgcaaaatagtgtagtacggaactgttatcattgcttcttgttgaaccatgcatcttgctattatccatgtttgattgtgagatactaggagtaaattcttgcatgaatgtatattcattagtttgtcatacgtactatatatctgaccatacatttacatcattactactagtaaacatcattgtaaattgtcctaacggctctctgactccacttaattctcaatcagacgaaaaagcaaagctaaagcactcaagtcaatccacttgttggtggcatatttcggaaatatggtgtgaacgaaacagaagaatatttcaaaattaagagaaaaccatgtcacaactactcgtcaaaatacaagatgaaatcaagatatggagcatgtgtggagcgaaaaaacatcacaagaatatccgcttagctctcatttagagtgtgtgtattttttctatgttttctccccccccctcccctgtttctctcacctatctggtgaccttgtaaatattttctctccttcttaatataacaccagcttagtctggcttcggtttttttaaaaaaaaatctcaatcagcagaaaaaaaacttgtagcaagaattagattcgcaaacaacaaattacccaccaattgtgcatatataatctgcaagttcgatataacatatatatactctatataatttgagattttttttttagaatctttaggaaggtctcgagagttattgcaccatctaatgtaaatgttaatactcctgatattttttaaatgatgcatcaagagataacacaaattgacaatataaaactgtgatgcgtgccgtgctgtacatatttaaggactactctcttcatcccaaaattaaaatatcctaaaatataacaacttctccaccaattttttctcaactaatcataaatttttacaatttaatttctccatctgctttctcttctcaaccaatcacaatattttctatttaattttacctattttttaataccatatctaactggtctgaaagattttactctatccatatcaaaatataacagtatggtaatggatgaggcgtatcctagtataacaaatctggacatataagtattcggatgtaggaaatttagtgctagattgttatatttttgtgacggagggattatattttgggatatactccgtattactgctcgtagcatgtctcatgtttctagctagctacaacggtgtacggatttgagaccccatgcaagtgatgggctagctaaagtccatgagtgctgcaactagtccgcagcagaagctagaaggagacaggagcaccgaaccatgtgccatgcatatctgcaaattccatattgatcgagactaacactgggatatcatgaaaagaagcatccatgcatatatattaattcctcaagcttgtttaattccattcaaactttaattcaaagatgctaaaaatcctggactatcctgtccgtacgttctccatcgaacggatattgtgaacccaaacggagttcggagaattcttcaccgaccccccaaaaatcaggtttcttggacacagattctattctactaacccaaactacgaaaaagcgtacgaacttgggttaaatttagacaaagttgtctgtaaagctaagaaaagctcgaaaggtgcaatgaaacaggggcgacatgatgagacgaatacgtgtgcaccggcatggcgtggtgctaagcacatgaaagtatgtgagattggcaagaaaacgaccacggattagagagaatgttaggtgccatgcgtgcgtgatgcgtaccacgagtacaccgtgctgcagtagcaccggctgccgcgccgccgccgcgccgccgccggtgacgccgccgatgcgtcccctcgggatcctttgcaagcccaggatgtagccatcctgcgtcgtcacctgtccatgagaagaagaagaaaacaaaagagatttgacggttttgattcgtgcgtgcgaacgttctgcgtgcgcgcgtttaaaggtgttcgacgagattgattaacctcgtgctcttcgcaggggtagccgaacggcgccacggccgtcgcgcacgcgccgtcgccgccgccgccgccgccgccggcggtggcaatgtcgcgccgccggagttcagcgtggttgatcaggacgcgcgccccggcggcgagctgcgggccggacaggaggacgacggcggtggtgacgacgatcgtcatcgccgccgccgagatcgagaagaagccgcgaacgccgtgacacgcggtgctcatgctggcgcccgccgtggcgcgctctgagtgccactagccgctgctgcgtcgtgcgcgcgcgcgcacgatcgagctcagtgctgcgagcgatcgaggagtgggcgcatgcgtatttaaaagtggtcactgctcagctagtgatgttgttgcggtgagctgcgccgtgtgaacgcggcgacccccagtgcgtgagatatattcttggcctttgctttcttcagcgtgacaccttggcctggctaccttgctagctagcagctcagctcagttctgatctgggaatgggtgtacatgcatgggcgatacggttcattagttctaacaaaattcattcggcataacactgtaattaactgcattactgcgtgtgtaaagaatttgacttggtaaattaattctgagtaattaattaattataaccgccataatgttcctgatgcatatgcgtgctgtctgtggcctgtgagagtgtgacacgcattgttcagggttcagaacaatgacacacggtcaaatgctatttaattactgttagtagtaactcgatctgtttctgtggtggtttaattctagttttaactatgtgaaattcaattaatttaaatactaagcaataactcttgtttttaagagtatatatgcttatgcttttataagagtaacaactcttcaccattagcagcacttcctgaaacccagagctaagacttaatcttttgtagagaaatcagataaagcctcattgtttcgcttatttgtggaataagccaaacaacatatttataaactaatagtaatttataaataaaacttttacatatatgttcttatcgatctaaaagtaaaggctgaaaataaacttctatgaaaaaaaagccaaagttagtttcaaatttaaggttgaaaatttaaattttggttgataagcataaacataagcgaaaagaggaggcttttaattaatttctgaaatatccacactataatgttttctagacgaaagaccttagatgataatgtgttcaccgaattgctgggaaaggtatgcccatgtgtgatgtttttattgagtttggcgtggtggactctgctcgtcagtatcatcatcgatcaggtcgtcctcctgttttcttgggttcagacgccaccgggaacggaggaggtgagaaacagacatgaatccatgcaacccatcaacccatctgaatatctgatcccttagtctgaataattaaaaacacgttgcatttcacatttccggataaacaaacttacgaacagtccaggtctaaaacgttggatataaaagataatcttgaacctgtttgacattactcgaagatctaataagaatcgacagttttcatatacaagatggaaaacagatatggaacatctagagaagcatgtcccaatgaatttacctaagaataagttgaatatttctagccttaaaaatttatgtaacttgaaaaactagatccgaagctctatcaaatagaatcgagaactgctacatattgcacccataatatataaaaaaaacaagatttagagggagacgttctccaaatattttttttaagaagatagcgtgttagaaattgaacataagactttcgggttaacttttttgtcattgcactatcaagtgcatctcatcttacacccatttcatcaggtggggaatggtgactcaaaagtaggccagcagatacacgtcgatcgagtaccccaactctataagtgcttgtttagttcctaactttttcttcaaacttccaacttttccatcccatcaaagctttccaacacacataaatttttaacttttttcttcaaacttttaattttaatcaaacttttaattttggcatggaactaaacacggcctacggcctaagtactatagtatcatgcagttgcagagaaaacaagctatgtgatctgcaccgctctgtaatactacattctcgtcctgatccatacaaagagccaagaaaaatgcatgtcctaccaatccaaacttcttgtccttttatacagatcatgacatgaatatggcacgtacagagcggtgtagaacattagctagcaagctcccctacccaataacaagatagatatatacgacgagtaccgtatatggcctatcggtattgaaaactcatgcaacgcagcatgggcgctagtacagtttactcaagaactctgcactagtgaacaactgaacatttctcgatctttgtccttggaaaaaggagaagtgaacatatgcgctcaaatgttcacaccttcctgtcttccttagtgcagaagatagtggtccagtcactcaatcctcttcagtgcctaggtgacacatatctcagtgtttgttgccttttattcagaaaagaaatcagtgtattgattttgggtttctgcggcactactgcttgggtgcattatcgtttaaagagtgcaaaacgtgtaattgcaatggttagtgcattgtgcattcttcattctttttttcagattagctagctagccagccatcattagatatcctcccacaaaaagaaaacaattaggagaaacacatcaacagagtagcctataaaaggattggtggtttttccattacaaaaaggattagtggtctgccaacagttggcaatctctagttggcactaatcaatccactacttcacctagtaattgttttctgtaaccttccaattttgcatttgcaaaaaatcaatgcattttctccttctgaacctcactgaactcttcattccgtttcattcttcaggcaaaaattcagaccaccgtcagaagaactgaagttttcgcttatctgacatggatatggatcgaatccattaatctcagcctcgaaccctagatgtccacgcgtgtagctatgagcctaggatcatgcaagcatttgcatcatcgatcagatccacatcatgtatctatctagcagagatcgatccctccaagcagttgatgagtgcacgcacgcatttgctgcatatatcactcaattattgatcaagcccatcagttctgttctaagcgagctagcacaaggaaagaaaaggaagaaagaaagaatggtcctatgtttgacttatcctgcgatggcgatgagatgaactgatgaagcaagcaaggcagcaacagaagcgagaataaaggcgagattcttggagaagatgaggtgagaattgagatgagagcatcgctagctggtctcctcccttttgacattggagcagcagcagcagttcagtgctaatactgtccagtgtccacacgaacacttctctgaaaatctgaactctgaacttgtgcgtgcagggctgcaggccagctgcttcagtacttcagtctgacggagaagggaggccaatctatggcgatttgggctcttttcggcccaattagaagccttttacgaattacggcccaaagtaatcaacctcgtccattgctacggcccaatttgaagtcctattttcggcctaatttgagtcctttacgaattatggcccaaatcaaccagcctcagttactccggcccaatttgaagtccattacaaattacggcccagataataaacatcatgcattgctccggcccaatttaggcctgacgaaaaagaaacagagcccatttgttttgttttgcttttttgaaaatttggtagtctatatcagtagctgctacttgcaaccaagttgatgagtgcacgtaattgtctcgtgtattttttaatcacttgaccatgactcgatgctttggtagatttaatttgatgctagccacgttggatttacattataatattcgattaattcttgatgccatgacttggatgctagtcttccaagtagtttttttttaattattaattccagtttacttgatcttatccacagtgtctgtcgagagttcagagtcattgtttatttcattttcgatcagatcacagtgtccatttgataatttgatgtgtgaacagaaacctatcgccccaggaatcaagacacatgtatttttgtgtctttttaatgtgactaatctttcgtccaaaaaaagaaagagtgactaatctctaatcaatcatgcaccgacacacctgctggtcctgctccatccattctctgcaagtctgcactaatcacactttcaaggcctaataattatagcaacttgcatggcatatccctgatattcttttaagatgaaaaataccagtttgttagttggtgtattagttatcaaccacaactaaaacttaaatgttaaaacttaattttagatttgattttaggcttctttctaccttggtttttcatccataataagtttagtatttcttacggcgttaccagctcaaccaatgctgtcgggattgtttgtagtactgcacttgtagtagctgccattgacatgtggaaccggatctatttgtcagccactgctactgcaaatacagtactgcagaggattcatgtcccattaactctactactccctccctctcattttaaatgtatttgtggtttgtatatccaacatttaattaacatcttatttaatttttttataattagtatttttattgatattagataataaaaacatgaataataatacttataggtgtggtttattatttttattaattttataaattttaaaatgagatggacggtaaaataagttggacacataaaccacaaatgcacttataaacagagggggagtaatagcatcggaagtatcaatgtagcgggaaaaacgcataaatttggtcaatggacattcatgaacattgaatacattacacaaaaggaaaaaaaaaactgaatactggtagctcataaatacgcacgagcaaacaatgggaaggaaacaaatttgcaaaatccaaacaggaccagcaactgcaacacaacacaagactgcgatttctgcaaagcagttaagcagagcaggggaaaaaaaacaaaagaagaaaaaaaaaagaatctacccctcatattcctcctcgcctagtccacagagagggcgaaccgaaacatccctggacctatccttggtggaccgcgtgatgacgtcagcagcggctcggcgaagggtctacataaaccgggtccacgcgtcccccaaaaacccacccaatccgcgtgtcaaaacctccggcctccgcaccgtgcgcgccagctcagcacgtcggcggcggcggcggcggcggcgacggcgaggggagagatggacgccgcgatggagtcggcggtggggccgcacttcagcgggctccgcctcgactcgcgccgcctctcctcctcctccctccccccctccccctccgccgcctccagcaacggctgcggcggcaacgacgcccccgccgcggttaacgggttcgcgccgccgccgcccccctccgccgccgcagccgcggaggaggggagcaagcagcccttcgtgatcggtacgcactcctccgcccgctctctctctctctcgtaatcgtaatccttggtggtgtttgttttgaattttggtggttgtggttggcgaaggtgtgtcgggagggacggcgtcggggaagacgacggtctgcgacatgatcatccagcagctgcacgaccaccgcgtcgtgctcgtcaaccaggtgtggtgtgcctcgttgcatcgtcaggatgcatatcatgtctgcttggttggttgctatatgcatatgcttgcctagtagtgagatttcgtgtttcgagcgttttgttcaatcagccaatccgttgttgcagtgatcagtgtatggtttgttgttagtacaaaataacttacggagtggaacatattgtgatgcggtaggtccaaaaatgacatgatttgaacagtcaaggtcgaggatgagtatggtactccactttcttgtatgtgcagtttgtatgcatcctaatgcctaaacatgtagggcctttcgtgcagtattatattttttcttctctgtaccattcatagcttgtttcttttctttaaggcaagcaggcagaattgctatttgtgcaagttgtcaaaaggggaaatgcgttgtgaaaagaacttctttcggagcagcttgaacaaaatgtgcatttgattaaatcattgcctgcgtattggcaagctagaagcatgaaattgctttcatattcgcatctgtattcagttgtgtgtcttgtatggttggctgtggtttcttgctcagttgggtgaatgctgatctgggtacttgcaagttgctgtcatttgaataagagcttcatcaaaagagcaaagactagttgttgactatgtctgatagatcatttctgcaattattctatatacttcagctaaagtttcaattttgcaggattcattctaccgtggtttaactgaggaagaatctgaccgtgtgcaagattacaactttgatcacccaggtgcttgatttgataaaaattgattgccttttgagttctcgaggtttcaatctgctttacgttgggaagagactaagatattttcgttctttcttttttgcagatgcatttgatacagagcaacttttagagtgcatgggacagcttaaaagtgggctatctgtaaatattcctatatatgattttaagaaccaccgtcgatgctctgaaagttttagaaaggtagtaatgtcgttgttgacctttggtgtgaaaaagataattcctgtttatctattgttattacaccttttatctatgattaattactggttgataactttgtatgcaaaggtcttatgtagattgatggcatctggtgtgccttatttcacattctgttctagaaatttggtgccaaaatattgaatctataggcacatagttaagtagtgtactatgaagtctccattaataaatgagctacacatgctaaaagagtatactataaagtgaccttttttgtgggcggggaaaggatataaggatatgcaatataaagagtacatcatatgtctaagaagctactgtggaccttgctcaacctatgtagcagttatgattcatgaaattttttcataaccaacccagccctagtttcgccatggcaataatttatgggtggtatttctttttctgttcagtgtcgttgttggtctattttctggatttctttaatggtagtgaaacctaatgaattatgattgttaattaggcttaaaaaccttttgactattttgttttcttaggttaatgcatcagatgtcatcattttggagggcattttagtttttcatgatcaaagggttcgtgatttgatggatatgaaaatttttgttgacacaggtttgttgctcctctttgttaggtataatataatagatattatggtaacaatatcgtttgtgatcattcacctttatccctttgtattttatgcatcaatttagatgccgatattagacttgcccggcgtataaggcgtgatacagttgaaagaggtagagatgtcatctcagtgctggagcaggtaatttaaacacccgtctatgttattttagtctttttctatttaaatatgtcacaaaatctgcatgccctgatgtttgtaatacatatgtaatgacacttttgatgaaccttattgaattgtagtatgggaggtttgtgaagcctgcgttcgatgattttgttcttccttccaaaaaatatgctgatgtgatcataccgcgagggggagataaccatgttgccatagatttaattgtgcaacatattcgtacaaaacttggtcagcatgacttatgcaaaatctacccaaatgtttatgtggttaatacaactttccaggtacaatcaatagtttctctcgatcctaagtttcataatgttattttattcccaacccatggttataaacactcgattaacagatacgtggaatgcatactcttattcgcgaccgggacattgcaactccagatttcgtcttttattcagatcgtctgattcgtctggtagcactcattctttttggcctctgtacccttctctagttctacatagctactgaatgtgtctgactgtttattgatgtgttattcatgtggaaaataaatatattgctaggtagttgagcatggactggggcatttgcctttcacagagaagcagattgttacaccaacaggtgctttgctggttccattatactttgcgcctatttatttttgttcttggaatttgccctatataaccccattagcatatgccagccagaaaaagaaaaagtaacaccttaagtatgtttggaattatctcttagtggtagcaacttagtatatgctctggaggttttcttaacaatgtttctatggtatctaagaatagtgtttgtgaactgtagaaatggaaggacagttttggcaaaactggatctgctatatataccattatgaaagtgtgggatttgacatttccaattgcatgtttatggttttgcccagagccatttgaatccatggtggttttactaagaaccatttttgtgtctttgcaacaagcaatgggaaatatgtttttgcaccgctccaataaaataggtctaaaatgataaagttgtgcatctaaatttcaacaaacacttacctattatcttttgtcctgaaaaataacaaggagcaacaagagctccaataacccctttacaattttactactgattttaattttatggcgataaaggagcttctccattcaaagtggaaaaatatggaatgtaagcagctgtgaatcaaatgaatctaaccatcttggttcaatattcattgccaagagaaatcttgaatctggggcttctaaaagattgttgtctgatcacccaattacttcatgaattattcttttttataaaggtccagcttcactggcattgtattaataaagagaaagcaaagcgctgcaattactggttgtctacagtttcacgcacgtagcactgtccatttatgttaatgtaaacaaatgttggaaggttgcacatttatgacgtcatactcattctgttcttttgtccagggtctacttacatgggagttgacttttgtaagaagctctgtggtgtgtcaattattcgaaggtaagccattgctttcctgaaaactaatagcttcaaatgcaaaaaaaaagttggattatctgcagcttctagtgttgaaccttcctttaatggttaataaaacctgagtgaatttctataccatataagttcttttgcagattattgtgtatacattgatttagtgttcagtgatgaaaatctttattcaatactactctgtcccaaaaaaaaacgaattcctagctacgaacctggatacacatgtgtccacgttcgtaggtaggattggtctgttttttgggacggaggggtatgtatttggtactcataactcagcccatgctgaccagcagtgtagtttagttagacttacgacccatttctttgatttatttttatccttatgtacttactgcatgaaataacttggtatatatgttgttttgcagtggagaaagcatggagaatgcattacgtgcttgttgtaaggggattaaaataggcaaaattctaatacatcgggatggggacaatggacaacaggtgaaatgctttgtagttttcttgaaaataccatggaaatagttcactttctgcgaaattttgaacggaccttgtttttccccttgtccagctcatataccacaagtttcccttggatattgctgaacgacatgttctactcatggatcctgtgcttggtacaggtagtgttgaatttatccaatgctcctttcatagtgatgtttgcttgcttgtcggaatgagaactactgaagtcacagctaaagtttcttatcataactattcaactgtacaggtaactcggcaaatcaagctatagaacttcttataagtagtggagttcctgaggagcggatcatgtttctcaatctcatctcggtaaaatactccagctctttgacatggttaatactgatatagtacatgattcattttgtgcaaacttggtaatggcatttcgatgaacaggctcctgaaggggtccattgtgtctgcaagcgattccctcgtctgaagattgtaacctcagagatcgaaactgggttgaacgaggagtaccgggtgatcccagggttaggagagtatggtgatcgctacttcggtacagactaatcagggattgatactggcttctttggcgatgtgaaaagatcacattagagctaacattaccgtgagagagatatatactggtgtttggttgtttgtggtataccattggaggtaccgaaatcgtgcgatttcgtgtgttagtgtttgctgctgtgataaaaacttcgggtgttgaattttgaaggcccctgtcgctagttacagcggcgtgtgaaaaaagggaaaaatttgtgacatgtagagcccacttctcgggcctgaatgcggcagatgccgtgtggtttcactttcagttgtgattgaactgcatgctaatgaaacttacatatgtatgtactgcaaagtccatgcatatggtcctgacaattgtttgcgcatcgtggaagcagcattgttggctgggtgtgttcgctacagccggctcccaacgtgcactaagcacggaaaatgaagcaatatattagcacgtgattaattaagtatttgttattttcttttcaaaaatggatcaatatggttttttaagcaacttctgtatgtaaactttttgcaaaaaacataccgtttagtagtttgaaaagtgtacgtgcggaaaacgagtgagaggggctgagaaaaggggtgccgaacaaaaattctctaggagatatgaaagccactgacatttaggtcctactccactcttctttgagcccatatgcacgttgctgctgcagaggatatgagtccgtagacacataatattgtaaattctagtgctcataattatgcacataaagttgtgttttagcatgtgatgtgcaaacatggtgatgcctgtgcattttgagcttgttttgtttggagccaaatttttgccaaaccaaaattttattagtttcaaaatcttaacaagttttagcatagaatagaatttaaacttttttttgagacaatatagaatttaaactagtgtgtgcaaaattggtagccaaccaaacattcaattgatactattgaagttgccaaaattaattttgatatggtaaaaattaggcctttaaactaaataaaccatcgataacgttaaaatttaggagggttgaaaatggtatgcatgtatatatttcaaattgatatattggtatgcacgtaatcctcccggttttataattcttaacgttttggataagattaagatcaaacttttataactttaactattataacaactttaaaaatatttagtttaaaggcgctagaacaacatatatagatttgtcttacaaaatactgcaataaaaatagaaatatattttttgtttattggatgctccctctgttccaaaatatactttgaccaacaatattatgttttaaataaaaagagttgcatattatgaaagtttgtttaataaaaaatctagtaatatcaatgttacatgatttattttttttatttttatttttttgctattagcggtcaaagttaaaaatgtttattttggcacttatattttggaaccgagagagtatattataatagaaagatattgtccaatttatattttagatttggagggagcatggtatattggtatgcatgtatatttttcaggtaataataatgtttgttcgcaataaaatcccagcaacgcggtagtttcggcccggagccgtactcggtttacgtcaattcggcccaactccttcgatacgcggcccaattacggccgtttcggccagagacatgcgagccagcccaagcccaaccgcgcacgcgggggagagggcgaaaggcggcgccgcggcgtcgtcgtctctcgccaacacacgcactcccacgccggcacgccgccgccgccgcaccccctcctcatcgccgccgcggtggctgctcgcccacacctctctcgtcgcctccactccctcgccgtcgcaggccgccgccgccgcccgccgcgagcggttaactcccgtctcggtaggtaaatcaaccgcgagtcctccctctcttgacttcgagatcttcaatcaccatcattaggatgttattgctcacaatcgcatacaattccgtatgattatttattattatttttgttatgatacgaggtcgtttgatcgtcgtgattaattaattcagggaaggcgttttaatttatcgtttttacatcagtttcagacaaagtacaaaacgacggttttggggccggtaagtagtacattacacaagtgtagtgacatttctgaatttatttatttttgactgaaatctctgaattttgttgggatttgatcgctcaacttcaaatgtatacacatgatgaacgcaaatatgaatagacactgattttctgtggttccaaacaccatattttttttgtcctgtttatttcaagactcaacctcaactgtagaagcttcctgaacccctccttaaatacaaatgctaaattagtagtaattaccttgaccacaacgtactctgcatgcactaactctgctggccatgcatcgaacacatggctcagccactaattaaccaactcaactaactcatgcaagcacatgcatcatagctgaccaagtaatacatctcctacatgcatgtcgtacatgattccgtacatacaaacttgttcacactaataatatcacacttgcatgacaatgtttccaacagaatttaacataaataggttatggatgaactgcttcacggtaaatttctgaattcagtttttcagagatcaactgtgccttttgggtttcaatatcagttttgcgaatcacccataggaatctggagttgaatttctctattgaggatttcaataggatgttaaacccatatggtttttatttcgaattgaaggcatcattttttgttcttttgaattgcattgactctgactttttatttctccaattggtatgtcccttcaaattcttgcaaacaactcacttttacggagtacgcaaaagatttttaatatcgtttcatttttttcaaataccaacgaagcaaagcgacaacaaggaaaaactccttttgactttccaatggcttcgctacctagctattacattcagttaatacagattttgttcaaattgacgcatcatctttcatttttgagttccaacgtcagaatagcttcgcaaatttgattcatccattggcattgcacaaactcatttgcttggacatttgggcagcatattctttcccgttccactactctcgcaagttgtatgcctgattttttgttatcatgcataatatcaacatttcagaacaattcttttgtactagattccaattcaaggccccctaatcatcaacattaaggctaaaaaattctcttctttagaaaaggctcaacctgtgggcttccttggaggtcttgtaacaaacgagccaacaaactagtggtaaaagctacatgttgcatgcatatataaatcataccacacaactcttctctgatgatccatcttgtttctgatcaccttgttcagggagcagcagcaagaagccaagaacatggcttgcaaggtgagaggggacatgggcaagctcatcccggtgatctccttcttcctcggcgcggcgctgacggcggcgttcgtcattgctactatggatatcaactggaggctctccgccctggcctcctggaacaacaatgattctccaccggccgtcaccgacgaggtcagtgatctaccgatgctgctttctgcgttttctgcttaacaatctgaagttctgaacatgagatgagaacatcttcagtgcagtttccttgagtaatgccgaattatacttttacataataaaaaaagggtttttataccttttttttcatttcaattttcttgttcttattgtcttgcaagatgcttcaaaattctaatagataatggccgtgcaattaattgggactgtttcatttcgttgcaaatagttggaagttgcaactatgcataatagacgggtattagtggtcaggtagtctactggtctccctttctatcgtcctagattattcctctatctacatcttcattcagtgagctgataagtctctaagacgcaacgacaagcaaatccatatccaatataatgctgcagatatcttccacagcattagccaagtctagaatttcctttttttttaaaagccaatcatcaacaagccaaagtgccaattctacttttccaacattagcctgagataagcttcctgtagctttgtcacatccacagagcccaaaagcttaaagctgaaactgactactgatgaggtaacgaatatgctaacctgttgtccaagcagccttgtggggataggatatattacatcatttacaactcagccaaatgattcgagtgaactttctatgaaattttacagctcgacttgctactaactttcagttcagattcttaaacaaaacaacgagatagatcttcacatttgcaacatccaatggaaagacttgctactaactttcagttcagattcttagacaaaacaacaagatcttcacatttgcaacatccaatggaaagatttgctactaactttcagttcagattcttaaaacaacaagatcgatcttcaaatttgaaacatctaatggaaaaaggctgaaaaaagataataataatgattgcagatgaaagcattgtcagaattgaccgaggtgctgaggaacgcgtcgatggacgacaggacggtgatcatgacgtcgatcaaccgggcgtacgcggcgccggggtcgctgctggacctcttcctggagagcttccggctcggcgagggcacggagccgctgctgaagcacgtcctcatcgtggccatggaccccgcggcgctcgcccggtgccgccaggtgcacccgcactgctacctcctccggcggccggagggcgccgtggactacagcgacgagaagcgcttcatgagcaaggactacctcgacatgatgtgggggcgcaacctcttccagcagaccatcctccagctcggcttcaacttcctcttcacggtatgaataatcatgatcaccttacctggacaaacttcacagcataaactggttgtcgatcgcatgcaactcaaatcatcgttcggtcgtaaacacatttgatgtttaggacaaagattcggataaaattttatattttcaacaatcaattttatatattagaatacgtttataaaatctacttcctccgttttatgttataagactttctagcattatccacattcatacagatgctaatgaatatatatatatatatatatatatatatatatatatatatatatatatatatatgtatacacatacatatatatatgtatacacatacatatatatatgtatacacatacatatatatatgtatacgtacgtacgtacgtatgtatgtatgtatgtctgtctgtctagatttattaacatatatatgaatttgagcaatcctagaaagatttataatatgaaacggaagaagtagtaagtttataaagattttctcattatctaagaaaaaagtaatttgtggaattatgatagtagttttcgatgtataccatttctcgaaactaaactaagcatttggtaaaatattgatggtttaaattttaaaagtttgatcaaatattatcctaaacgttaaatatttactacaaaagatagtacataatattccaaattttacggcgaactggccgatgcatgtaactcgaaagtagtattaatagtagtgcattaattattcaggacattgacatcatgtggttccggaacccgctgcggcacatcgcgatcacgtcggacatcgcggtggccaacgactactacaacggcgacccggagagcctccggaacaggcccaacggcggcttcctgtacgtgcgcgcggcgaggcggacggtggacttctaccggcggtggcgcgacgcgcggcggcgcttcccgccggggaccaacgagcagcacgtcctggagcgggcgcaggcggagctcagccgccgcgccgacgtccggatgcagttcctcgacacggcgcactgcggcggcttctgccagctcagccgcgacatggccagggtctgcacgctccacgccaactgctgcaccggcctcgccaacaaggtgcacgacctcgccgccgtcctccgcgactggaggaactacacggcggcaccgccggcggcgaggcgccggggaggcttcggatggaccacgccgggcaagtgcatccgctgacacctccagcagctgcttgctactagcttaattttaagcttttagcctagctagctagctgctgctaccactgtttattactacctccgtttcagattataaaattttatagcattgttcatatttatatagatgttaatgaatctatgcacatatatctagattcattaatatctatataaatgtagacaatgctagaaagttttatgatataaaacagataaagtagttattactgtgattgttttacgtactggtcaagagtagtcagtgcgtgtgtacattttcttgtttccctcttgttgggatctaagtgggactgattgatatcaggagcattgtaaaagtgttctttttatcataacatataatacaaattcacctttttccccccttttgctatgaacataattgaatcagctgtgcaatgcatgatgaaaaaatacatagttataaccgtttgatttttagtttgctcggagttatagaaaatcaacacccttgtgttccacatcgtcgtttgtaagagtattatagaaacatagaaaccttttgtacatgtacttttcccctaaatacaatttaattaggccctgcttggaacaggtgcacagcttgaaatactaaacacatgtattgaatttaaaagtttatataagttaaataatagctagggactgtctagccatcatccagctgaattcttgtgtgtcttcagccgaatttggggccatcagataaaacacgtgtcagcatcgtgtcgcgcatgctgacctcacgcgcgcttctcttgcccagtcttgtggatcagattggcatcaagctcgtttgtgttttgtccagtaaaaattgcccaaaaaacaagctgacttaaaaacacacaatccaccaataccccaaactagtctgtttgagaaatttgaaacgaactgcccatttgctggaaatacacgggcttagccccattatccccctctgccaccagttggaatcgatcagtcctcttaaaaaaagcttagaaaaacaatgcagtcgtaaaagagagagcatatatattctgctaaaaaaaagcccaactttgtttaggaggcttgattgttgcttcaatcttcggacgacagcaaaacggaaatgaagcgaacaagacctggaagaagggactgcatctctgcaaatgaaactagtcccagttactaaactaatgcaagaacattcagaaaatttttgttcagtttatgaatacttatccttaaggagcattcaaaaatttgtattctgaagttgtataatgctagaggccagcattggtgccagaacagggctcaagatttgtgtgatcaactgatggttattgcaagaataatatattgggggaaactattttgatccctctaggggatatcctatcgttgtttgtatgtcactcaaatagttatgaaaaaatgtaaaaaaaattaagaagatgtattaacatgtgatatatcatccacaaacatgcaagttcaaattcaatttctacatctcgcaacgaaaaaacaaattaaactataactagttaacgtatattcacaattattttttttcgttacgagatatagaagttgaatttgaacttgcatgtttgtggagtgatatatcacatgttaatgcatcttcttaattttttttcataagtatttaagtgacatgcaaataacaaggagatatcccctcgagggattgaaatccactcccgtatattggcccttttcttgataatgaagtgtgtgtactatgatatgatttgacaaaatcaattctctatctgaagtcttctgtgagctgaagtggactggcataattattattattatcttaatcatagacgaggcatcactctctaccagtattatccaactgtgagttgggcaaaccttcatcatccaaagggtaccttgattattattttttgtaatggtgcaatgaaatggatagcgactgctctggggatacattttgtgagaccaaaatcctgaaaatcttctcaattctgatattcaatctgaagcttcaccatgacaagttcttgatggaattgcattcgcaaaaaaaaaaatccttttaatacttgatggaattgcagaccagttagcgaaatactgggcgtgcaaaactgtagacatgttgacagggaagtgtactaattggatgcaagaaagaatttgagataattatgtcaacaaatacacgcctaagtctcctgcttgagtggctacaattaagcagcaatactcgtacaaatcaatttagtcttcagaaaacaaaagggatacggcctgccacatgatcaatgaagctctccagttgcaaacttttctgtgcataatcaatgttgcattcgtgcactggctaaaaaatcaaggtatttattggtagaaagagaattgtaggctacttaatactccctccatttacttttgatagtcatatttcatcttaacacacagactaagaataagtaattatacttatcatacatttaaacatgctactaattattcctcgtaaacaagcgaatcattaatatttatatttctcgatgcccatatagccaatcttgtgtggaagaatagagagtcatgcattaaatccgagaaagtcattaagatgatagattgttggattgaaatatgattatcaaaaataaatttttcagatttagaaatatgactatcaaaaatagatggagagagtattgtacattatgagctcattcagaggtttgatttgtaaaaataaacaaaagcaacatgagtagtaatcttgctcggcatttcttgccagggtatatgttcttgctgctatgattgcgcgactttacgcacccgggcaaacaatatttaacaagattatatatactgaagaatataataatcaatcaacagccattacacgatttgtctccctacccctacgtggaaacagtgaacgatcttagtgttaggtatacttgtaatggatgccaggcataagcaaacaagcaaattcatctggacaagtgcctaacaaaagtactctatgacctaaataatatgatttagtaattattatcatgtagatagcgcatgaacttgattaataagtagcaaaatattttttttaaaaaaatacaaaaaccagacacgaatatacatcatctttaatttatccgctagtcttgagaaacaaatacatattgcaagttatctcaatatacaggagcataaaaaaaacaaccatgtgtcaatatacaggagaaatttagcttgtccactttctgctcagcctcagcccttgcattctaaataaaacacaccgtttttgaaattatgctcatttatgataaagtaaatttttttgacaaaaaaataagacaagcaatgacaaaaccacttatttggagaagttaaaaaaaactgacaaaaacaaaatacaaattcatctggattactagggcctaacaaaagtactctatgacctaaataatatgatttaatagttattatcatgtagatagcgtatcaacttgattaatatgaagcattttttttaaacacctcaagtatatgtgaaaaaccatataagaactaacaaaacaggttactaacacaactactcactacacctaaaaatttggtaacaaaattacaaatgggacacacaaaaccacttttttgcataattttttttttaaaaaaaagacaaagacaaagacaaaaacaaaagtacaaattcatctggactactagggcctaacaaaagtactctatgacataaataatatgatttaatagtttgttatgggcatgggccaggcccatgcaacagtttaggtatgataatttaggaataagtcacataaatataagagattacctagttaggaaagatatgaggtttattggaaagttagagatagagattggattggtttatataatattatagactagttccttctatgtccaccctgtatataaagggaccgcatgtcctctattatcaatcaatcaataaaactctaaaattagccctaagcctcggatgcagggagaagccggcttagggctaactttaggattcattgattacatgcacaaaccttgaacaattggatggccagcaattcagctgataaaaacaaaaaaaaaaagcaggctattgtatagcaaatccctttaaatttaccctaaaactgacgcaaaatgattaatccaaatgttattggtgtaatcacagctcagattcatagatttctagagctgaaaatacttagctccaagaaattttgaaacatggccgcttatgaatggctgaatttgtgtgccacgtcaatgtatcatttgtaagaaatttgtaagaaacatttcttacgtgttaccaccaaacaaaaaatgatgaatgactgaggccttgtttagttagagaaaatttttggatgtagttatcacatcagatatatagacacacatttaaatttgaagtattaaacgtaatctaataacaaaataaattataatattctgtcaagaaactgtgagatgaattaattaaacctaattaatccgtcattaacaatgcgcaattaggcttaaaagattcatctcgtaatttacacgcaatctaacgcaatctatataattgattttttttcctacatttaatactccatgcatgtgtctaaacatttgatgtggcagcatgaaaatttgtgttttgttaactaaacaggccctgaatatgattatgccaagctcacaataatatagatgtaatcgaattgttgtgaatctagatggcctgtagcatcagcaatccaaccatcgtgtgccgggaacgaccgaccgtttacatagacgaaaataagatttaatttgaatcactgtaagcaatcaagccagtttgatgatgacgcttttgtaaggcagtaaaattttggcagataagttggcaagtaattgttaccatttgaacatacacaaacgaaaggatagcatcaaacttaacaagttccgactaaacaatggtaccagaaacataaatagcacacaatgccataacaaagtactagaaaatgaactaaagttgcgactctgggcggataagctcactgcctcctcggggcgatggtggtttcaggctacaaaagaaacaattgacagtatggattagaagaaaaaaagagctaaagaaatgctggaacgataaaaggggcatcgcccacaaaatttagctccaactacaaggacctcaagctgagaaggatacatggatttaggttaacatcatgattgtattattgcacagaacatggcactgagaaaaaacattgtggcccaaacagcttgaatagtctatataaatccaaagcattacttcccacaaactacctaattcacgaaaacaactgagactataatgggatgaaagaaacaaatacctctttcttcacggcctcttccttctctgacaagataagctcgacgtggcagggtgaggacatgtaagctggccacaaaagcaatataagtaaactacaaatggaaccataaatcaacatccatcctcgagaacttacgattgatgcgtccatgagcacggtatgtccggcgtctctgcttctgggcttggttcacctggatgtgtgaaacgaagaggttgtcgacatccaagcctttaacctatacgcaacaaaccattagttagcccaagcatattaaaaaaatatgaagagtgtcaccattaaaattgagaggaaaactagcaacaggttcatacatcagcgttactctcagcattcttcagcagatccaaaatgaacctggctgatttggcaggccacctgccctgcccatttgattggcgagacttcacttgtgcagtacggcccacgcctccacagtaccttctgaagggaattgcctgcttgtgagcaataacatcctcaaggtaccgctttgccttgaccaaaggcagcttgcgaagagcgaacgctgtctcccttgtgttctgcagcaattattagagcatttgacattcagctagagaaacaggaaaaaggataacaagaaccaagaaacaaaccatcgcatacgcatcagagtcttacaataaactagtccagtgaattcagtttaccatgcacacaaagtaccaggaaatgatttcatatcaacagcaacttctagtgagagttatgagcagtgtgacaagaaggccaaatgttctacaataatgatacaatagttttatgtacaaggaagatctataaggaaaacatgagaaacaagaccataatgagtaatagaacagcataaaatagctgtaacctgtgaaagtcaagcttaatcagatcaagaaaattcaatgaaatggttaacatgtgaatagaattatacctaacaatcaggctaataaaaataacttcctccaggttgtacagtgcgcacttgaacaggtaacaacatcaaaacatgaatagcattatgcaagcaatatcgtcaaaaaaaattatgtgcagttcacaatatcttacaccattttcgcatagcgaaaatctaactttgcagatatacgacacaggttctgaacaaaatgcagaaacacttatgatctctatcaggccaaaatcataactaaggaataagcatgatgtcgcactgtctctgaaccatttgtcattgagatacaacagttcgccagaagacagtgcatcaatgttcctaaagtaacgtgggaactgttcgtctgaaaaacagaacagaaccttttactctttaggtcatcatcagactccaatcctttcacaatgctatctacagagtgagaatccaatcctttcacgatgctatctacagaatgaaactctaataatttcgcatatgccatccacacaattatttgccctaaccgaacaacattgcacaaaacgagcaaacacaataacctacaacaaatcaaccaaatacacaaaaacagagatgcacacagagcaggttgacgaaacgcaccttgaagtggaccctgagatccctccccatggccttggccgctgcgcacacaaacaacatcccatcaaaaaccactacacagacagatcaaaccgaaaccaaaccatcgcggaaaaaggatatcatcgagatcttacacttggtcgggttggacggctccgtcgagtacttgccctgcgaaaagatgcaacagcgagacgtcagatcaataacggaacaaaccacgagcggatcaacgtaccggagcggagagagctcaggactaaccatggcggcggcggagcaggaggaggagaagggaagggaagggtagctctctctctctctctctctccgcacagaagaagcagtggctcggtggcggcggcggtctaagaggagggaagaaaccctagaaatggttagggatctctacatgggccttaggctttagttgggcccaaaaatatggcttggttcctagtggactgtacgtacatgtatgcacaaggctggcccattattgtgggctcttctaatagacaaattaggcccatttggtatttggtcttgccaaaatgaattcgataagattgtgtttgagagcatagaaaataagagatagaagatacgtaaaatgagatgggttattagcgtataattaattaagtattaattacttcaaacttaaaaaaatatatgattcttttaaaataacttccctataaatttttttaaaaaaaaacacgccgtttagcggtttaggaagcgtgcatgtaaaaaaagttgcagttttctcatttgttgaaacgaacacagccaagaacacaattcaatttccatataaaaactataaagtttaaaacaaaggatgtattcaaaaggatggttggtttagaacggttgataatatgaacatgtatggctgtatatcgtagatttaatcagcgtgcggcgtattataatcaggatggccgaacatccaagatgatatgagcaaatctgcctcatgaatattctaacgattgtgtgaatatagtatagtgaaggtcggcgaccaaagtcatgtaatttgattgtgactgcatgcccataacataatatttaaccgaaggacattaagattgaacataagcacagcaacacttataaatacaatgggttctgaactttttttttccttgaagacaaaaaaaaaaaaatccccttgaagacaatgggttctggagtctgtactgtgagcaacaaaagttcatttcttctaagaccacagcatcaggttgatgaagttggctgaagccatcagatcagaaattgatcaggaaagactaattgagtagcaatccagcaagataaaagtcaaaactttgtatccactgtccaactcggatgaaatcagaggctcgaattcgtgatacagtaatctttttgatagaaacagcatacacatttgtttggctcacttggcccaaagggatcttttcaatagatgttgctcagattcgtactgtggtaatgaaccttggacgttgactgcacataactttcagtgagttttgtaattcctaaattcgatacgagtattcgtttttctttgtttccaaaacagggtagattacagagtagtattaaacaatacataagagattacaatcctgttgagtagtattttggtcgggcaaagtagaaaatttgaatgtgaactgatgaattcagaagcggccttcatttcaaagtcatgacatccatcaaggtgggcatgctttcatgtgttcccaaccactccgatcgaataggaactgctctagctagtaaattattacgaaattactcgtcacctgaatcatgctttgccatctctaatacactggccgtttgaacgaatatgaagtgatgcgtagtttcaatgtttttctcacctgtgtgatcacttaattcagcatatacaaaaactgcgaagaaaatgattaatactatgcatataggaccggcagacaagaggcatggtgtccatcagagagaatcaatgcacaagattaaccatgataattcatcctatgtgacatctttgatctttttcaatgggttgtcagaatcagatacatactatatgcaagcccagacttttttttgccgggacggccgaaggttggccgcccaaaatttattaagagagagggtgatacaacttttacatcatcgacattaaacagtcgatagggatgctagccgtggctaacacccccgaaataaacgaccgtgaagaacacggcgcctctaacaaactctgagaaactagtcgattagtctacttgcttgaagatgcccgcttctctccaaataataatctcctccctgatggcccaaaagagctgtgttgccgatttagagacatgctcgaaaatacgcgcattgcgctctttccatatgaaccagcaaaccatgagcatgcgccagactcgattggttagggggcatttcattaagaggtgattgcagctctccatctcagcattgcacaggccacaagaggcgtcatgcggccagcccctcttctgaagattgtccgctgtcaggcaacggccttttgttgccaaccacatgaagaatttaatccgcgacggtgctcttttttgccaaataagctgtgcgcattgcgatcgcaatcgagccagcaagaagagctcgtaaacggaagcagcattgtaattaccgtcagctgtgatgcaagcccagacttgacgataaagggacactaatgagaagatagtgacgataaagggacatttatgcaatcccagacttgacggttaatatcagctggagtagaatcgttcaggtttactgaagagctgacaacaaatgttcagaaggatattctctgatggacttcgatcgaatcggcacaggttcgatgttttcccttgtgcaatgggcactctgatatttcggttggattaagtgggggaaactggaggtgattaagcaaggttcaatgaacagtgtgtaattttgggatgagacgtcactactgatacagttttgtcgatttgttagtaccaagtctgaactttctacgatttggactccgtctacagaacagctacaagaatctttatacttgaccttctaggccacttgcccaattggcacttggtgggcccggcctctcggcctgtgggcccacataggctaactgcctgtcccagaccgagtaatttgaccgtcgacttctctaaaatatgaagaaaacaataattaatgacctttctgatatgcgatggaattcattgttccaaacttcaattcgttagttatcctgcaaaatatcttctttggtcatgcctgtgatcttgtcccgctaaatgtgatccttgttatggttgaaatttgaagctttctcatttgtcaacgttggaaaatgtgatcctgaaaaaattgcaatcctgaattgggtaaaaagttatttgacaattgatattatcaaccaatcaaggattgtgggattggacatctgaaatttcatctgatctaccaaataaaaattgtagggcctattggaagacaacacttgacatgagggaagtagacaagtagtcacacactcgcactccattgtgcatctttcctaccagctgagttcgaatgttccaaatcctacgaagctaccatgaaagtacaaaaccgtattagcacttttttagagaaggacaaaaccgtattactacctcctattgaatacaaacttgtatgccgtacatatttttgcacacggttacaattcccgaacaagggaaaaaaaacatgactttcccatcaaaagcacaaccttctccatcaaaaaaacattttttttccattaaaaacgacatttttcacgaagtgagcatgatttatcagttagttagtgttaatgaccaaatttggtaatatcagcatcggaaaaggagattagatcaaggtgtagtcgaaggcggagattgatccaagaacagagcaaagaatcggctgaagtccagattggctacgattaggatcggctgggtctgagtcgaactaggtgagccgatgcagccgattctaacagtataatttggtgtatgacattgggttgaattgaggtgcttcaagatgattgccgcacatggatagagtcctgagaaggcgattgtatctattaattatgatgttttatgtaacttccttagagatatgtttgggcaaaagtctgccgcaaagacttatggtatcttagagtttgttagagatagtggtcgtgtccggtatggacatatcttgtaattctcgggtataaatagaccccgagccctatgtaatttttaacacacatgttcaatacaatttcggcgcatcaccaactttttactttagttttgtttcgacgagttcttgctttcggattgagctgcatcggtttcgatcttcaacaagaggtaaaacttgttatgatgacttgtgttctcgagattagtgctttcatctttatgacactctaatcttgtctatataattcgtcaagttatcatatatcttacataatctttggcaatatcgtcatctaacctacaatcggctaacatatgttaatagaaggcagccgattaggttaaataacgacgttgtcctagattatataagatatctaccactttatgaaacacctagcggcttgattgtctagatattgttcttcttttcatacttaatgctgcatcagttgagtttgatctattaagtcgtgcttagaatatcaatctctagcctgccctctggttgccgattagggtagtatcggagtttcagccgatcttatctgatttaaccatattcgatctatatgcttcaatgacatattaaatccgccatttatgtcaagatcttattgcatttaagtatattaagcttttgtttggaatattatatttgttttgatatctttatataaagtagtatcggagtattagctgatacatgctagatctatctgatcagctatgctataaacatatataatcctgttattaatatatatttcgatctaagtggtttatactgtctcggcatggtgaccgatctatcccaatcacttaatttaagtatatattaatataagaactatatatcgttaatatctacagccgatcgaatagatttagttccttactatctatttataagcgccgatcgattcatatatgacatcgactcaaagataaatgatatgtcatcggcacctagccgatcggctatcatttatagatttaaccacgaattttttgtttctatttcttgttgattacaggatcaaatcaactggtacgctcatatattcaaaggcgagctttgaacctgcactggaattaagcagatctctcagacctcgtgttttctatcaacaatcaacgacagttagttttctttttctcacgacatacccgtacttcgtcgattttaagatacactgacatgattagaggtgttaattggataaaacaactgcgtctgaactgtgtttttcaataaaaaaaagatagccttttccataaactcgacacgagataatcatccccgagtattagaaaggtgtggcgctgcagtgttttgatacgtggaaattgtccgaggacgccgagcaaagcaaagcagcacgagcggcgcgtttggttggtcgcgtcgcgctgcacagcacccggtctttgaaagctaccacccggcgcgcgcgcgcgcccgcgacgacgacgaacaccaccaccaagaagctctctctctctctctctcctttgcttctcctctaggcgattgctgcgtcgacgacggccatggcggacggcgcgcgggacgccgtggtggaggtcgcgaagcacatggggaagagcctcgcggtgtccaagaacgcggccgatgacatgatgcgcgttctgtccaggtacgaaggtgaggcgcccatgttccccttgtcacatccggaggtggatcaggcggaggaggaggaggtgttcgcggcggcggaggacatcatccgccggtgcaactcggtgtcgtcgccgtccgagatggttgattatctttacgccgtggacgacgcgatcgccgcgacggcgctccagggcgagctggcgtcccgcgccgcggagaccgtgcaggccgccatgccgcggctcgaggaggaggtgcgcgcgctgctgggctcctccgcgcggcgcctctcgctcgactcgttcgaggacctcgacgacgcgggcgcggcgacgacccccgacgggtcgccgccgcgccgcgacgcgctctcgccggaggcggccgcctccgccagcggcgtcgcggaccgcatgctgcgcgccgggtacggcccggagctcgcgcaggtgtacgtcgccgtccgccgcgacgcgctcgcggagtccgcggcgcacctcggcgtcgaggccgtcgccatcgaggaggtgctcaggatggagtggggggtgctcaaccagaggatacggcggtggagccacgccgtcagagccgtggtcaagaccctcctcgccggcgagcgccgcctctgcgacgaggtgttcgcctccgacgaggagttcggccacgagtgattgcacacgtcgccaggggctgcatcgtgcaggttaaaggatttagggacaccgttcccaatgtccccccggggcacgaagaagttctaccgcatgctgggcatgtacgaggcgctcaccgccgtcgagccggacattgaatccctcttcaccggagacgcccgcgacttcttctcctccgaggtcgccggcgtcgcggcgcagctgggcagcaccatccgccacacgatcgaccagttcgtcaacgtcatccacggcgagtcgtcgcggcgaccagtcctcggcggcgagatccaccccatgacacgctacgtgctcaactactgcggcctcctcgccgagtgccgcgtcacgctcgacatggtcctcgccgacaacaacaccagcaaccacgacaccaacgacgacgaccacgacggcggcggcggcggtggcgcctcgtcgacgccgtcggggcggtgcatgagggagatcctcacccacctcctccgcaacctcgacgagaaatcgaggctctacgacgacgccgggctgaagaacatcttcctcatgaacaacatctactacatcgtgcagaagatgatggtggagttcccggcgctgcgcgagctcctcggcgacgactgggtgcgccgccaccgcggccagatcaggcagtacgagacaggctacctccgggcgtcgtggatgtccgtgctggcctcgctccgcgacgacgcctcgccggcggcggcgcacgggcacggcggcagggcggcgctgaaggagaaggcgaggagcttcaacgcggcgttcgaggagctgtaccggagccagacggcgtggaaggtgaccgacccgcagctccgggaggagctccggatcgccgtgtcggagcggctcatcccggcgtaccgctcgttcgtcggccggtcgaggcagctgctggagtccggcagcagcagcggccgccactcctcgtcggcggcgaagcacatcaagtacagcctcgaggatctcgaggactacatgctcgatttcttcgaaggcgttcagaagttcgtcaggtgatcacaaattcagagtttcgcagaattttctgagagtttcagaatttcacagattcagagtttcagatatttcagagcagaggagctctgcttgacttgtagagattcagagtttcagagaatcaa

SEQ ID NO: 17928 - DNA, 372 bp, Oryza sativa
tcccctattggccatgctgaaagactacatgctaacactgaaggaaaaggaagaggaaaaatacaggcaatgggtaagtagttattaatcgattggtgatacagaaaattatcagtcaaattgttgtttaattcatcaagattctctttacaggagaataaaaaggtacagactcaacttgcaaggaggcatgagaattcatttatattaagacccaacacaagctgcagtcgtccatcaagcagaggcttcaataccagccctggctcaagtactatttggagcagcagacttcctactatggttcaacaacctagtgcagataattcctcagctgaaaaagatgtgcatataagaaaagttaggaacaga

SEQ ID NO: 17929 - DNA, 783 bp, Oryza sativa
aggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgtaggcggaggcaccagtcggcggcgacggaggcaggccggcggtgaagtcgtggacgcccatgaacggtggtgtgaccaaccaaccgtataggcgaggacaccagtcggcggcgacggaggaaggccggcggtgaagtcgtagacgcccaacagcggcggcataataggccagccgtgtaggcggaggcatcaatcggcggcgacggagtcaggccggcggtgaagacgtagacgcccaacagcagcggcataataggccagccgtgtaggcggaggcaccaatcggcggcgacggatacaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcatagacgcccaatagcggcggcataataggccagccgtgtaggcgaaggcaccaatcggcggcgacggatgcaggccggtggtgaagacgtagacgcccaacagcagcggcataatatgccagccgtgtaggcggaggcacca

SEQ ID NO: 17930 - DNA, 10997 bp, Oryza sativa
gccgccaccggcaccggcggccggccaggtgtacggtacgtgaggtgtttggtgttttgtctccggcgacagccagccgccggccactgcgagcgtgacgcgtgtccatatcccacagcatctccgtacacatacggggtgacgtcatccacagctagcgcacccggtaccggtagtactaccgccgcgcgtacgtcgagccaaataaaaacgagaggtggtcccgtggatcggatccgggccgtcgatcgcgccatcgacggtgtcacgtggatcttccaatcctactactagtatagtacgtgtcgtgtctgcgtgctgctggatgttttcctactttcctttggtccaatcgctatccaattcagcatccagctagcagcttagcttttgcaacgacaaggtattatttcgtcaacttgtgtgcacgtttgtagctatagctttgggctcaatcgatcacgacgtactctactacactttacataaggtggccaaagagagtggtactgctacaccaaagtgcagctatagctattttttgctgctgttggccatgtttgtatgcagggatgatttcagtaggaaaaaaagttcacttcttgtagtagttcaacatagctagaaatgctctcacatttcgtagatggggcctagatgatgcttggagcctacatttcataggtagagaagagagaagattaaaaaaaagaaaaaagtatatattttttttgaaattttaaggtagagataattaagaaaagataaaactagagagaaaaagatgttttttaatttttttttcctatttgactgacatgtagattcttatgacacatactcactccgtccaaaaaaaaactaaacctaggagggggacaatgaatctggactaccctttgtccagattcgttgtccttaaactaggaaggatcaaattccctcctaggttgagttttttttggacggagagagtatgtgtcaccgtggcatgtcacatcagcgcacggagtgagatggagcctgtttgaacatgtatgatatccaagaaaagtttcgggatacggatatgcattttaagatttcatggatctaaacgtaaaagtttagaaacagttcatatacttcactcgagatcagattcatttggtgctacctaattaattaggctgagtagtgcagctgggcattatatatgatctctgcaccaagaaaagtactgggtagctacatatggggttatggtttgtccttaacgaattaattagttcgagaaaccgagtaactgatcagtgcgtacatctctgatatatgcaggttagttattaacctagtttcaattcattaaggacaaaccattcatgcaattacatttgctgggtttgtacactgtactcacatgcaacaagatatgccaagagctagggagtactacagtactcattagtgatcgctagctaggtagagaccatgcattcttgcatcaaaccaccattcttgcaattacatgcatgctcaatcatcaaaccatactaccaacaacccaacaagaaggacgaagagatgattaactaattaattgattaacccttttctgaaaggccggggtccagtcaccgatcatcagatgacacacacacacacacacacatatatactactacagtagctgtagcaactagcaaagcaagtggaacagagatgaatctttctgaaaagggtcattcgatcacctcgtcatctagctagcttagctacctcagctactgagtgactgaaagtgacgtcgtagccatcgatcgctcgctcgccggcgatcgacgacggcgagatctaccgtcggcgtccgtcgccaagcttgcggtggtcgtcgacgacgacgacggcgacggcgacgttgatggtggcacatgggcatcgaccgatcgatcgctttcacggcggcgccggcgactattcaacgcggaattgaaacataataatgcatcggagcagatgagatcagaacgagatcgcagcaatagcaacaatctgacggcgtccttgatggctctgttcccccgatcgatttgctcctcctttttggttttttttgcccaatcgttggatcgatcgatcgatcctcatcaatgacgatatgctcatgcatggaccacgacaagggcctagctaccctagctatagctatagctactgttttattgagcggaattcgcaatcagtaaaagctagcagcggagatagctcaatgcgataattggattgatttgtcaaagtgaggcagtacatgtaaacacggctctttacaatatccactcaattaatgggtcgatcgatttcttagaaatagaatctactccctccctctaaaaaagacaaaccctgaatttccatgctcaacgtttgactgtccatcttatatgaaattttttacaattagtattttcatgattaatactttatgcgtgacttatctttttaattttttataatttttttaaataagacggacgatcaaacattaaacacggaaatctagggtttgttttttttaacagagaaagtagataagtacataccacatactacctttattcgagaatataagagattttgcctacgtgattaattgcattagcaaaatcccttatgttttctgacaaagatagtagtacgaaaccaccatatccatctcgcgatctgtgctgccgctgtggaaaccgatcgatcgacaaagagtcgtttttataagtcgtgattgcaactgatgatcatgaatataggcaattagcaaaagctcatttatcggtttataaatgagagatcgacctgacgaactcaattaaagtagagagattaaattacgagctacggctcatcatcgatcatgcagtagctaagacggccaccagccgccggcgatcgtcgtcgtcgtcgcccggcgacattaactgctcccgggcgtctactgttcctgtgttgcgtggccgcatccaacaccatggatggatgggtgtttcgctggagggagggagggagagagctaggagtactaactccataaaaaagaaaaaaaatttatagcatcccaagataaatttagtgagaggtaaaaataaccaaaataaccctcatcaatggaaaatatagtaatgatgataggtaagtaaaggatatttaagggataaaacttctcattttatgtgttgaaacctgaaggtatgtagggtgatagaagttggttttccgcgggataaaatttaaactctataaggtcccatttgtttctccaacaaaagttggatgaagattaagatttttcgtgacatgcttttcaaactgctaaacggtgtgtttcgtgcgaaaactttccatatgaaagttgttctaaaatatcatattaatctattttttcaagtttataataattaaaaatcaattaatcgtacgttaataccatctcattttacgtaaaaaacttaatttcatcttcaggagaaaagaacaccacctaaattgagttttttttttatttagggagtagctagctagctaccaaggtagggctactgtgccgggaaaacgatgcttcactcggtcactttcgtgaccacgtcccagaacgccgcaagcacaagctaagctatgatccactagccaagcttcaattaatgttctgggttgttcagctagctgtcgaatgcgatgacgatttttacctcctttcgtaccaaaataactacgataaaaaatattattattttttcgtttaaatcgttctagaaaatacaatgcacacacctaatatgattagatattttgaggataaaggatttaaagaaaaaagatggttatgtcttatatttgatagggagggttgtatctacatactaagagattgggcgttttactgatatttgtattatactgaaaagagaaaatatctcaagtctaaattttacttgcttattattttttgaaaaaataattaaaatacttgaaatatgttaatattatcaaggtgcgcggcgtcacatatatgactttcactcatccaatataatcatttatagtagtatgtggtcaaaaagtgggacagccatagttaattaaaagtggtagttaaagaacgaaggaagtattaagggcctgtttagatcctccaaaatataaaagttttgcagttttggaccattttttggcaaaatgaatctaaacactagtagcaaaaaataggcaagttggcatttgtcatttgggagtacatagcagcaaatttggccaaaaaagcatagggccccgtgtatgagagaggcaccagcaattaatggtaaaactttaccatgcatctaaacgccaaccaacttgtaaaattacaatgccaaatcttttgccaccaaaacttttgccaaaaaaaatttgccgcatcaaattgatctaaacaggccctatgttgtattttattggaatccgtaccacacgtatactttcttagccttagaataaattcatttttggctcctttcgtttattctaaaataagtttatttttcagtaattattatatcggagttgataaaagtataaaggaaaatacattgagagtaaataaagtggaataattacattagtatttgataatgtgggtgtattctagtttcttttatttgtatggtttatgtggaattggctaaaaagtaaagttattttgagatgaagggagaactcaaaataaatataactaaagagcgtaggtgcacatatattcacttcgttgcaaattgatattccgtatgaaaaggagcatcccaaggtttttataggagcgaattttaaattaggttattatattgaatttatcccttttattcttaatgtgtgagttaaatttaggcttaatttctctctgattttatagactgtcatacatatgttgtatgaatatttgcaacttattcttaaaaaaacataactatttggataatgtttgaggaaacaagaggacatcctctttgagagtttacaagtgtgttttcccattgtaaaactgcccaaaacccctacattatgctgtaggactagtaggtgtgtttgggtacttaatttggtgtggtctaattaattacacgctctagggaagttaattgttatggtgagctagctagctcattaattgtctcgtaacaaatcaatgtgccattgttgaggaagaaaagcaaacagtacctgcagcaagcaaaaccgatcgatatgtgtcctggttttccacactgaccagtacacattttcagttgcctccttgcttgggaagaaattaactactgttcctactatctgacatatatatataaggacagctgatttttcaacaagtgtgaattcaccgcgcaatcaatagatgtgttctaatcctactacgggtgtgtttagttcatgctaaaattgaaaatttgattgaaattagaacaatgtgatggaaaagttggaagtttttgtgtgtagggaagttttgatgtgatgaaaaagttgtaagttgaaagtttgaagaaaaagtttggaagtaaacaaggcctaattaacatgataacatcggacttttcaggcaatcaggctacaggagcaggaagacatctgcaggtatacgtatgttgcttcccgtggatattattagtagctgaatcctatgaaaaaaatatgataagcgactaacattaggaacgatctcatggtagaggggcgggactagaatttaatttctcaaacctatagctggtgtactattatagtttacacataattgtatatttaattatcttcaagcttttgaagtgtacagtataattcaatgggtgtttaggctgtgtttagttcacactgaagtttaaaagtttagttgaaattggtacgatgtgatagaaaagttgtgtgtgtatgaaaggtttggtgttatggaaagttaaagtttagaaaaaaaaaactttaaaactaaacagggcctaattaggttcatgatcgagtaggactacttacggcgcccttaactgtcttattagctaggttaagctaattacgttccgttgtagcagataaagagaagaaatctctcgtgtgttatccacatcttatggagaggcgaacatgggaaacaaaaatcatggtggctcacatgatgacgcggatttcaggtcaagtatacgtactagtatcgatgacgttgtacgtgtacacacaatacaatatatcataagggtagagtttacgtacgtgtatttatataggtgagtgtgtacattgtgagtgtctgcgttgtactgtgtattttttttaaaaaaaattggtgtatgtcacattctcttttagtttttttttttaacggaggagaacaacgccgtaatacgcacctggtccattgtgtatagtacacgatcgacgacgtggcatgcagggaccgcgtgtgcgtgcgtacgtacgtcgcatgtggtggctggcgtccgtccgtgcgtgtctgtctcgaccgcccgcgcgcgcgtggtccacgtgcggtgcggacggcgcagcatcggtcggtcggtcgatcggtccgtccgtacacgtgtgggtggtggtggtgctggtccagtgaacgaaccagttgggctggacctggtggaccagatcgagcgcctgtcactttgtctggctctgccacgacacaacgtgtggagattatgggtaccccatacccacacggcatggttatccgactagttatagaggataacttatatgtatggaatatgtaacagatcatgacttgggtattacgtttccctgtatattatggaacggcctaaagtcctggtttgataagattgtagagtagatttaggaaaccgataccatattggttaaggtttctatcttgtaaccctgccccctaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaacctcttgctattttttgttgttgttcgcatataattacgcggcactattgaggcgattgatgctggtcatggactcgaggcgtctcagctttccggtcgatcggccgcgagtccactctgccggcttgtcttcgccaccgccattgctgataacaacaacgacttcaccaccggcctgcctccgtcgccgccgattggtgtctccgcctacacggctggcctattatgccgccgctgttgggcgtctacgacttcaccgccggcctgcctccgtcgccgccgactggtgtctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtctacgtcttcaccaccggcctgcctccgtcgccgccgattggtgccttcgcctacacggctggcctattatgccgccgctgttgggcgtctatgacttcaccaccggcctgcctccgtcgccgccgactggtgtcctcgcctatacggtcggttggtcacaccaccgttgatgggcatcgtcatctacaccgccggcctgcctccgtcgccgccgactggtgtcccagcctatacggtcggttggtcacaccaccgttgatgggcatcgtcatctacactgccggcctgcctccgtcgccgccgactggtgtcatcgcctatacggttggtcggtcacaccaccgttcatgggcgtccatgtcttcaccgaccggctggccttcgccgccgccgactggtgtttctgcctgcacggctggcttattatgccgccgctgttgggcctctactacttcaccaccggcctgcctacgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttcatgggcgtccacgtcttcaccgaccggctgaccttcgccgactggtgtttccgcctgcacggctggcctattatgccgccgttgttggatgtctacatcttcaccgttggctcaccttcgttgccgtcgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattgatcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggcgctaagtattattcggaataaatcaaaagcatagagataagataatttattttctactcttaataattgcaaaagtacccgagtagtaaactccgatccgtgaaactttgttccattaatgacgaactcatgtcactcatatgcatgtttgggaagtgcttaggccgactcccagtgcttggtggccatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttctcgcctgcacggttggcctattatgccgccgttgttgggcgtctacgtcttcaccgaccggcttgccttcgccgccgccgactggtgtttccgcctgcacggctggccttttatgccgccgttgttgggcgtctacgtcttcaccgaccgacttgccttcgccgccgccgactggtgtttccgcctgcacggctggcctttatgccgctgttgttgggcgtccacgtcttcaccgaccggcttgccttcgccgccgccgactggtgtttccgccagcacggctggcctattatgccgccgttgttgggcatctacgtcttcaccgaccggccgcctcgtccgccgccgactggtgttttcgcctgcacggctggtctttatgccgctgttgttgggcgtctacgtcttcaccgaccggcttgccttcgacgccgccgactggtgtttccgcctgcacggctggcctttatgccgccgttgttgggcatctacgtcttcaccgaccggcttgccttcgccgccgccgactggtgtttccgccagcacggctggcctattatgcagccgttgttgggcgtctacgtcttcaccgaccggccgcctcgtccgccgccgactggtgttttcgcctgcacggctggtctttatgccgccgttgttgggcgtctacgtcttcaccgaccggccgcctcgtccgccgccgactggtgcttccgcctgcacggctggcctttatgccgccgttgttgggcgtctacgtcttcaccgaccggctcgccttcgtcgccgccgactggtgtcctcgcctgcacggctggcctattatgccgccgttgttgggcgcctacgtcttcaccgaccggctcgccttcgtcgccgccgactggtgtccacgcctgcacggctggcctattatgccgccgctgttgggcgcctacgtcttcaccgaccggctcgcctttgccgccgccgactggtgtcctcgcctgcacggctggcctattatgccgccgttgttgggcgcctacgtcttcaccgaccggctcgcctacttcgccgccgactggtgtccacgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctggcctattat

SEQ ID NO: 17931 - DNA, 5532 bp, Oryza sativa
tgttgggcgcctacgtcttcaccgaccggctcgcctacttcgccgccgactggtgtccacgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctggcctattatgccgccgctgttgggcgcctacgtcttcaccgaccggctcgcctttgccgccgctgactggtgtttccgcctgcacggctggcctattatgccgccattgttgggcgcctacgtcttcaccgaccggctcgccttcgtcgccgccgaccggtgtcctcgcctgcacggctggcctattatgccgccgttgttgggcgcctacgtcttcaccgaccggctcgcctacttcgccgccgactggtgtccacgcctgcacggctggcctattatgccgccgctgttgggcgcctacgtcttcaccgaccggctcgcctttgccgccgccgactggtgtttccgcctgcacggctggcctttatgccgccgttgttgggcgtctacgtcttcaccgaccggcttgccttcgccgctgccgattggtgcttccgcctgcacagctggcctattatgccgccgctgttgggcgcctacgtcttcaccgaccggctcgcctttgccgccgccgactggtgtttccgcctgcacggctggcctattatgccgccattgttgggcgcctacgtcttcaccgaccggctcgccttcgtcgccgccgaccggtgtccacgcctgcacggctggcctattatgccgccgttgttgggcgcctacgtcttcaccgatcggctcgccttcgccgccgccgactggtgtttccgcctgcacggctggggcgcgtcttcaccgaccggcttgccttcgccgctaccgattggtgcttccgcctgcacggcagacttattatgctgccgttgttgggcgtctacgtcttcaccgaccggccgccgcatccgcagctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgccctcacctcaacgtctggtttatacagctaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcgacttcatctttattatcttcggcactggcaaactctattgctgctacttcgcaagttttactacttcaccaaccacgacgtctttgtgaacctcgacatctcggcatgcaatgccatgatattttactacaacaagtgactctccaatattcaggatttctacttggacaccttcaacacatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgtcaagcctcatcaacatagccaactctgctgctgttgatgggaaacttcgtcatcatagtcggctatctctgttgccgctaatcatcattaccgttggatgcgtttgtcaccgccgattattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctgactgttgccgactggtttcttcacctccatggttatgcaacttcattacatttgattggtggtatctttactaccattgacatcttccgttacttccgatgagcaatttcgtcttcatgttggtcatttcatctccatgccgactgcgtcagttattgccaatagacaattttgactatgacagaaggacaagctatatgctcaggggctcatcaactcaagcgtgaggattatatctccaatttggacttgttccggatacattccacatggattcatagtcatgagtctattttctatgttcaaagactggaccaattattattccccgtaaaggttatcaaccgaatacttgcgccagtcgggattcaattattatatttattttggagtatcccataagggataatcattcagatcagaagctattcatatgagctacacttggtctatattactcggaagatttattactcgggagcatgttatatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgcttttcgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcacttaaccgcatagtcgagggctacacctattaggtgcatctagtcgatgcacctgactttatttttcagccctccacagtcttcagatttggtaaaagtactcgggagaccatggcaaagatgattgaagtactcggctttggagtaatctggttcgagagaagattatcttttcgactgtgaaggtctcaggggctactgtggagattatgggtaccccatacccacacggcatggttatccgactagttatagaggataacttatatgtatggaatatgtaacagatcatgacttgggtattacgtttccctgtatattatggaacggcctaaagtcctggtttgataagattgtaaagtagatttaggaaaccgataccatattggttaaggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctaccccgttttattattgccgaaatcatgtttcgacacaacggctgggctgcccctgcctggtgcgctcgattcgctcgacctgcactgcactatacgtacgtacgtactgcaccggaaatgtatacgtactcgatactcccatgtacagtatgtacgtggtgcacatcttgtatagttgtgggctctccttttgttctaaaatataatcatatcattttaggtaaatatcattttaggtaaatagctgatacagttcctggagtttcgctttagactcaatttagtcttttgggtttcaaatcgtctaaacaagtcctccaaattagttatttgggttaatatggtctttggaaccgcaaaaaatgccacgtgagcatgcaagtcatcatcgcatatagtggtatagatgaaatggccattctacccttatataccatatacttcatccatttcatattacaagactttctagcattactcacattcattgttaatgaatctagacatatatgtgtgcctatattcattaacatctatatgaatatgggtaatgctagaaagtcttataacctgaaacggatgtagtacaaatgaaagaaaaaaaagaagataaatggttcacatgtgtatgatcgtttcagaattgccacttacgattgctgcagccaagcactgatcgcgtaaattcctttgtcggccacctatccgcaacaatgctgggcctgggctggcatgttattttttttgtttgtcttttccttcttttctatatggtatataagggtagaatgatcatttcattcataccgctgcatgcgaggatgacttggtatgctcacatggtattttttgggtccaaggactatattaatggttaatttggaggacttgtttggacgatttgaaacatcgagaactaaactgagcccgaagcgaaactccagagactatattggctattcaccaaatcatttttagaatagcgtctagtcaaacattttaaactttgaatattatagtaaaaaaataaaaaaaatcaatcatgtaaaattggtattacaatatttatcattaaacaaactatcataatataactctttttatttaaaacatcttacttttagatatattattggtcaaactagcatttcaaagattatgtcaaaacaaatactcgctccgtcccaaaatataaacattttttaacttcgacacgatctttgggatgctactttgaccaacaaaatctataaaagtaatatgtattaaataaaaaaagttgcatattactccctccgtttcaaa

SEQ ID NO: 17932 - DNA, 2552 bp, Oryza sativa
acatatgctaaaaaatcaacggtgtcaaacattttgaaacggagggagtataatagtttgtttaatgataaatctagaaacatcaattttacatgattgatcttttttattttttattatcaataggcaaaatttaaaatgtttgatttgatactattctaaaaatatttatattttaggatatagtgtctgtatgtttccaagttgcctcctgtaaatattttcttcatccattccatattataagtaattttaattcttttatcaatcaaatattttagtttaatcaaatttatagaaaaatattttaatattttaaatacaaaacaaatatattattaagatatatttaatcttacatctaacaaaattaatttagtattatatgttgttatttttttaaagttaattaaaactaaaaagttttaagtagcaaatagtaaaagcgatttataatatgaaacaaaaacagaggcagcataccatactgtctatacagctaacttttgtaccaacctatattcctttaacttttgtaccgtttataaacgctacttctccaaatatgctagtactaattgatagtacatctcgtctcgatcacactctcttataagctcgtgtagatattactccctgtggagattatgggtaccccatacccacacagcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacatgtctaaatcctttgtctccacatccatccacttttaggtctcgtgcgctaccccgttttattattgccgaattcatgtttcgacactccctttcactctcttttttcattaaatctcttaccacaatttcataagcctagcttactccctgtctttaaaaaggacaattataccatttacattttagctttttttttgaaaaccacattttagcttaaaaatacaattctatggtattatcttccccctctaaccaccctcatatagtcacatatttaaatttcttcccatcttattattaacaaccctcctacgactctctcctgttcctcacttacggataccgtccaagtcatttttgtatcccagttattttgtttttttaagtaattgacaacccattttatttgctgaacacatcatcctacgtggagtattaattatgatctgcaacacccttcctttaatttagatgtgttacactgccgcatgcattgatcgttctttgtagcaggtgggtactcggttaaggctgtctttagttcacaacaaaatcgaaagtttggttgaaattgaaacgatgtgacggaaaagttagaagtttgtgtgtgtaggaaagttttgatgtgatggtaaagttggaagtttgaagaattattttgcaactaaacacgacgtaattacactagctagctctctaaattattagtccctccgttctactccatccgtcccacaagagtattcctagtatcccaaggtaaaactagtggagagtaaaaaagactaaaatatccctcattattgaaaaaaaagttgtaatggtgatagataggtaaagtgtatttaagggataaaactttcttattttatgtgctaagcctgagttcagatgagggggttcccaacccctctccctcgtattccacgcgcacgcttttttaaacggctaaacggtgtattttttataaaaagtttctatatgaaagttacttaaaaaaatcatattgatctatttttttaaaaaaatagctaatacttaattaatcacgtgctaatggaccgctctgttttccgtgtggaggagttgggttcccaactcatggtatcgaacacagcctaagggtagatagagtggtagaagttggtttttttggcacaaaatttaaactccataagttgagtttttttagacggaggaagtatgatataagatttacccttctaacttgtctcacaataataatatatataagggattttattatcaagaatactttatttcccatttatcgagtctttatagtttattttcccagctatctcttgtgctactacctaattatcaccttgtgtactacggcaaattggcacgttctttttctactctcttcatttcaaattaaaatattctctcatattcatattcgtaatactgggatatgtcatatctctatactaaatttatttattttgaaacgaaaaggatacttccttaaattttattatataaaagtaatatactccttccgtctcataatataagagattttggatgga

SEQ ID NO: 17933 - DNA, 17033 bp, Oryza sativa
tccaaaatcatttatattacgggacgaagaacgtagtttgactagttaggtttcttgtttgtggaacgaaccccacccagttgaagttctaaacttgacacgagtgctcgcatttatgactatttattcttttagtggtaggcaacgtacccatgatagtgaggagtccgtggtgactttatcaatctcaagatatgtgagcttagttttctggaggtgtgctcataggggtagggtgtgtgttcataggggtgagtggatgcgtgttagcgtgccgatgacaagtcatgtcacaacgctgttgatacgaaaaacacacactagcctgggagatctgcttagctccagtgcaggtccaagacgttgatgagatgcgggcgtgccagtcagtttgatcctgcaactgacaagatatgtaaacaagatatcaataagccgatcggctgacaagccgatgaagtaattccagccgataccgataccagccgatagcaatagggtttcgagctatcggctatgtgtttgatgtggggtctgacaattgatgtagataacaatataaagtcaatcagctgatgatgatataatataacaataatataatccagtagaaaccaatcggctaataatgatagagtaatcactgatccgaaggttaaagcatacatcggctggaggtctgatgtcataaaatccacaagattagataaacatgaaacctttgttgtcatcggctaaatccaacttatatgtatatgcaatccttataaaccgatgcaacgtctagtaacttatcggctagcaccccgataaaacactagcatgaacctatcggcttaacaagatttatattatcaacaacaatctagtaggtcgaacctaaccgatgcagcacgagattgtatacgataatctaatactcgatgagccgatagatctgtataatgtgatggatataacaaatctatttacaacagcattgtgattgtagagatatatcgactaagacagaagatcagacttaactaagacagttccaactaaaccgatgtgtctctaaacacaatgcaattagagatagaattgagatatcaggtaggcaaatatatcaaccaaacaagagcgatccaagagatcgaagcgatgcagccttgaacaacaccaacgtggccaatagattcaccagggccggcgaaacgtaggacttaccccttcgccggatatcgaactgaaccgatgcagccccacatcgggtgcctaattccgctggatgataattaaagacctcgggaaagagggtggcgatgcgccaagagtagttgtattgatctagagattgatagattatagtgaccctatgtgcacatatttatacccatgtgtagatactagtccttgtcggataagaaagaaactttcctaaagataaaaggaaaacataaattccttattggacactgaacacactttcctaaagataaaaggagactaacaaactactcctaattaatagataacttgccatgccgcatctcccttaaactcggactcttctggataaatttcctttaattgatccaactccaccaagaacacaattgctggcgatttgacgactcccatcggccgattccaagactctgaagccgatactgactctaggccaatgatgacttcgggcttacaaattctggcgttaacaagcgcacgcttgcatgcccatccatgtgtgctattaattaattaggctgtgtttagatccaggggtgaaaaattttggcgtgtcacatcggatatacgcacacatttgaagtattaagcgtagactaataacaaaacaaattacagagattccgcctgtaaactacaagatgaatttattaagcctaattaatctgtcattagcaaatatttactgtagcaccacattgtcaaatcatgaaggaattaggcttaaaagattcgtctcacaaattagtcgcaatttatgcaattagttattttttaagcatgtatttaataattcatggaggtatttaaacgttcgatgtgacatggtgaaaaatttcgaggtgggatctagacagagcattaatagtagtattaagtcatgaaatgacgtatggatgaattaaattcagtcgtcagacggcattaattaacaacactcccccgacgagcgtaataaaaatgcccgacattaattaattaacaatgtgcataactgtgtatatatatgcatgctaaaacagagcgaggccaattagccgtacgtacgtgatcggtgaagcttcatgcatgttactcatgacatgacatttcaaacctaattaaattgactgatgtgtcatgtacatgtgataaattgtgtataacataattaaattgactatggaagcagcagccaggggtgaaaatggggcgggtaagatcggatcacaatcagagttttcattactgtcggtaaccgcggttaccgccattaccgcggggtacggtaatagaaataccgcagtatcctccttaatttcaaataaatttagaaaataatttgaatttttaataaattttgcacggtttcgtacggtttttcacggttaccgcggtaaccgtgcttaccgccggggcgcggtaaccctggccccgatggtttaggaaaccctcatcacagcattctcatatcctaacctacatcttactttaaattcggaatcggatatgggtagtgtcggataacacatcactcatcccgtattctatcccatattaatttcttcgaatcggattcgggaacggatatttttttatgtccaactcatgaatatttaatgtaagaaaactattaaagtgctaaaaaagatacatcaaggaacaaattatataatattgcacgtgagctcataaaaaatagtgattaactaatcttttattatgtttataggtgaatttataatagattttcacatatgtttcataatatgtgacatgcgggcgaatacaacccttcctgtattctaatccatatattttttttacagatttgggttcgaactcggataatatcgggtatcccattttctctcccatattcctcccgcaggcctcggatcggttgggcgggcgggaaatatccgccccattttcaccccctagcagcagctactataccgatcgaccacatcacgtacttatacgtatatatatacgtacggacacaaatacaactatatatgcaagggcagatccagtgattcatctgtaaagtgtggacctacgtacgtatctacagcatgcacgtattcgtgtgtgtgtaataggtgttaatcgaaggacctatatatacgtaatactacttccatttcaggttataagactttttagctttgttcacattcatataaatattaataaatctaggcgcacatatatgtctagatttattaacatatatataaatgtgaacaatgctagatttattaacatatatattataatatgaaacggaggaagtaggagttatggtgcccatcggttggcttatttagggaataaaccaaacgacatatttgcaaacgaaaaataatttgtaaataaaacttttatatatgtattcttggcgagctaaaagcaaaggctgaaaaataaatttcgataaaaaacctcaaaaccaactcaaaatttagggttaaaaatttaaattttggctgataagcataaccacaatcgaaagatgataggtgacgaataaatttttgtcacgtgagcgtcacagattatgaactgtgacgaaattttatgtttttgtgatgtaaaagaagcgtcatttatcataagatttcttgtagtgaggccacatatataggttgtaaccgtgtcattgcatgatctaccgaccacacgagagtatactgcatgcatgcagacgatgtatacgtactcgtaaaggaagtcgtttaggacaatgtttaagtcaaacattgggaatataaattatgaataactctcaagttgttaagtttgaaaatataaaaattatatgaatagatttgtcttgaaaaatacttttataaaagtatacatatatcacttttcaataaatatttttatagaaataaaaagttaaaattctgttttggagaccgtgtcgctaaccaaaacaactttttttatgagtacggagggagtacacggaggttttaattaataatgacggtggttctggtattgtacgtgcatatgcatgagatatcagagtactgtacgtactaggtgagatgggcagatcgcaattaaaggtttggtttggtttaatttggtttggccctgtatacattatactagtttctgattattggaccaccctctgcatgcatatgcagctagcagttttttgcaatgcagatcgaggcagataatatttagagatgcagccactactgtacgttactagtactactgttgcccgtgtacgtgtgcatgggcaactcgttaaaaaccctagctttatgagatgatccaagataggccggctggccatcgatcactataccaatacaggcttagagctagcagggtacaataacataatgcaggtatgataatgcatgcaggcttatagctagataactattctgagctcttgaggggatgttccctggttgtttacatatcacttaaatagttatgaaaaaattttagaagatgtattaatatgtgatatatcactccacaaatatgcaacttaaaattcaactttcacatgtcacaacaaaaaaaaagaaattaatttacagctagttaacgtatatttatagtcaaattttattttttttcgttgcgatatgtagaagttgaattttaagttgtatgtttgtggagtgatatactacatgttaatgcatcttcttatttttaaaaaaaaattataactatttgagtggcatgcaagcaacgagtgaatgttctttccagagtgtaaaatttactcccgatatactagctcactattactacgctagtggataattagattttagctatatatccatggcatgatagtcaatagatatagctagtttttttttttgagtaatagatataggcatatagctagttggctttactattagctttgctatgttcggacatgttaacttttccttgaattcgtcatattggtgtacctaccccccctgcaggtaatctgcttatgttatgctctaactagtaaaacctgctttatttagatgagggaagaatcgtactacacatttgttggaaggacggacaacgataatcaatttctctctttttcaacatggccatggaaagttttttaagagtaggtaaaatagcaaactattaaccaactataaatatattttaataagataaaaaatgagagagaagagcagcgagctacagatctgtagccagctgtagcacggactccaagacgcaatatgtgtatgatatgtgggaccatatattaatacactacaagataattgagctattgccaccaaattattacagcaaaaaataattcgtagcaatatattatactattgcaatgataatttttctgtggcaaataattattttttattgcaacgatctacaatcgttgttttatttagtacttttgttgcaatagaaaatgagatatcgccacaaaaaatcgtactattgtaaaaaaatgttctatcaccacaattttaatttttgtagcaatttatatagtacatggtacttttcactattttttgttgccacgatcaacaaattcgttgcaataaaaaaaattgttatctcataatttaacttaattttttcatatggacacggattaagacaaattttatatagaaattatagctctcgacgagatctacaattttataggtgataactttttcatttgaaatcttttagatattcaaatatatgattcaaatctcagttaactaggctcaaatggaacgatatgtattttccaacagaattgatgcgtaggtgagttggtaaaggagagcacacctgaaggacaggtcttgggttcgaatcctatctaagacacaaaatcaaaaagataagtagataaatagataggatgatagattaatatttgtacttttaatttggtacgtaaaactaatgctacatatggagtggtggcaataatttttattacaacgatgcgaagtgttgcaatatgactttttgccacatccattccgtggcaacatctaaatttattaccacaaaataaaaatcgttgcaataacctattaccacgttgtttattaccacggctagcaacgatcttacaattgtggcaacatgtatctattgccacacttttagtattgatgccacgattttttttgtggcaacaaatgatttttctagtagtgatagtatagtaaacaactattgtataacttggctattaaattggctatagatgaattggagctagtagtgggctatactattaaaattgctctaatatgatttgacagacgtttctagggctcttattcgtccgaacacttgaccctgactccacattaacgactgtccttccacccaattccccacatccttgcatcgcatctccaacccctacctccacgcatccaagggtgctacaaggctacaacacttccaacttgtttagttccaaaataattcttcaaactttcaacttttccatcacttcaaaactttcctacacacacaaacttccaactttttcgtcatatatttctaatttcaaccaaactttcaatttaaccaaactttcaattttggtgtgacctgaacacagccgtcacatcgccaccaccagagttcaaaaacaaagctgggacgtaatcccgggcgtgacgagtaaaaatccaaaatttaaccattctgatttgccatgcgtgcatcgacgtgtttttcaagctactagctactagtagtacgatatgtttaatgttcaggcacagttcgaaatctgcatggatcgatatcgatgcattccatttaacatcgtatcgtcggaccaggtctcggttcgcagtggctgaaaaagcacgaggggttgtttagatttaggggtgtaaagttttaacgtgtcacatcggatattatataggatgtcgtatggggtatttggacactaataaaaaactaattacagaatccgtcagtaaaccgcgagacgaatttattaaacctaattaatccgtcgttagcaaatgtttactgtagcaccacattgttaaatcatggagtgattaggtataaaagattcgcgtcgcaaattagccgtaatctgtgtgtttagttattttttagtctatatttaatactttatgcaggtgttgaacgtttgatgtgataggatgtaaaagtttagagtgtgatctaagcaggccatgaatcactaacgaggcaacagcggcgtgcactgtggaatcgaccaattgatcgatcgatcataggtctcggtggatgatgaatttggattggcggccggcaaatcacgcatgtagcaaaaaggaggaagcagcgaaccaaaagtcggacacaggcatgtctgagatagatacaaattaacggccggtctttgtaggcagtcaacacctaacagtaggatcgatctaaacctatagatgtaaggagacatatatactgtgtatctaacgtacagtacactgtattacaacatatataaaactaggtgatacctcgcgctttgctgcgggattcatgtatgagtatatgttaaatatgtcgaaatgatgaaagttaatgttgagaaaataatgcgaggaagatgatttgacacatatttgttgatctctgtagtataatattatagatgatgtgttatgcttacatgagatttaaaataggctagaatagtaattggtagtaagtgaagatgtggcatgcttgtataggtttttaaatgggctagaatagtaatgctagtggatgatgatacggcatgtttgcatgttgaactttagcttctaataattatcagtgggtatcaattatatagaaagtatatatactactttcgtcttattaaaaaagcaacttcagactaggaacctacgttcagattcatgtttagaaattggttctacgttcagattcatgtttagaaattggttcttttataggacgcaagaagtatattggataacctccatcatcggtataagggtcgtatggtgtcagtgcggggggtgccgtcactattcagaaccttagaaattagagaccccaaatcttaattacatgaagcagtactaagcatacttaattagtgatatggttaaaatattaaagcccagaaggtccggagtatgacccagagctaaggccctgtttaaaatttttcaccctctcatattgaatgtttggacacatgcatagaatattaaatataaacgaaaaaataacaaattatacatattacgtgtaaattgcaagacgaatattttaagccctaattgctccatgatctgacaatatggtgctggtaatgatggattaattaggcttaataaattcatcttgtagtttacaggcggattctgtaatttgttttgttattagtttacgtttaatacttcaaatgtgtatccgtatattcgatatgacacgccaaaactttacacacgtgaatctagtcacaacctaaaagtggaacttaaagagtaatacctaaagctaaatcgattaccataatcacattttacaagtttttgtgatttgccatctgcctttctacgtaaaacagtcaatctcacctacttctagtagaaacattttacagttgggccgagtttagtttcaaatattttcttgaaacttccagctttttcatcacatcaaaacttttcaacacacgtaaacttttaacttttctatcacattattctagtttcaaccaaactttcaattttagcgtgaactaaacacaccgttggtagaagtaacagtgctagcttcccttcatggcttcatacaataccgttgattcctcggacccacttaccacaaacagaactatacagaacattaattactactctgtatttactactcggcccttaattactctgcgggcctccccagctctacaatttatgggctggcccatctgtctcccagatataagatgtgccccttgcaaaaagacattgatataagatggaccaaggtgacaaaacgaaaaattgaggctcagtgaactgaaaataatctggtgaactatgtcgattcctggttacattccctggcatatttacaacatgtagtatatatactggtctagctgagagtagcagattcaggagtcaaaagaccaggctctggtgaagtaattacaagtttacaacctcctatgataggacagccgaagagtgactcaagctgctttatacgcaaatgttggtcgcgactcttgttcctcatcttccgctaccatccaatctagcttagggccctaaagcaggaaaaggaagacataagggcctctgtgcatttatacaaaccgcataaaatgcagttgaagcatccagtattagctaattatgccaatcataagtcaacgaaataggtcacaaatatgaaatagataagcattacgagataatacataacggtgtgtttaaatgcagtacatatcatttgccaaatgtcaggggatagaatgagaaatttccttttgcttgatagtatagtcatatggtaggataactttagtccattaatgaaaatgcatacctttccctgacgaatgatggtagggtagcttcccgtcatatcaaccacagtagacgggtcagcaattctagtacctccatcgacaatgaaatcaaggccctgaaaatggaatcaccaattaatgaagcgtatcacgccaatttgtgtttcagcatgacccaggaatgggtacacaactgcacatcaaagtaacgcagaatggacgctatgatagttttactagacattccaagcagttcgttacaatttttacctttttacatataattacatcaatcatatttagtaaaaaatagcttcatgtgaaaatagccagcaactgcaactaacagagtcacacccacaattgttttgtaagtcaggactttttgcttcagttactaccatacaagccagagctgcagagcagatcatagagacaacttgtataaaaagcctagtagatgataactatgaaatctacaataacgggtcagcatgtactaataacaatatcacctataattctttataagaaaacaacaaatgacactctttaaaagatcaatacagtggaaagtgtaacgccattgatacacaaaagctcttttaataagatcataatgtgcatagtttctagtgtattgatggaagtgaagatatatacctgttgctcatatatatcagcaatgataaccgggtcaagtatccattcatcctctgacagagatttgacactgtaaatacaggaaaaggagtatgactatgagtatattgtttaagaaagaaaagttgataacacgacatctcgatcattatcaattcctcattcctttcaaacgctaaagaaacctaagctccagaaattactaaaaaaaagagagcacaagaaatctccgttcgtttttaactgacaagaccaaaacagagaggtacatatgcacgatatagtattgtgaatgttcaaacatgccagcagaaaaaataaagtactttctccaaactatttgatggtattataattcagcaatataacacagcatgtcactacatagagcaggaaacaaataaagtaaataaaaaaaggtagttacagcctagaccaaccttgtgcagatcaaaggctcatcaagattttgcaatattgcttcacatatggggtcatctggaagtcggacaccaacctgcctccttttcgcgtacctagtagatgatccatgccttatgcattgtttgggcaattccttggttgcaggtaaaataaaggtgtactgcacaggattaaataaacaggtcatttgtgaagtactacaaaactatggccaagggtgaaaagaagatatgcttacaggcccaggtattacacgcttgacagcacgaaatatgttagcttgcccttggttagtgcctcgaggaaatccggttgtgtaggtatcaatgtctcgtagcgagcggcacaagatgctgagaggctgcacaattcagaactggtataaatacacagaatctacaagtaggaggaactgctcccaggttgtgttttgcttgagaataatcatcaaactcgtacaaaaacattttttacgtctttgcatatcttgcctttgaatctccaatgcctttgatcctgaacaagataacaaatcacaaatccccgttagaactgaaatgcatgcttgcttctgttattcaacatactaacagatcaaaggctcagttgtacctgcgaaggcgctcgacagagtcattgttactgagatcacagacgatggagtagctggaaaaaatgatactataggtattatttatgttcccagtgcattatgcaaaacaataagagatggaaaattcaacagcacatttatgtatctaaatatggtcaaacaaaacgcacaacgaattaggaccaatgcaagctactactatcagtcttctataagttgattttgagtggaaatcaaggcttaaatcacaacatttgcagagaaactattcagagattgctgtgtctgcccattgacgagcatgtacttgaatgggcatgccatacttaatattgagtggaaatgaaaggcttaaatgacaacatttgcagataagttattcagatattgccggcgtctgcccattgccaagccaagcatacacttaaacgggtgcaccgtgggtatcaactatcaaccgcaattctgcaaagtcgcggaacgccacctcactaaactagacagtggcagactcctagacaagcaaagcaaccagacgaacacgcggtgagactgaaagcggtgggcgtacacggtgtcggtagggatgatgccgacggcgccgcggttgatgagttcgacgacgggctccagcttccacgcgtcctcgccggatggctccacctgcacccgcagcatcccggcatcccctctctacacacgcccccacccccaccaatcaccaccaccaccacaacacaagttcagcacactggagttagccgcgacggcgacgagcagcggatagagagagagagagagagagagtaccgtgaactggcgctgggaggcgtacttgagccgcttggggttgcgcttgtggagggcgacgacggcgaaggaggcgcggtggggaggaggcaccgcggggaggcggagctgcgaggaggaggaggaggaggcggcgcggcggaaggggaggcgcgaggaggacgcggcggcggcggcggcggtcgccgtggcggtggcggtggccatcggagagggtcggggttgggttgggttgtcgccgagtgggggaatccgccgcggtttatgccgttctcgtgatcgaatccacgggcggcgcgtgcgttgggccttgggccgcacaaggcttcactcagcccacgtatttttctcgtgggctctacggtgaagtccacgtattttaggaaggaatgaactatggaagaattttgtagaaagcttataggaattgtcagcatgaaaaaaattccaatggaaacctaattgtattttaggaattactgttcgagatgaacgtttcaaatctacaattttaaagaaaaaaattgcaaaaaaaaaacaccccaaatgtcatcccgagttgagtttaaggttatctccttgttgcatatactctttagaattcacattgatttgggattcctgctattgtttggtgttttttccctcttcatgcatactagtatgttgtattacctagcatattccttaatagaaatggccttaaacatatttatttcttagcaataccaatacttatattgaatctaacaaaaaaaacctaacaaatgtcgaaccctgcgaaacaaacgcaacaactcatctcttcgtcgcttcgatgtgtaagagtggagactcatgatcaccgtcgttcattgacgtgctgaacattatgacttttatgagtaggcatgcatctgcaacggcaatatcatcagccctgtctgatatgaatggcgaccacatctccttactcgtgagcgtatgtgggatttgcagctatgatgatgagctaagcatataggtaattgggtgaaaaagaagaaatagaaaaaacatagcatataaaaatgtacaacaaagaattacaaaagcacaggacaaccgttggaatgaccatttgattgggtcgcagaaaaaacattgaaatttgaggagagataaagaattaaaaaaaaatcttttcatgagattatacctcatgttaaatttcctctaaaatttgtatggaaagatacattccgaatttttatagggttcgtctctctttgattcaaaggactactagtctatcaaacaaaaaggcaaaggccctcttcgtttttgaattaaaatggcatatttttcaaactgctaaacggtatatttcgtgcgaaaactttctatatgaaagttattctaaaatataagattaatctatttttcaagtttgtaataattaaaactcaattaatcacatgttattaccatatcattttacgtgaaacacttaatcttcatcttcaggagattcaaacatcaccaaactctacctacgagttcgtagttaggattaaattttttttgggatggatagggtatgtaggaaaatttcatatagaaatgaaatcctctaaaattcatatgaatttcatttgaataaaggagcccgaattaggagagaacatttgtaacaaacggtcatataagagaaaataaactcagggttttttatgatttccccaaatttttgtaacgagattcgataaatttcgaaaaaaaatgtgtcgagccgcggctaggtgaaaattcgcatacatttcacattgccttacgaacacaaacaaaccctcccggcttgtttggcaacttgagagaagaggattgggaatttacacgagggaattgatggtgagattaagatgagaatttaattttttattacagtctcttgtttggtagaggtggtggaaattgatagggagtttagttgaagattagatcattaatgaaaacggatggctgagatttgtttagcgaagtaaatgagaaattccctcccaattacctgcccctacccagatattgaaaaagagggagttcatttctcaattccccatctctatcaaaaaaaatcctatatcctataaccaaacaaaatggttaatatagcatcatcctctgaaactcccaatccctcgtaaaaccccctccaaccgtcccaaaaccacaccaaaccacgccacgcccccctcctccgactctccggccaccgcccgccgccggccgccctagccggcgcaaatgccggagccgcaggccatcctcccgctccgcgcgctcccgccggacgcgccgctcccgcccccgctcccggcgccgttccactccccgtccacccccgccgccgccaccgccaccgccaccgccacgcccgccaccgccacagccacgccggccacgccccccaacccgcccgctccccccgccgcgccgccgcccaccttctcctcctcgcggcccccgcacccatgggagatcgccgcgcgcgcctggctcgagtccttccccgacggccgcccgcccaccgaggccgaggtcgacgcctacatcgacgtccaccgccccgagctcccctccctcccccgctcccagctccaccagcgcctcctcgccctccgcggcgaccaggtaacccccttctcctcgtgttacccacgggagattcgcacattgcttacgggattatcaggtgtatccatcgattttaagtcaaattggatcgattagcttgggcacttaaccataatggagattctggtagcgtctgggttgagcaattttttgtatcagtcaagtggagtctgtttgtgaatgttcagttgcttgattgctactagtcatggaacaggtctgtcaagtattaatgtatgttatcatgctagaaaggctgatggacttcagccctttgaaatggatctgttcagtgttgatatggctgatttgcctttctgaattgcagaatagctgaactgggacagattggaactgttagagctaattaaacatttgaactctttgcctctttggttaacgatgtttgtgagcttcctagggtttctatcatgtagaactgctgttcgccaggcctgttggatttagctgtttaccagatttttccaattgatcactgattcagactgacattttattttcacctatgcgtaggttttagatgcagaccaaagtgctttcccgtataggttccagcggactgatctttggaagcctgtgtacaagtggttggaatctcttgagctagagtcgctagttacatcaaaggagatatcggagtggcttacatcaaacccacagataatggacaggttggttgagaagcattcaaaatatcatttgatacactacacccagaggatgcacttgaagcttctgaagaagagggggaagataccgaaggtacataatttctgatccactttgatggggtagtgcaaaaaaatgttatattttcgctctatttcctaaaggtgttgctaagcaaaggataaaatatttatgattttttcataaaggcctatcaaaagttaattatattttctagtagttggtatcttcttattgctgaatgttctacccatatttagcacccgagtattcttccttttttcattttatctctgtttctattattattagcttacgatagcaattggaaagaacttatggcacaccgatatgcaatatagttatatggctgtaatgatacagtagtttccctaaagcaccaatttggcagttcagatgtatgtgtgtgtgtatttaaaagaaggaagttgataatgatgggtaagagttaagtgcagtcgataccgcacatgtaagattaaacattagtctgtaagtaggaaaaactgttccaatgttccatagagcataggcacttccaaaccataacattatgcacctcaaagaaatagatatgtgcagtagtttgtgtctttggtgagggtggtggcagactggtggcttaagaatggtaattacagttagacactgggcctcaattagcgagattttatgtctattgtaccatatatttatatgctatttctacatacaaagatctggttatattgaggtgttgttatgtcactttggcggagcatttgtctatcatactaaggctgagttctttcccaaactttcccaattcacctccctcgttttccgcacgcacgcttttcaaactgctaaacggtgtgttttttgcaaaaattttctatacgaaagttgctttaaaaaatcatattattccactttttttaaaaaaaatagtaaataaattaatcataagaaaatgcgtcgctccgttttatgtgcgcccaacctcacctcccgaacacagcctaaagaatccagtctcctccaaaggagcacctattattattttacaatgaaggagcactaggtttttttttttcaattggattacttcagggctcaggcagttgcttttcaaggaattatttgaagtaattgtatctcatgtagcaatttgatgccagtttattgcatagactcatgcacactatattgcaatcatttttctattttcacaagtgtctcttttaaatatatcttgctacaccgttggttccttgcaaataattattttgtccttgctcttacaattcttgaattggcatctttgttgtcccttttctaagatgctaactttacatt

SEQ ID NO: 17934 - DNA, 930 bp, Oryza sativa
tctacaactttctgcggctagagccacggtcccagcgagtgcttctccagttaccccacaagaaagcacaccaactgtgaggaaatctctacctccagtgacaggttatcctttcaatgattttgcatttgtttcttgaagtgacgttttctcatggtcttctaaataatacagcatcctatttgttttccaggtgttagtgcaagcagatttgtgggcggcgatgctcctataagggacaagaagatgtcactatccaaaaaaaaggaagctttccttaaatatgaactgtacgtcactcttagcttagctaaccctgggttatacctctgtttggtttttttaattgcttgcactaaaatattaatagtcgtgtttcagtttgacagacttgcagaatcagttgaccagtgtgttgttaaagaatcgccgcactgttgctattaaagaaacagattttcagaagccagagactaatgtaagtatgcaagaaggggctgctactgcaagcacatcaacccctacagaggtgacgaagatttattgcaacgaacagccaaaccaaggagcagcagacaatgaatttggccagaagagaaaaaggaaccctataattgtaacacctgcttggtgttatagtgaagctacaacaggtttgtcctttcgcttggtggaaagattaatcatctgttgttctatttgatacaagctgagaagtactacgtcctattggtccaacacattttctgtgaaagtttgatttgttattttgtgactatgctttcatatgtcctactggcatactgggatgcacctaggaattctggtgtgttgccattttcttttcacatgttcatccatggctacataaattgtattgaagctctgcattttcatcagctatatgattgcaatattttatatttgttg

SEQ ID NO: 17935 - DNA, 293 bp, Oryza sativa
atagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatt

SEQ ID NO: 17936 - DNA, 5137 bp, Oryza sativa
agcatatagtggagatttggtgctatgctgctatcagatacaaaatctatgaattgtatatttcatgagggcacctatgtatacaaatgttgacatatgaaaatggttagcatatggaggtatgtatatgcagctagaacctacaaggtcctgagaagtaggggccgtgtagagcgcacaatcactccgatgttctactgattcaaaggaaataattgaaaaacaaaatcttacccataaatgtttgaggttgaattgattatcataaaaagaattaggtcaaacattatgatacattctaagggggaggatccatgtgtataagctgggcctggaagtttgagacatgaaggccttactctggttgcggctcgtcgttttgaatttgtcatgccaaataccggtcatgaatatttgacatttagaacaatattcaatcaaacctttaaaaatccggccatcaatgttatattaaaataagtttataaaaaccaataagtttcaaagtatttgaggcaaatctaggcataccttttttttattaaaaaaactaagcattagagaaattataatcaaagtttttaattttgaccaaatctaacaccgaacatcaaatgtttgtgataaaagagagtaataaacaagtactgtgagccttgttttctccaagaagattcaagcctcatttggttgaaaggattttttttaaagtacataaatatgcaatcctttggaattgacactataccacagtgaatccaaaggaatccaccaaaaggaaaactacagtaaaacttgctatcccttcaccaaaacagaggaaaaaagaatccactcaattacaatcttttcgatcctttggcttggctcacgcaggaacgacataaaagattcctatgtttcacagtgcttattgtaatttgtaacaactctatctaaatctcattacatgaggctcctcttcgtcgccggccctgcgaaaaaacaagcaaaataaaatctcttaggcctattcggttcacgggatttcccaatcacaagaataggaaaaacatagaaataatgtaggaatgcacgtgcaaaaaaaatgattggaacatattaattttttctacactgagctaaacgagaggatggagtggatgtttttattcatatggaattagtacattttggagaattggcatagctttcctatgaaaatcttcttttgaatcctatgaaccgaatgtataaataatgtttattgcaaaagaattaatatttcctttagaaatacttctcctggttttctgctccagaacgaacaattgaggcctcccatcggatggcctaaacagtcaaagaaaaagccaaattttagattttcaaacttaattttgagatattttcaatggagtttcttttacagcattagcttttaagtcacaagaacacatatatataaattttaccaataaatttatttttattccttaataagccgttttgtcttatcagtaaaaaagccaaacgatgtggcctgagcaaaacacaacagcacaaaggatttggagagggcccacatgtcatggacctgaaaaaatgttaggtcagcaagtgacagccgtcacccagcctcgcaattgccggccgagtcgatcaccacacaaccaaaaaaactccggcccacttggagttggagcccgtggcaaatccatccatccatcgcctctgcctcgcctccaccaccgagatgccggggctcaccgcgccggcgagctactccgacgagccgcctcgccaccccgccctcaagatcaactccaaggttcgtccgttcgctccgccctcccaccggcctatcgctgttcctgaatgaaatctgtcgtcgttcaacctgcgtgggttggtggggtttgctcggggttgggggcctgcatcctgcatgcgtcgtcgttcgccaccttggagggccggacgattcccgccgtcgggttcgtccacccacgccgctggatcgccggaatcgcgggcggtctccgtttatgctgtacacagtgcccatgttcagagacgcaacgcgttgcgtagtgaagtgcggggatgtgtagggtagtttggcttgtcattgctcgcttgctcggtggagaaatggatctccgattctccgtttcccggcttgagcgaaagcaggtgggttttaggattagccgattttgcgatgttgttctgtttgttcacgatacaattcactcgggtgtgctgtgctacaaggctgctctgcgggccttctgtcgtgtagattagcttcagctgttcatggattgttttgcaagacatagaaatggggcatttcgttctgtttaatcggttcactctccgagaggatccccttctgaatatacctttgacaaggaactggatcctaaatattgaagtaaacaagtctctgattttttttctacatatttcgtaataacttggatgaacattgctatcgcatttgtcgattccttattggaacacgctcggatacttttgcgcttgtccttggtcagcagtattgcagacaacagactgattcttaaaagaaaagataagaaagagacaagctatatttatcttcattataatcttccttctaagtcagaactttattcaaattgtgatgttgttccatgctataaagttattatgtaaccagccaatcgagaacaactcttacattgttgattaggattgtacattaggataaatatgtgagggaaagaataacccaatttgcttttctatatggtctgtcactatcatagtatacaagtgcacggtatatatataaagttagcaagtcttactttactacaactgttggcaggaaccatttaatgctgagcctcatcgatcagcattagtttcatcttatattaccccggtggatttcttctacaagagaaaccatggaccgataccaattgtggatgacctctcaaggttgtcagcatgaactataagttgccatttatcattatgttttgtaacaaaccttacctttttcagtttgactgaatcaacagatacagtgtttccattactggtattgtcaacaagaatgtgcagctgtccatggctgacattaggtaagtacttcattttatgttttgttatgactaaacaaaatattgttttgagaattgatgcaaactttcacatgcaggagtctcccaaagtatgatgtaactgcaacgttacaggtttgccacaaatccctctccccaaatctttatctgatggataatattgacattgttagtaacataacgatacaacatcgaatttgtagtgtgcaggcaacaggaggactgcaatgagtaaggtacggaaagtgagaggcgttgggtgggacatatctgctcttggaaatggtaagaaatacaccatgtttatagtatgtactgaagagtgttgtcttcaaggttttagaaatgcaatctgatgtactgtgttactgaatactactcgtcactaatgtccagaagataatgcactttgtgggatctaggcatgctatcactacacaactacattctgatagcaggaattatagagataattattatcgtatgattggagggatttgcaaggattatctcttgttagctaggcctagaattgtttctttttcatgctatataactttaccgaccataataagtcatttctttttaccttttgtttttcctatattaacagtaccctgctcagtgattgttatatcatgcataaattactgatacgggactgttttgtcctcctagatttatctgtatgaaatggacacaattttatatagttgtaataatcgtactatgttttcttctttcatattgttcccagcaacatggggaggagcaaagctatctgatgtccttgaactagttggaatacctaaactcagctcagtcacatctttaggaggcaagcatgttgagtttgtcagtgttgacaggtgcaaagtgagtatgtaagtccttatctacccgcagaagttcttttagcctaccgaactaatctcaagccatttgtttctaggaagaaaaaggtggtccctataaggcatcaattccactaaagcaggcaacagatcctgaagctgatgtgttacttgcatacgaaatgaacggagaggtgaaagaacattgtttttttttcttttagtatgaaaattgataactttccctatgcggtttagaatttctcaaaatgtttgactttgcaaatgcttatgtttatttctccggtctccctttttgagtttgtgctattaatccattataatattatctagcacactattttattcaaaattacatatgctgagatataaccatttctttattttagatgtgattaaatataatataatattttctgtactgacgctgcactgtagtaaacatgctacattcatatagttgtttcttcctaaagcagaatggttagcacaagcagcacctgaaatattgattactactaagtatcaatatccactagtagccctttttttttacgctgacccagtctatggcaacttaatgtggtagtgattgtcaattactggtgcacacagtgcactagacgtggaaaaaaatgttgggcagagacactctgctcggaatctgggattctggatgcatgtatgttcttttgtgaactttgctgttgctggctttctaatgtggcgctatgatgtgtacagaccctaaaccgtgatcatggatacccacttcgtgttgttgtacctggagtaattggcgcacgctctgtaaaatggcttgacagtatcaacataattgaagaagaatgccaggtttactgaaaaattcagctcagtacctcatcattattttaagagtcgacactgattactgtgatcgatcagggtttttttgtgcaaaaagattacaagatgtttccaccctccgtagactgggacaatattaattggtcaactaggaggccacaaatggatttccctgtgcaggtatattatatattgtcatttttccttgcactaatcttttaccacaagaagctatcaatatttaaaacttctcctgccttttattttgcctcttttaatgaagtgataagttag

SEQ ID NO: 17937 - DNA, 3518 bp, Oryza sativa
aattctgatgaaaatgcatcttgtgtgaaacaggtggactcagcagcaaatgttcaacctgaaaaggtggaagacgtatggaacctgagaggaatcctcaacacatcttggcatcggatcaaaatacagaattcttcgtgcgtgggaagatccaaaatgtgaaataagtaaactgcttggaatcagaagtcaagagtttatagtgcccggaataataagttattgcagcattcgatgattctcgcagactgtgctcctgtactatagtactatgttggaatcgtgttgctggcctgggcttatatgagacgaaacacaatttttgggagtgatgttaagaagatgattaatacgtactccagtatttatgttgtcttctaatggaaaatttgcagttcttgtgctccatatgataaaagaaaaaactcagtaaattcagttgcaaagatgtgacaagacattaacattccccgcatatgtggaaatgtaaggatttcagcatgcgttgacactgatacttccaatggatttcaatttacagatgaatcacctactaacttcttctacaaggaaagcttctaaacctacatttgctccttagggtaaatggatgcagtgaccaaagcctagatcaaactgcccaaggggaaaaatatctatcacaagacgcagagagacacgggatgttatctggtacagtttttctgctgcaaaatgtccctggagctaaagctaaaatgacaaaaacagcattttccattttcctaagtgcatcctgcagtctcttcatgtccattggtattgccctgcaaaagtatgaaagtaacattcagatgcaagaatgtagtgaaaatttgttattgcagaagggattggccaactcacagtgttggacgcttggcccttggttgagtacatatcctcgagcattttgtctaaagtatccttggttaactgagcttcagttctttttccacaactgatgatttcccaccattctgaatctgcagaaaagacaattatttacagtatcaggtcatccatccaagtaatctgattgaacttctgataaacgagtaatctgattgtagaaatgttaggagcgtagtcagtgagactctaccatgaagttttaagcaaaattacaagataatgacaaatatatatagattacaagataatgacacaaatatatatcttggacaacaagtgtttcaagcatacctctgtagcaccagcagctggctgctctgttgtatcttggttttgatttgaagggcattcggttgtttctggccgtgatgcagatgcctacgaaacaactaattgcgttaaaaaaaaaagaagcaaatccttatgtcaatggtgaccaacaagcacattcttatcatcacactaactcacaaactatgaacatgtcaaccattgcctaattggagcttaggctccgattcaacactgcacaccaggtactcttagaacagaagatgaaacaaatatctcttgaattaatcccagaagcaaaatgatcagtgagctagaacttgctggtttttatcttgaattatctccgaaggtcaaaacaagaaccaaaatccatgtatcaatagtgaccagtgaccacattttatcttgacaccaatgcacaaactatgaacatgccaaccacagaaacattagcttgggacaattatctcttgagctaatcacataagcaaaatgaaatgaccagtgagctagaactttgcctgattttacctgatccttggcaacatcctcttgccactccggctgaaacttctgaagaagcaaggtgagcagcctctgcagctcgggcgacacctcctcggggaaaagcttggcgacttcgtccttcccgatgttcccatggacgcatctgcgaatcagtaccctgaggcaaaccagcaactgcgagagagagatgggatcagctacaagcgagcgcggggacgggaggagaggtggtggagatgatgagtagccggcggcggatacggacggggtcgaggtcggcgtcggaggcgaggtggagcatgtcgcggacgacggcgcggtcggcggcgtcgaggccggtgcggcgggtgcgccagagcgcctgcaggatgtactccaccgactccttggaggacgcgcgcgccaggagcgggaggtgcttgtgcccccacagcgccgccgccgccgccgccgacgccgacgcctccatcaccggccggaatctagccgccggcgacgcctgggggaggaggaggattaagagggcgttttagttggtgggccgcaagcaaatatgggccgtttgttgtgggctcgtaaattcggcccgagagagggagtagctaagcccacggtctatcagcagattattgaagactaagcaaagtccacttagcatccccatgtagcggctgagttccattcacatcccaatactacaaaaccgcttattgggcatcctcaactgttaaaaccaaaccagagcatccacgccacgtgttgttttggttttcgtcctatgtggtgtgaatactcacacacaccctatacttaaaccaaagggactaccgctccatattttttcactaaattctcacatatataaatacagtacaaacacattaaatcttaaaatatgtcagtccagtctctcaaaagatgctggtatttataactttatatttcttctgtggtaggtgatatatccgtcgacgtgttgttcgtaatgacttcgttaattttaagatatgtaatatacttataaggtgttcattcgtaggggtgagtgtttacgcgtgtaatgagagtcaaattttcttaatgtgttccgcaaataaacaaatagtttcatatcctcacaaaaaggtaaaagttttcataatacaagtgggacatggatcagcacggtaaacgatcgactcggccggatccgaattatccagaaaaacatatgcacgtaatcatgcatcatgcacttcacatttttcacaacacacacaacgtactatactatcgagtcagggccggcaagacaaccaagatggtgtttggaaaggagggacaaaactcagagggaattatattttttttagagaggggcttccagactcctccaaatccaggtgatttgtaattgacagatgaatgattaacgacgacaggagctagcaaaaagcctaaactaaggcaggcgtgatctgcaccatcgattaattaaactacacaaaaaggagcgcccaaacctgcagtgatccaaatcagtctatagcactaaactatactccactccagtataataggagtaatagatagataataggagtcatacaaaactcaacttgctgcaataattgaggagttcagtacataaggataatatataaaaagtacaataatcgagagaatcaaactattttgtacctatgcgcgaggaacgacttgataatcttctctcttgccagcttcctcttctcaacccctatgcaaaaggataatcgaaagtt

SEQ ID NO: 17938 - DNA, 25300 bp, Oryza sativa
tacagtagttcatcaaaaaaagatatatttgccctctctgagttgttaggcatgccctatacttagaagggtaaatacgtcttttttccttaagaattaacggtcaacacacggtcaactgacgggagtgacatgagagggtgtgcaaatttggatcaatggcatataagggaagagccaattttcaatggcatataagggatcagactaattttcagtggtatataagggattctctccttgttaatacatacattttatcattgtatgttattaatcactaatgtatataaactagtgaactgtctcgcacaattttgtgtgaagctaaatttataaacatgattagttttatattaaactcttgggacaattcttacttattttcccatagttatgattatattccatatacaaccatatcaatcaaatctaaatattataatttagactcaccagaagcaaatggtgtgaactttttttatctacgattaatgtggtaacaggtttctagtcgttcaaatcaattaatgtcatttatacaattatacatgtaacacataatatcttgcatatactagctagtgatgtaagcttttgagattatttgatgacttatatatatatattactgtctgcatccacaaatataaacatgcatttagacacggtttctaatatactactttgactaataatgtttataaagataaattattttaaatagaaaagttgcatatgataataatttatttcacaataaatctaataatatcattcttatattgtcaacctttatgatctttttgccattggtagttaagactaaaaatgtttaacttgacattattttaaaaatatttatatttatgaatgaaggacatacatataaaatgattatgagcagggccggccctgaggcagtgcgggcggtacgaccacactgggcctccaaaaattaggggcctccaaaatatgtatactatgttaccaagtctgatatgctattttctgcattgagaagatgctactagatgagattgttattaacagtatcattactgattttgcatctagaactgttagaaaaaaatgttttaaatgatctagagatatttctttttggtattttaaacttattagtgtgaaattcgttaataacaatgagtttttaaatattatcttgtatttttatggtgaatggggccttcattttttttccgcactaggccaccaaaaagtcagagccggccctgattatgagtgtatgtttttaataaaaatttagcgtggttcacgagtttattattaggtacgacttctaagtgtatggtaaagtgtcccactcgtgatgatgtgagtacttatgattgtttctgtgatgtagacgacgtcttcatacgttatgggccggggcgtagggagtagtataagccaacacaacaaatgatgagagatacagttaaccgtgatctgtcctacagatccaacacatacgatctgccgtacatgctgacaagaacttttttcttaaaaaaaagaagaaacttcttttttttttttgctgtgtttagtttcacgccaaaattagaagtttgatgaaattagaactatgtgacgaaaaagttgaaagtttgtgtgtgtaggaaaattcgatgtgacggaaaagttggaatctaatcagggcctttgtggactactagtatttgaactgtaggggttgttgcatttaaagtgcaaaacgacgggcacccgatcgtgcccccatcccgtaaattaacacaccacgacgaaatctacttcatctgtctaagtatttttaatatagtatcaagtcaaacatttttaaatttgactattaatactccctccattttaaaatataaggcacaaccacccttgattcaaagactaagaaacaattattatcacctctgtgttttaatcatctcaactaacacaatacatgcacccaataaaattaagggaaaatttgaaccatgccacacaaattttgtaaaatttgtgatatgccaccctgacccacatgtcattgactcatgtgggtcctacgtgtcattgaaatacgtgtggcatatcttaaattttacaaaattagggtggcatggttccaacaaaccctaaaattaaacatgagtaaattgcgctcatggtatataaacttgcgtggtgggtgtaaataagtacaacaatttacaaattgctcatttcgatacaacaacttgccaagtccgtgcgaacctgggccaaaacgatctctgcaagcaaaattaatctaatatggtacatattgacgagtaaattttattacacatcaaaatttggaatgataaaatgtgtaatcactattcacttgatatttttaatatttagattgatgaaagtgaaataattatcagtgtccaaccatggaaataaacttttaaaataagttttcggtgaaatggagtgtctgacaatgaaaaataaaataaattttctaggaggctaacgcatggacgaaattttcatggtcccgacattatacgagttatacagaggataattttttccaagacatgaaataaattctattctatgcatcaaaaataaaatttatctttttctttgcattctaaataagatatccaaaacatgtcatacatgtaagctgttatgccatctgtttgtgatgttttacaacgatttggtttgcattgacaattttggcccaatttgcacggactagtcaagttactacattaggatgaacaatttataagttgatgtacctatttgcacccaccacacaagttcatgtaccacgacgcaatttactctttaaacattttgtgagtttaggatttaaaaaaataataatttaggagagaggaagtgctattaattgtcatgcatgcatgtatgccttatattatgaaacaccttttaaaagtagttgtaccctatattttggaatagatggagtaataaaaaatgaaaaaaatcaatcatgttaaattaatgttactagatttatcattaagcaaactatcataatatgtagctctttttatttacatcttagttttatagatattgttggtcaaagtagcatctcgaagactgtgtcaaatccaaaaatgcttatattttgggatggagggagtatataatgttctgcattccgcgttgcttaaaaaaaaggtccggtggtcactcgtcgtctacctggcgatggcgaatccaggtacaatggttgtcaatagtggtgtcttagcattgctaattaggaatacttgttgacatggaagaaagagaaaaaggagagataaaatatcgtcgttatgcataacaacagcttaacaacgactcttaatcactataatatggaatatggttgcatgagggtaagaaaaatggaaagaatgttaacaagagaaatattttttgagttaatggttagaacctttgtcgtctcaacaattgtaaagacacggtctctaaataatcttgtattgtttaagaaactatattaatatctaccattgaacatgccctaagagttaaatattactaggggattccccgcgctttgctgtgggaattactaagtaatttttaatattattttttgttacaattcagctaggagtaaaaagaaaaaataatcaaatctcagggcttatcaatatttatcatgaaacaaatgaaattcacactttaatgtataacacgttgataagtatatattcaatattataaaaatgatagagagattcataaaattgttgtggaaatgatgtgagaggtggtgattgaatatgcttgcatgttaatttgtagaattaaatagattgttgatgctcttgcgtgtttgtatgaggttgaatatgtaattattgttagtgggtgatgatgtggcatggttgcatgttaagttttagagttagtggattataacgttatagaaagtatagattcctagctactccccacttaatagatcctgcctatgccacatatggatctgcgtttgttcaggagccataacaaattgacaagttgagacgactgaagagaccccaaatacaaataatcccaaaaagaggtgacaatcaatgtccaaattaagcaggtaacgtgctctacgccgacgattaagtataactactagtagaaaattggcgagccatttgacacgtctttagttagcctgttcgtgtaaccgaagaaaattaaatatttttttaacccttagtagataattataaatcaattgcttttgtcaatattatttagggcatgacagaaatttgagaacatgcaaaggcatgaatcagcttatagagcatacaaccatctgtgcaaattgcaaaagactgtcattatattttgatttcgatattgatttgtgattaaatttcgtttgtattgtcatttgattttcttttttcattatatattctactagcatttttttaacggcatatcttttcagttggttcagttatctaccgcgccaatatttgataatgccaaagctcatagagcacaacatcatatgtctaaattatatataaaaaatatttttttctatattgatttgtgatttaatttcttttatatggtcatttgattttttttcttcgttgagtagccctttttttaccaataaatatttttcgttggttcaattaactatcctattgtaatgctacaatttcgagggaaataaaaatcacgtgatgttctctttgatgccaaaaatggatttgtgactggtaatctagcacagtgggaggcctcttgagtctacactagacattaccgcgcgcgttgcgcgccctatcagctggctaaagaatcacaaacaaaaagctcttggaaccatcatattgttaacctcaattcacaccatttccatttattcatgggcataaccattatacttgtaacaaaaataatgtgtgcctcaagctaataggttttacaggtgtcataaagggcacactgaaaagacagaaaatgagcattagcaagcactgttgtcttattacaaatggggatttaatttacagttcatatcgaccatagggcctcagacagagcagagcttttcaagaatcatgttctcgtcgccgtcgacaatcttcagagcactcctcacgatgtcttcagggaagcccatttaaagttttaaaccaacttatgcacatgtggtcacagtcacagataagttgtactccgtatatccaatggaataacaaatactccgtataactcggtaacaatacattttcttccataccgacggaggtactctgcaaaggcctctatccagtagcagaaaatatggaatagtcacgcaggtactgcaaaaatggattaaaacaaacattaagagcagaacacaacctcaacactgattccttaaaacttgttaattagttttgaccatgtctcgaggttaggaatttctgattctgaatttatgactggaatttctgaattttttattctgaatttcttatactctgcatcgctttagtcacggtacagaactcaacgatttactcaccggggcccattaattatacagccaagataaggtgtagttcagattccgaactctggacctagattgaataaccaagtgactttaccaatataaaggtacactaaaacctaagttggctctctctgacccaataccttcaagaagaaatgaaaaaagaaaaggaaaaaaaaggcaatggaaatataaaacatgtagagtatagcatgcgcaaacacatctctaaattctagtatcatcaatggtccttacccagctccaagtgccatcattggtccacactgtagctctagccatcatgttttcatctctaccttttcccagcaatttgagaagctatgaaacaaacagctagagctgcaaaatttctccattacaaagcttaccagagccctgaccaattttatatcttcaatctcacctgcaagagcaccaaccagttttcagtcttcagtctccattcactgagcatgaaggaaagcatggagataatgactacatgaatacaccatgatggatcctctatcatgcaacaaatgaccagatccagtgtggtcatcagaagaatggaacaacgtcgataagacttcttgaaccagatacactgctagccattgcagccacaaaccgtaagaggcagggtaaagaaaaaagtgcattcttctgagaccaaactgcctcttactcccttcttttccccttcctcttacaagtcaaattaaatgttcacatgatagaaaagaaaaaaaaaaggagtactttgccagcacaaagtgcattcttttaggccttagccaaaagtcaagtgagcagccagctatatatgcaaagtagcaaattagtgacaaatcaacggaaacaaatcttaaaccaaagaaacaaatgtaactgcatccaccaacatatcctccattgtcattcatcgtgctgaaaagaatttcattaggatcaaaatctattcgaatcttgttggttggtttgtgctctcatcaattgggtttgtaaagtagttaaacaatgttgttttcttctctcttgcaagtttatcagtaaataaaaaactattaaatagaaggctctgtttctcattcaaaagataaatagattagagtccagagtctacctaaatgctacagagaaatagggaatactcacttattagtgccattagctgattagaaatagcatgtgagcacttgagtagagtagcagtagcagaccaggacgcgaccatgcgcccgtgcactgggctgttgctagctgctgctgcgcccgcacgctgcgcgtcgacgctgcctccgcgcgtccgcaccggcgacctgctgccttgcgcatgctgcgactgcgccagctgctgcaccgccgctgcgcacccgcgtccggcctgctgcaagccaccactccaagccaaaccctagccaccgccagatctgaaggtggtgcatcctcgggtcggggcagcgacgctgcgacggagtgggagaggggcgatgagacagcaggaagcagaggatggcgtgttgtggtgtgggagagatcatcgccgacgaggagaagcaagccaggtggagggaaagaccgggcggcggctgtcgcccgtcgcaaggaaagaggagagagcgagagaaggagaggggaaaggtagggaacagtggcagctagggcttcgggtggggtggggtgggtagggattttctttttttcagaaaaacccctcacttttcgtttatcagagcgcagccctattttcccattttttccttcttcgtataagatatagtaggttgtggagggcttttacataagaatacagaacatagaaacatatagtgagggacctattataaattatatataaaaccaaggtcttttttgaaaattgccagctcgaaaaacccctccgccttccagcgcgcggggcgacgtggatagcacggcgatcgaacacgcgactccaaaatcgttgtgggaggtacaattgggggcaggttgcaaaattataatggcatggttttaaattaccctttaatataaccgatgtggtgcttaaatcttcttatgttttttttattttagaaatggatccttggtttgctatccatctgtacattttttttgttttaaaattaaatgatataattttcatgtgttgatacaacaaatctacttctacatgttataaaacagagattagatcttttacttagaacttgtatttcttaggaaggttatagcccaaccatccgtttcagatactatcggattgggtcgtcacctccctactcaacgtgtatggcatgacccagctgcctcttgcaagagggaaccaaatttgtgaatcccatgtgccggggttaaccattcgacaattggcccggagctctcaaatcacaggagctttctaagagagattctggtagatatcttattgacacgacataattgacacgtgaaaaatatttggagttgttcagctaaattatcaggttgccacgtggcccaataacatgctagaattataatcctgaaatcggtataaagatttaggtcatgcttagttcccacgcaaaaacttttcatcctatcacatcaaatatttggatacatacatggagtattaaatatagataaaaaaactaattacacagattatatgtaaattgcgagacgaattttttaagcctaattgtgccatgatttgataatgtggtgctaagtaaacatttactaatgatggattaattatacttaataaattcgtataacagtttacatacggaatctataatttattttgttattagtctacgtttaatactttaaatgtgtatacctgtatccaatgtcagaaaacacctcgtttttcgcatgcacgcttcccaaactactaaacggtacgttttttgtaaaaaataatttttataggaaagttgctttaaaaaatcatattaatccatttttaaaatagttagtactcaattaatcatacgctaatggttaatctcgttttacgtatcttctcaatcacctcttcaaactcaccgtgtagtccacggtgtgtaacgtgctcccctgacatgcacatatgttgaggggggacgtgtgacactgacgtgcgggtccacaggagtgggccccacctgtgctgcttcctacagtgcgtgtataagatgatcactccggccatggccatggcgaatcatccatccattcctgcttcttggggacgcaggcgaggtggttagattgcattagctagctgtagaaagctagcccatgggtagtaggaagagaggaggaggagccgtggcaatggcggtggcgatgctgctggcggcggcggcggcggcggcgagcgcgtcgcagccgtcgtcgttggaagggttccagccgctgtcgaagatcgccgtccacaaggccaccgtcgacctccacggctccgcgttcgtcagcgccacgccggcgttgctcggcgaccaggtacacgcccgccaccgccgccgccgccatggtcggtttcagagagagatcatgaaaaaatacttgttttaattggagacctgaagatccggggagcaaagaatctggcgaaattcttgcactcacagcacacagactatattaagctgattaatccaaatcaactaactgaagtactaccaagaagtgaaaataatatctgaattgtgcgactgttggttgattcgccttcgccaggtagacgacgaatgaccaccgaacattttttagcggagcagaatgcataacagcatagatttcgtcgtggtatgttaattcacgcgatggggcacgtcgtttcgcattttaaatgcaacaaattaaacccttaccgttcaaatagtatttattatcctagtagtgcacaaaaaatagtttctttttttttcttaagaaaaaaagttattgtcagcatgtacggcagattgtatgctgtatatgtagtacagatcagctaaccgtatctctcatcatttaacaacgacaagagctagcaagaagcataaagcagtacgccctccctccaaataagtactacagttttgcactattcaattcatatccaacatttaactattcgttttatttaaaaaaaattatgattaatatttttattagataaaaaagcatgaacaatattttatgtgtgactgatttttttaattttatcatacttttattaaataagacggatagtgaaacgttggacacagatactcacgactgcacttattttcggacggaggcaggcctgatttagttcccaaatttttttcccaaatacatcacatcgaatctttcgacacatgcatggagcattaaatatagattaaaaaaactaattgcacagttagggaggaaatcacgagacgaatcttttgagcctaattagtccatgattagccacaagtgctacagtaacccacatgtgctaatgacagattacttagactcaaaagattcgtctcgcagttttcaggcaagttatgaaattagttttttattcgtatccgaaaactccttccgacatccgatcaaacattgatgcgacacttaaaaaaattttatttcgcgaactaaataggcctgtactaccaacaaaggcaggcgtgatctgtaccttcgattaattaaactacacaaaaaagagcgcccaaacctccgtttttttgacaaattggtccttatagaaaacttatttcgaaactagtccataccaaaaactatatctagaaataggccgtcggctcagcgccaacctctttggcgctgaggttgttcatatcagcgccaatgggactggcgctgacatcgcgccagcgtggcgggcgagacgcgacgtggcagggcctcagcgccaatgtatttggcgctgaccccttgtacaggctaattaaaaggatgcgcggccattaataagcaatgcacttgtggtacaatggtatgaccatttgcttgtgtaccctagcaccatggttcgactccctatcacggcagccttgtttgttctttttttttcttcaaatcttcaatctacgtgcgtacattagtacatataaatgattaatgatgctctctgttttttaaatatatataaatataaatatcagaatatatgttctacagcggcgctggcctttatactggctaaataaaagcaaaagcaaaagcaacaattaggtttggcttagctcagtggtaggtatttgaacggtggcgttacagtgaccagggttcgaaccctctcctttatgtttttactaaactttttttttacttagttctcaacttgcggttttaactttttcaaagctcaggtatttttaagtccattcttttatttttaaatatgtactaaatgtgttattccttttaaatattttttaaaaaagtgatatttcttttacaagctcaagtgttgttttaattttaaaaaaacacgtgacattttagaataaaacttacccttagttctcaacttgttgtttattttttaaaaaaaaaactcaagtttttttaaatccattcttctaatttcttttttataaaaaagtgatatttcttttaaaagttgtctctaaactttttttaatccattcttctactttttaaatttgtactaaatgtgatatttctttttaataaaaattaatttaaacaaaaaaagtacattgaagatttgaagacaaaaacgaaaatggagatcatcattaatatgtacgcacgtagattgatgattttaaaaaaaaacaaaaatggctgacctgggattcgaaccctagtcctcagatatagcaagaaagaaacttaccgttgcaccacgagcgacaccgttaattcattgtcgcacatcggtctatttagggtgtgcaaggtgtcagcgccaagtgcattggcgctgaggccctgccacatcgcgcctcgcccgccacgctggcgcgatgtcagcgccagtcccgttggcgcagataagaacaacctcagcgccaaccgctttggcgctgatccgacggcctatttctggatatagtttttggtagggactagtttcgaaataagttttctgcaaggaccaatttgtcaaaaaaaacgccccaaacctgaagtgacccaaatcagtcgtatttgctgcaataattgaggagttcagcacataaggataatatatataaagtataataattaagagaatcaaactattttatacctacgcacgaggaacgacttgataatcttctctctcacctacttcctcttctcaacccctctgcaaaaggataatcgaaagatcgtttacaattttttgagtggtttcggtgtttagtggggcgtttgcgacctccttttagatctagcgacaatcgatcacgcttagcgatggttgggttggtgttgtgtagttccggtgtttgcccgggcgtttgtgacctccttgtaggtctaggttgtgtgagctaggagctatcaactcgtggtggtggcgtgtttggtttttttaagttactattataatcttataatttatttcctgctatatcagtataaaacttcgcactatcttgtgtgggttattttaaaaaatatttagtaccactaaactataggagtaacaaagaagtcaaagttgtttctccttgttttcttccttttcatttatagttcagatatcaacccggattaacttgttaatacagatattttatcattatatgttattaatcacaaatgtatataaactagtgaattttctcacacaattttgtgtgaagctaaattttaaaaacatgattagatttatattaaactcttgggacaattcttacttattttcccataattatgattatattccatatacaaccataccaatcaaatctaaatattataatttagactccccgcaaaaaaaaataatttagactcaccagaagcaaatggtgcgaacctttttttttctaagattaatgtggtaacacgtttctagtcgttcaaaccaattaatatcatttatacaattatacatgtaaaacattaatatcttgcacatactagtgatgtaagcttttgagatatattatttgatgacttatatattactgtctgcatccacaaatataaacatgcatttagacacggtttccaacatactacttggactaataataagaatttagcgtgattcacgagtttattattaggtacgactcctaagtgtatggtaaagtgtcccactcgtgatgatgtgagtgctttttattgtttctgtgagtgtgcatcatgtaattaaaaaacaactacacatgatgtataataaaataataactactccttccgtttcaaaatgtttgacaccgttgactttttagtacatgtttgaccattcgtcttattcaaaaaaaaattaagtaattatttattctttttatatcatttgattcattgttaaatatactttcatgtacacatatagttttacatattttacaattttttttaattagacgaacggtcaaacatgtgctaaaaagtcaacggtgtcaaatattttgaaacggagggagtatatatcatactccaagtaagctgcaagagttaaatatcattcctattcccccactttagatcctgcctatgccatatttggatctgcgtttgttcagcagccttaaacaaattgacaagttgagacgattgaagagaccccaaatacaaataatcccaaaagaggtgacgatcaatgtccaaattaagcaggtaacgtgctccacgccgacgattaataagtactacatccgtattttaatgcacgacacctttgactttttgataaacgtttgacctttcgtcttattcaaaaaatttatgtaattataatttattttattatgacttgatttatcatcaaatattctttaagtatgatataagtaattttatatttgcataaaaaaattaaataagatgagtggtcaaacgttaattaaaaaatcaacggcttagtataatttagtgtagtccactgtgtgtaacgggctcctctgacatgcacacatgtcaagggggaacgtgtgtcactgacgtgcaggtccatacgagtgggccccacctgtcactgaagctgcttcctgccgtgcgtgtataagatgatcaccacacggtcatggccatggcgaatcatccatccattccagcttctggggaagcaggagaggtagttagattgcattagctagctgtagaaagctagccatggttagtaggaagagaggaggaggaggaggcgtggcaatggcggtggcgatgctgctggcggcggcgagcgcgtcgcggccgtcgtcgtcgctggaagggttccagccgctgtcgaagatcgccgtccacaaggccaccgtcgacctccacggctccgcgttcgtcagcgccacgccggcgttgctcggcgaccaggtacacgcccgccaccgccgccgccgccatggtcggttagagagagagagagagagagagatcattaatgttttaatttgagacctgaattgaaatatatagatccggggagcagagaatctggcgaaattcttgcactcagatcacgcagattatgttaagctgattaatccaaatcgatctactcctatatattatatccccatttcatatgcatgcgtggtgtgtttagctaactgaagtagctgaccaagaagtgaaaatatctgagttgtgcgactgttggtggattcgccatcgccaggtagacgacacgagtgaccaccggagcagaaatgcagaacagcatagatttcgtcgtggtgtgttaattcacgcgatgggggaacggtcgggtgcacgttgttttttgcattttaaatgcaaacccctaccgttcaaatagtatttattatcctagtagggcacaaaaaaaagtttatttttttcttaagaaaaaaagttattgtcagcatgtacagctaacggcagattgtatgttgtatactgtagtacagatcacggctaaccgtatctctcatcatttaatttgttgttggtttataggccacaaccaaaatttaaatcttaaaacttaaagttgagttgaagaagttttcattaattttttattccgtaaaatagagttttttttttctcaatcgtagtttatttttcagtattgatttttaaaccagtaaaaatataaagatatggaaattttactataaattttttttggtacttctgtttattttctctgtgatttatcttagcacttagcaaaaaataaattaaggcatcttagcatgaagcatcaaggtcagcgtgtgcaagtaggagacacttaatttgatcattttaatttgatgctgtcacgcaagaactaaccagaggtggcgcaccttgactttgtttctttaattaacgagcatttagcatggaacttttttttacctactgtaacctgttgcttagtgagaaaagagtatagagcatgaattcttcgagttgggcccttcggagtttttgtctgctgtacagactgtcaccggcgacggagtcaaaaaattatagaagactaaaaatatagaactcgactaatgaagtattaatttttcaaaaaaaaatactatatggtgaattaacaaaatttaagcaagtttttggaggcagttcaagggcttaagccttagctaccctaggcctgcctccgcccctagccaccggtgataatattctactccgtaacagctagcttacttgaaaaaaagaagacgatgaacaataaataagtttaaataagaagtggtaattaaacatgtgaaattttgataaaagtataggagtttcaaatttgcatcaacatcaatcaatttggcatactgaatgcactacatgttcttcagggagaagacacagagtgggtcacggtgaaatacggctgggcaaacccttccgctgacgactggattgctgtcttctctccggccgatttcatgtactactaattacaacaaaatcctttcaaatttccacattttgatcgtgaaagtagttccttttactcatcagtggacacatttgatcgtgaaattagtttccttcactcatcagtggacacattttgatcgtgaaattagtttaaactgttaaatctgtgtcacttgtgcagctcgggttcttgccctaatccttccagatacccggatgagccgctgctctgcactgcaccaataaaggtggattaactgcaatttctctgaacctgaatcttaacaagtggttgctgcacatatgaactgatgatgaacatgtttatggatgattaacgaatcaattgatttgcgcatgcagtatcaattcgcaaactactcggcgaactacgtgtactggggcaagggcagcatccggttccagctcatcaaccagcgctacgacttctccttcgccctgttcaccggcggcctggaaaacgtacgtgatattatgatcgattaacccaattaagaaagaaactaattaaaactgcaactaattaatcaatcttgatgcaattaatcgcaatatatgtaatgaagaactctgatgaaatgagatgaaatcgacggcgttgttgttgatgtgcagcctaagctggtggcggtgtcggaggcgatatcgttcaagaaccccaaggcgccggtgtaccctcggctggcgcagggcaagtcgtacgacgagatgaccgtcacatggaccagcggctacgacatcagcgaggcgtacccgttcgtcgagtggggcatggtcgtcgccggcgccgccgctccaacccgcaccgccgccggcacgctcaccttcaaccgcggcagcatgtgcggtacgcacgcacgcatatttagattttctctctctctctctctctctctgaaactttttaatttttctaagaaaaactctctcaaaacttatttccaaactaaaatcttttagccacgccaactagattagcgtgatgaaacaatactgtcatgccggtctagctaacatgatatcgttatttcgccatatcggttcggctggtgtggtaatattatttcatcatgctaccatggacaataacattataaagctgtcatgtctgctacgagtggcatgccagacgagatgacatggtaaaaattatttagattttagaaataagtattatgatagtttatttttaaaatttaaaactaaaaatttcaataaataataaaaataatcacattatgtaccacaccgctccatttctttctacgaattattggttaagccgtacaaaaataaacgatcaacaaaaagaaatttgtaaaggtgagtgagcttgtatgcttttcaggtgagccggcacgcactgttgggtggagagaccccgggttcatccacacagctttcctgagagacctgtggcccaacaaagagtaagtggcatgttcgatctttaggactgaatagtatggaatgctgaaatagatgaatgatttaagtatacaaatgaatgaatttactattataaaattggaaaatgatttacaataatacttttaaaaaattatatgtagaaagtatatgaaaaatcacattactatttaggagctaggaaagcgtgcatattttttatgcttttatattctattctatccagggaaaagaaacctttgtatgtactattataaaataatctttgatcattgcaaggtgattagtgcagcagcaagagttaattaattatgtgaaatcatgatgaacaattgtatattcagaactgtggtatgtatgtacgtatgatgtgatttcaggtactactacaagattgggcatgaactttctgacggatcaattgtctggggcaagcaatacactttccgggcgccacccttccctggccagaactcgctgcaacgcatcatcgtcttcggcgacatgggcaaggtgaaaattttcgtttctgacgaaggagcaaagcctgcaagaatgttcagaaaccgttcatcaacatttgcctctagatcaatcagaaattactactcctccatataaaacggaataaattcttatgtgacatgcattttgacaaattgcacagctgttatatatatagtgtaataataccgtaattgattgatctgaatatatgcaatttcaggcggagagagacggatcaaacgagttcgccaactaccagccaggatctctgaacacgacggacaggctggtcgaggatctggacaactacgacattgtcttccacatcggtgatcttccgtacgccaatggctacatctcccagtgggaccagttcaccgcccaggtcgcccccatcaccgccaagaagccctacatgattgcaaggttagtatctgttattgtgcaatgttcagacaaactcaacaaatgttcaggcatttgttcatattcatttggcattttcgtgtcgattgatgcagcggtaaccatgagagggactggcccaacaccggagggttcttcgacgtcaaggactccggcggcgagtgcggcgttccggcagagaccatgtactactacccggccgagaatcgagccaacttctggtacgtttcgtagcccacttctatatatttcatttcacgtttgaggaggccacaaaagcctgtgaataagtcaaatggtatatttacaaaagaaaattaatttgtgaatataacttttatatacgtgttcttagcgatctaaaagtaaaaactgaaaaataaactccaatgaaaaaaaccctaaaatcaacttcaaatttaaagttggaaatttaaattttggctaataagtataagcataagtgaaaagatgaggctgataaattgtttatccaatcccgcttcattagtttaagcttttgtgtaaactgattgcgattttacgtatgatgagtagaccacaaaattctcgacatatgtaaattgtatattgatcatcgctccatcggcttaaactttttttggttgaactggctggtgtaaattgtttatcgatcatgctttatcagtttaaacttttttttctatcatatgctctatcggattaagctttttgggtcgaactggtcggtgcatacacgaacacgacacaggtacaaggtggactacgggatgttccggttctgcatcgcggactcggagcacgactggagggagggtaccgaccagtacaagttcatcgagcagtgcctgtcgacggtggaccggaagcaccagccgtggctcatcttcgcggcgcaccgcgtgctgggctactcctccaactggtggtacgccgaccagggctccttcgaggagcccgaagggagggagagcctgcagcggctgtggcagcgccaccgcgtcgacgtcgccttcttcggccacgtccacaactacgagcggacgtgcccgatgtaccagagccagtgcgtctccggcgagaggcgccgctactccggcaccatgaacggcaccatcttcgtcgtcgccggcggcggcgggagccacctctcggactacacctcggcgatccccaagtggagcgttttcagggaccgggacttcgggttcgtcaagctcaccgcgttcaaccactcgtcgctgctgttcgagtacaagaagagcagcgatgggaaggtgtatgactccttcaccgtggagagggattaccgcgacgtgctcagctgcgtgcacgacagctgcctccccaccacgctcgcctcctgatgaatgaaacaagggaaaggatcattattaggatgcatgagttgatgcctcatcgtcaaaatgctggcagctgagaaagagtgatcggtcggtcgatcgagttgggttttattttttttcttcttcttcaaccatttcgatcaggtgtggtagtggtcgatcgcttggctcgatcgtgtttctcttcctcatggatggtgatgttgtgcaataaaattgcttagctgctcgggcacaaatgtctaataagattggcaatctgaatttctgagtccacacaatgcccataaatgaataaattatagaaacaactatttacgccggacaccctccgaatcacttaaaaccaaggtgattttggttgaaatgacaataatatgaagtccatatgtgcaagcacaccccctatgtccagatttaaatttagaagtttttttttaatgaaacagagagagtaagcacctaggcattgacagatacgtggaactatagatggccatatggcccgaggcttgacggcccggcccacatagcccaaagagatgagggagaaaaaaatccttatttaatagagaagcacgatgggctatcgtgcctttgggccagcccggcatagcccgagtcttgttgggccaggggtgcagcccatgggcagtcccagcctggcctgggtgttggtcaggccatactggcccgactagcctcaacccaggcctagtcgtgcatgggccatgccgggccaggcagcctatttggccatctatatgtggaaccaaacagtcaactataagggagaaaaaaaaagactaacctacaaattgaatccaaaacttatgtccaaaaaccaatccaatccaacccacatccatccctcacccaagccgatccaatccattagctatctcaacccgtttacacccataccaagtgaagccaaattgaaaaccaatccattagacccattcccatccaacccattagcaggcttagctgcacaggagatggagatgggaagggaggaggaatgtagcaggatgatatggtgttctcacaaacttttttgtttagggcaattgtattcttgcccctacttttatttgcaattgtgattttacccttactttttaaactttgtgattttgccctcactttttgatgttgaatggtctgtttgcccctgtttaacgtctgttaggtggactcagattaaatgagtttaagaaaataagaaattgacttgcaaaatgtaaaaagacatctctatcccaaaaatttcaacctaagccactgctgactcctcccgatccccgtaccccattccgacctccgtccccgattcctaaccctcgcgagcggtggcggcacacgcgggctagcgagagcgaggagcgcgcggtcgtcgcggaggagcgcggggtgaagcaggctgggccggcgcgaaatggcgatgtcaagctgagctagcccgtcgccgtccgccgtggtggtcactgggctcgtcggcatcggcctcggctatagtgcccgaaccgctgcacagcagatgatcgagtacatacgtactgctgcatatgcgtagctagctaggctgccttgcctccattagcatggccgcgaggagctcgcctgaggcatgatggtgacaaggaggagaagaacagcaaggagaggaggagaggaacatttgagttttattgtcttttactttttcttctttgtcactccccctttagtttttatttttcttactgccttggactattggttggttcctaaactggacaggaccaacaaagctattctgttgttgaaagaaagagatgagagtagtgtttcttgtttgcatattcataaatcccttgattgttaaaatgattaaacatgcagggcaagttcatacgtcaggcattgaggcattgaattcatacctcggtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaagccctgctaacggaacaggagcatacctgagcttcagttcaaaatagtgagggtaaaatcacaaagttaaaaatacaagggtaaaatcacaattgcagttgtaaatagggacaagaacacaattacccctttttgtttttatttgttaagttcgctaccatgtcaacattatgtagcaaaaaccactaccatttcagcaccaaaacatgtgctggttaaaggtagcaaaagttcatcttaagagcttgctaaaggtaatcataaaacaaattatactggcgcaaattcttttcgcgatcttggggtgtccaatctcaactgcccaacttgcaaaccctgaaatagccggggcagcccacaactgacatattattctcatgatttatgctatttcaccttaatgctatttgacgatatgatgataagacattgttatacatcttatattaattagtcccataatgcgatgtgacagaccaacacgagaatgaaagccacgccattagacttagcgaatgcacaagacgccgaattgctcctaagctgaaattcccgtaaacaacttaagctgatatcctgtggctataaataataactggcacatgcagacgagaattaccttcttatttcttaacctgcagttaattgcctaccagtaagcaattgatctgttaccttaagcggtcacgaagtagggtttcgttctcagtacaatccacacgtccaataaagtagcacccatttgtctgcaggcttcagttgcaagctctagcacagatggacgtctccagaattcaatttgctgaagatgaagagcagccatcacaatgacttagaaccctcatctttttgtttaacatttccattacattatactatatgacaatgcgtgaaaagaccatacctgctcaacttcttgaaactataggggctaataatgaaaagataaagaagcaacaaagcaaagcaactgtcaagactcttcttcacaaagcttcaggctttgtgtttcagctcggtgacaccaaccacgtatgtgctacttgtcttgcaagcaaatccagcatctaaagccactcgcagcaccaacgtgtttcccagctttttctgccacacactcactacttacacacatctctgcgctccaatgcatcccctaaccaagtagtgcatccaactaaattgctcccagcaatcttcgccttgggatttccagaagatgggatcactcaagatgactggaaaagctccctgtgcagcactgccagagtcctcatgtgcctacctgcttcaagaactgaaggtgcacacattcctctttctcaaaacatctagttttgtagcatgacagctgaagattatttggcttatcatactccaaacgatttcagatgatatgggatgaagttgggcaagaagaaaatgaaagagagagaatacttcaagagatagagcaggaatgccaggaagtttataggagaaaagtaaatagtgcaaatatgtctcggattcaactgcatcaagcgttggctgaatccgaggcagaatttaccaacctacttctttctcttggagaaagatcattcccaggccgagtatcattctcatctcaaagaccatactgtataatcaaattgaagaaaacagcaagaacctgacctgaaatttctttatgcagcctgagaaaatgacaggtacgctaaaggagcagctgaattccatcacaccagccctgcaagaaatgcagatgagaaaagaagccagactgaagcagttcagagaggttcaaactgagatacaaagaattgcctctgaaatagcaggacgccctgagaatgaagccatcacagtgaatcaagaagatctgtcactaaagaaactcgaggagcaccaaagtgaactgcaaaggcttaaaagagaaaaggtaccagaagcacagaagaattcttctagagtcaaatatagagcaattcaggctccctgttatctgatttacctattggaattttatttactccagagtgatcgcctgtgcaaagttgaagagtacaaggttctcattcacaactacgcaaagattatggggatggatccctcaaagatcctctctaatgtccacacaagcttgttagatggcgcaaatgatcaacaaacaaaaaacatcagtgatgacattcttaacaagctcaacaccatggtccagcaacttaaagaagagaagaaccagagaatggacaaggtgatttcttatccttctgcaaatacttctataatgcaccgaaccgatgtaataattagaaatttagaattagcaaaatgtatcacatgtttgcgcagctatatttgcttcgaactagcaggcatgggggctcctttgcacccagttttaataatatataatagatatacaccaaaatttcagggttacaattaatacaatttacaagcatacgatgaacggtcgcaggaacataaaatgtttgcacaaatgtcatgggcattaggccaggaagccgagctgcctgaccctgctacagtaccatgtatattacactaatgtaggcattaacatgcagctccatagccttgggaaagcattgacaaaattatggaatattctggatactaacatggaagagcgcaggccatatggtgaaattaagatatattcaatgacttcaggaagcagtatgctaggcccaggaagcctcacactcgagacaattcagaaggtaaacaaaccaaaaaatgaaatactgaagaatatactgtctaaagctcatatagtagtttcattccactattgcatgaaacagatcgaatctgaagttcagcgactagaccatctaaaggcaagcaaaatgaaagagctcttcatgataaagcaaaccgagataaaggaaatttgcaagaagtcacacatggatatgccttaccagacagagatgaacaaaataatggatgtgataatgtcaggtgtgtgatgccaattagatttcattataatcttaaagtacaaagaactttctacaacattgactaataacagtacttgcgaaaaatatgaacaggggatgtggaccatgatgatctactaaagacaatggatgaatatatatacaaagtaaaagaggaggcaacaagtcgtaaagaaataatggacaaggttgaaaaatggatggcttcatgtgatgaagagagatggctagaagaatacagcagggtgccgtacttgcctcctgccataccaaaattccaagactacatcatgttgagctaactacaatgttttatgcaggatgagagaaggtattcgataagcagaggagcacataagcatttgaagcgtgcagagcgtgctagaatcattgtgaacaaaatcccaggtaagtataaaagctacctaatagagtcaaaagttagtgcatatatgttatattaactataaaagtgcaggcctggtagaactcttaatggcaaagacagagatctgggaacaagagagggaaaaggtctttctactacgacgaggtgtgaacctttgactcaaaacgtaattactaaacatgaaatccttcataagacatttcgatttagaagttactctaatatgaaatcttccataaactgtttcagttttacaagtttgatatgccagtatgccaccatgtacttgttaccataaccaatctaaatggccagaattatcttttactgggataaccaatgcctttattggcaccgatttataaaagtaacaactaacaaggttgtttccttaaaaggaaaaccttccttgagactg

SEQ ID NO: 17939 - DNA, 756 bp, Oryza sativa
gattattctgcactatctgagtcctcatttatccttgcaatttttgtgcctcagtccctttgggatccccattcaatgtagtgaaagaaaattatcgcaacttcaattgtgttgttgggaattccttttcgctcaaccagcacaggccacaactctaagcattgaatttttcttgttgtttagtacatggattacttcacacatcccatggatttggtacatttgcacataagttgtatttgttggatgttgttgcatggatcatctgcacctatcattggctcattcctgaaagtgtgtcttttagtatttcaatatcttaattttactggcatatttcttcccggagaattgatattaaatgcactgctgcttttaggtcacatctgtttcatttagcaactgtggtacctatttttcggcttctagcacatcaaacaacacactggtttgggacacaagaatagttccattaaaccaaagcagggatgtttcacgaagtaaagacatgcgttttttccggcctttgcattgcctgagccacggcaagcagatgcctactgcagaatatacaagtcaactgcccgggtaatcatcaaatttaagtgtcgaattattgcatctagtgataatttgttgtttaaaacaatgtttatggttatgacctttgcggggctccctatatttattttgagaattagtagcttaaatagcattttattgtctattttgatgaactctttatgaattttgaga

SEQ ID NO: 17940 - DNA, 471 bp, Oryza sativa
atatatatatatatatatatatatatatatatatatatatatatatatatatatatatatatatatatatatatatatatatatatatatatatatatatatatatatatatatatatatatatataatatatatatatatatatatatatatatatatatatatatataaaccatgcagcaacagggccatgaaaaaaaaaaggtcagctcgatctttagtcccggttatttcacccgggacaaaagatagcgatctatctttagtcccggattggtagtcccggttttcaaaccgggactaaagggggttatgaaccgggactacaaacgctttctccaccagtggtcttattattgtttgatttttttttcaaaatgttgcgagtatttctatatagcgtagtccctctgtccctaaatagtaaatatgggacgtcgtggactttttttaagcatgtttgaccattcg

SEQ ID NO: 17941 - DNA, 10115 bp, Oryza sativa
agagaagaaagataatagaatagagaaaaaagaaaaatatgtgggcttagattgccacccctatatactgccatagaacctattttgcatggttttaaatatttgagaggtagacatttctggtattgaggattagggatcttaaacagactcgacgtaaagttgagagacctcgggtgaagttattccactacaaaacccggtataacaccacccctatttttgaaaactgtgcaaactatctccttagtggtttaagaagcggtttctgttgatataggcaggttgattgtggttgacttgctgagttagcaggtgcaacccacgtgtcaacgactctcaccacatttcatcctcacctctccacgccctctctctcgtcttccctcttttcccgcatgcgctgacgccctcagcgagcgccgcatagtcacacttggccaccctcgatggcagctcctcggcctagtgcgggaccaaggttgccgaggacggtgtgggcgtcctcctcgtgcagatggcacgttgtttgcgatgcgccaatgccggccgaagccggcacgaccgacgctggaggaggtggaggcgacggatgcgccggtggctgactgagagagctagcgtgcctcgacgttgtcgtgcgactgtgtcggtcaaccaccgtgcccaacgagctccctgtccatgacatcgctgaccaatgtttatggtcgttagcgatcagtttcgactgtcaatattaccaaaatagaggagaactagttatgcttgcaatgcatatttgtgttagaaataataatactccactagtattaggtttactaacctgttgtagagaataaccataaagtggaggagaatcggcatcaaaccagacgataaatcaatcggacgatgtcgaggattagacttatgcatgaatgggccaagaactcagaattgacacaatgaactgtggcaaaattcacaagtctgcgtatgagagcagcagagaaggccacctgccgattttgggctaggccggcccaacccatggttcggtctaacccaccacggcaccactcgatcatggttcttctggacggctgagatcgactccctatggcggttggagggtatttccgaccattccaaccgccacaactgtcattctcaagctataaaagtagctttcactctcacttcctccacacactacaagcaaagctctctcattattctctcaagtttagtttagtaatcttatgctagtggagtaggaatagaatagaaatcgtagtccggaagccttcggaagagatcgggtatggctctagtagctttcctgtcgtcttttgtaagctttgtactttgtttagaatactcttctttagacatttctggtattgaaatacttttcgagtatatgaatgccaactttacattatgttcatgttatactgattatactggtagcttatctgggagaagcataggtacgggtataatgtttgcttatgcaattactctatgtcatgacgatgatattagagtagtatctggtagtttaggcatggtgtctagattacgagatatcattatttggggttatatgctgcggatgagaggtgggccgctgatggtgacagctcagtacgggtattcctccgcacgtgtatatagtcctaagttagtttcctgggagggtactcctccgtatttagccctggttgtatggtcatggcgggctgtcgtaagaaactcgacagtcaggggtggcttctcgaagtactaggagggcatcggaaagagggtattagctagttaatcatataagtgtatgtatactatgtatattagaagtataggaatagattctctttctattttctttccacttagcttagatgttttagtatgtgaatgagtagctccctgcttgtgtgtcactgtaccctttgatttatcttaacccctgcttagactatgattattacaagtaacatataaattattagtacggttctctctactatgatcttcccacgggattacataaatacgatacccttggaatactcttgggtgaaatgctacaatgatatatctgcatgtttgcggatgaactctgtaaccataatataccaggagtatttctgcgccattactggaaattatattctagtaatatcattaagaaatatcaacaaccaacttcccatctggcatgatcggtgatggtgaacctcatggtggacatggcggcactgctcgtagtccgagatgcggtgggaccgcggctgttgtgggtggcggggacgtcatactccccatgtggatggcacggcgtccatggtggaagtagcaacgtttgacatggtagatgggttggtcaaggaggtgatgccgtgacgccgatcgatgtcggcatggccagcggtggaggaggtggaggcggcagaggcgttggcgctagcggctgactgagaggagcggtcgtgcctcgtcgctgtcacgcggttgcaccggtcacccgctctacccgacgagcaccattcccattacacatgaccagatccccgtgctgtgtgctcggtggtggtggtgcgatgcaggaccttacggtgaacacaacagtggttgctgtgggcgtcctcctccccgtgcggatgtcgcagcggttggatcggaggcgcttgcgttagccgtcgaccgagaggagcgggcgtgtctcgagaagcttctcgtctctgacttcgtcggtgccgaatccctcttctcactcttccatggcggcagtggctctcctcactgctccacggcggcagtggcactatgcatgcttatgtttcacgtcacagggcgtgaagggccgacggcgacatgtgacatggagggccagcgacacagatgaaggggcaatgagggaggttgtggttttgcggttgagagatgtgattggaccaagggaaatatttaagggatgcaaaatagacttatttccaacaagaaaatgtggtgccctagccctagtgcatggggaaagatggaggtagcggttgagcctaccttatcgtgggcttgaagtctttgcggagtaggtcttggttcgttgtcccggtaacttcaggccataataggccttaatgcttcgtgtagttgagctttggtactttggcccatatgtaggttgttggttgtggtgggctaaagagggtttgggaagccaatcgcttgccactgacttgaattcagccaggagaggagaggagaggagaggagaggagaggaaaggacgagacaacgctactggttggagtgagcttagggaagggattgggtgggagcatggccgacactatggtatagtggtaggctaggcaattagtgacatatgctcatcaattgggcctaactggctggaaaacatgaacatgatcaatgacattcgcaaacacggaatgattagaaacgtgttaaaatctttctaaatggagtttcccgtagttatccactatgatatttaagtgagttcccatggatagtggtcactcttgcacgttctctcccataaaccctgaaacattcaatcctacgaaaccgtggaagaagattccatggtgatcagactcttgtcccatgtaggtagtgacattgggaggaacaccgatcactagaatgccttcggcatcattgatgtgtagtagcgaaggacatcaatcaaccgcaaccccttcggccccacggaggacaatcacctgcaacatctttgcttcaagcagacgatatcatgttcgaggtacctcaagtacacaggtagctaagaacatcaacatctcatgagccagaagaacagaggaagacgatacccttgtggctccaattgacaccggccagtgcaccaaattccacattagattatcttggtgatcatgtgttaggctaagcatccttttgatgtaagattagaacttacaattacaagtaagaacattaacaaccatgttcagttggaacaagaacaaatcttgctacaacaattacatatacattccctaaaaatcctacttacatgcaactgtttccatattaattttacaacaatttacgtgatcagagagagaacggatccttgggagcacggtaaatgctgggcgactctggagagcattagcggcatcatggaacacacccttgactagtgcagacttgccattcattgattcagatcctgcagaagcaacagctgttgatgctgtcaatactcgtatttcctcgaggtacaagaggtgtttaagtccaacaggtgtggcctcatcccattcccatggatcaagtgctaatagcagcctcttgagctggggcatagcacctaccccaaactctaggtgtgacatcctattagagtcaaaacagaaaaaccggagagcagcgaatcctatggagccttctatcatgatcctgctttccttcaccgcgatattgcatgtaacaatacgtaggcttagatgggtgaggaagggtagcattgtgccgatcatactaacatcttcctggagtatcttcttgcccccaagtgccaactcacggaggctatggagttggccaatccatctaggaactttggagaatgtccaatctagcagatcaagcttctcaaggttgagaaatggaggtgaaaaccagctgctcatcgcatcggcgcaacagctaggactattagacctcacataaagacctttgagattaccgagtttctcgatggaacaactcagagcagtcatccatcctggagtagtagattttgtgtcttgtttgccacaatggagtgacatatctgctagactagtgagctcacccagggcatcaatattttccaatgagcttactggtagattaaagccatgcaaagtgcgcaatgacttcaatttctaatcccatccggtaatccccccttatgctgtcgcaacactagatgggtcaagcgcggcaaatcaatgatgcctgatattgatgggatgctgcattttgatacccagggtaactccaaggtttccaaatgttgtagccttcggatttgacttggtaacactatggaaacttgtgatggtatgtcaccatccattaggcattccttgcattcaacctttaaatatctcagctgggacagttggttgataccagtgaggtcaattatcatctctcgtagaaagaattcaaggaataacacccgcagaaacttaaactccaacaaaggaggtatccactttgatcctccaaatacaccaagagaacgaacttgtgacactttcctagtaatgttcatatccattgtgtcacccatggcaccattcaagtcaatggtgagccgacgaatcttgtcttgaacttctatcgccgctcgtggatcttgtatcacactgatgaaattatcttccttgcacctcattagaatcatgtctagcatcatatcatgaaccttgcaatgagatacttcattgtagtagccctgatatggaagttgaatcatgcttctattcaccagctcattgaaatagctctctgcaacaacccatgcatcttgcccaggagagtgactcacaaaaccttctgctacccaccttttaataagatcaaccttgctaatcacacaatcctctgggtaagcaccaagataaagaaagcatgctttgagatgatgtggcagactcttgtagctgagctccaagatttgcatcatgtcttccaaggtggacttccttgcaaatttgttagtggctagagaactttgaatgtactcccattcctccttcagtcttgtgggttggcaagctaaaatactagctacagtaacaattgcaagcggtaggccaccacacttcttcagtattttacatgagacttcttccaagtaagagggacaataatctttagacccaaatattctgttgaagaatagttctcttgagttttgggcacttaggggcttcatattgttaatgcttccatggtcactggaacatgtcctagccacatccccgtgtcttgtagttattataactctgctatgttgattattttgtggaaaagcacatgtaataatattccatgaaggaacatcccacaaatcatcaactacaatgaagtacctacaaaaacatttcacgtgcggtacatattaaattgcaaggaataattaaacactcgcttttaaatagatttagcaaaatcaaagctcgtgcaattggaaactagattctatttcctctgtccataaatataaaaattcccagattttgaaatttatctacaaatataagcattctactatgtatcccatcaatcatctcaatcaattttcaccatctttaacctcaaacaccctcccactccaatccatccctcatttaagaggaatactaaactctattatcctttactttaatatttgctaaacaacctagaaatccttattttttttggatggagaggagtacattatattcatctttatatttgaagcgaatacttgtattaaatatgcaactatttttcaaatatacaaatgtacagtatgtaggaaataattgagcaattaattaattcgagctttaccttattgatggacagaaaaaccatcaaagtcaaatgtgaccatataaatacatagacactaaaatcatcaattaatatctttaaatgtatttctaccattcaaaatgtgcaccaaaaatttgtgtttctagcaaggtaggacccaactagttaatttgagaatgctaattaggtggactaattggctgaaccttttcttttatttgcatgcatggtgaattgagagtgatgttgagtcattagaaacaacattaaacaggggtacaacggtaatttgtgttgagtactaatctatctgaaatttgctagtttttttggatggaggtagtagcatgaatgtgcaccatttatagatgatccttagtaagtaaaatttaatttcatttgtgtcctctgttcctaaaactagtcaaattaagtatgtgttaacgggtcttaaattttttgaaacaagaaatccaagcttttgtggaaatctaaaggtgtgcacgcatattttgacctaatacttaggaggaaaagaaataatttccttaaaggtttaataattaatttaaaaaaagacctagtttgataaaacgttaattaattcttagaaactgaataaataatgtgaatatcaccttttaatccataaaatatcccttgaaatggtcaataagttcttgcaccccacaagcatgagagggatgttgttggagttgtaacagcaaacttgtgagtagccttaccatgtcgggtttttgagaaacagatacaaatgccttacagttgaactgcactccaacttcacgatacacctgactagctagggtggtcttgcctaggcctccaaatccaactattgacataaccttcaattgcgtctcttcgtccatcaccaatttagtgagctctctctttgggctgtcaatgcctacaaggccggctgtctccttatagaatgccgagatgcgagggtcaactgtcactgaggtagtattagagatgtaatgtccaaccttgtacctcttacgccgctcgtttatctcctgtagacgagtcttgagctctttgatttgccaggcagcctcaagatgagccctgcaagtcttgagaaattgggaagccttgtagaggaaccccgtcttagcgtctacgcttgtgatgttgttactgaaatcatcgatgcagtcctcgatgtcgtaggtcatctccctcacttggttcctccaatttttcgcctccgaatcgagttcttcggcatcatccagcttctccaggagagcactcatggcaggcagctcatccctgaggaacaaaatgtccctgctggacacgcctatgaggttggcacacatgtcccctcccatcagctctctgagctttgcaagaacagagtcaatcacccccttgtatgcgctcaccaccatcgtcgacatgcctctctttggtcctgcaaatagccaaattaaggtgtttatttattagagttttaaaatggtgcttattttttaggagaaatttaggcggttaatataataattagtaaccgacttgtgttgggttagttgtacacttaccaccggtgcttcctcaatgaagcttagatttctgaccagtgagagtagcctcgaccgagcaacagatgaacccaaataacaatagctagtagtaatgaagcatggatcaagagaaacataagaattaaagaattagccagcattctaaatggaaactgatagattatttatttaattatgaaagaattaaatcctacatgctacaacctgttaacaaatactaaggctgagattaacacgtaattaattaagtattagcaaaaaaaataaaaaataaattaatatgattttttaaagcaacttcagaaaacttttaccaagaacgtaccattagcagtttgaaaagcttacatggaagaaaaagatagttgagttgggaaagaaggggaataacacaacctaagtgcttacaagaaatggcctaagcaatacagtagaaaaaaagtagtactttttagaggtgtggaggaagaaaccagcagcccacaggccagagagctacgtacctgccctgcccttgcaccgtttgaactttgaaggcaatgtgcacccaaagcttttaattcacgaatgaaggcaggcaaagggaggcacccaaagccatcgatcatcggtgtcatatatatatagagtgttctgaaaaaataaagtcaaaaattaagtctgacattgttgacagggtatatgcggacggatgcatggtgtggacagctcttaattagctagagtcttcttttgtaggcgtacgcacgatgtccggacgattatattaattaccctcaattatttctttttgtagtccaaattattttctataaataatgggaattacagcaagaacgttgcattaattattgagaggaataagtccatatactccataaattttggatgaaaatctacctagtacactgaacgtacgttagaactggacatccaatctctaaactttatagtattgtttatattacaccttaagttggttttgaacggcggttttgtggatttggacacttaaacggacggttttaaataatgaatataacatatttatttacacatagtcaatcctcgattctcaatttatgcttacagtgatgttattctagtattatattgatattaagagagagcaaacatatgactaaacagaaatatttaggtagagattttaacatatatctaatgcatatgtcaaatagtcaaattgatccaacataattgggtttcttgtggcgcaacatacttatgtgggttgaagtactagatttggcatgcgtgctagtatttatgcgatttattcattcaatggtttgtgacgtggccgctgacacaaacaactgcgtggttactttatcaatatcaagatatattaacctagtcttttggagttgctcataagggtagggtacagtgtacgtgtgtacttacagggaaagtgcgcatctcttattagtgaatgcatttgtactttatttctgaaaagaattaaataaaaaccactttgtaaaatcatcttaaggtcatatgaatgattacaatttaggtaagatggacttttattaaagttttaagggtatttagactttttctttattaagacaataaggcaataatcaattactcttttgactaactagatcgggtgtatatatatacaattattgaagaccaattatacaggaagatcgcgacgcgagttggtgttcgttgtatttagtatgtaactatttctcctgttggatgccttgatgaatgtgattgatttgttgattaaagcattattaaacaacgtacatgcatgcacatggagtgtcgacatggattaatatatatagttagtgtaacgtttactccctccgtttcacaatgtaaactttttagcattgttcatattcatatagatgctaatgaatctatatatattctactcccttcgttttttaatagatgacgctg

SEQ ID NO: 17942 - DNA, 1950 bp, Oryza sativa
cccggttcaggaagcaggccccacacgccatggccccaccaccactgacacgcgacgaaaacattggtctcgctctcacgcgcccacctgcccatgttagcggagcagacattttacctcgaacatgccgcggagacagctcatccatgatttcctcccccccctcccccccgattctccatcggattctaaaaaaaaaaattctctccacagattgatcgatttctccccccaccgaatccacgagatttcggagatttcttcgcggcgcggtcggttcatcgtctcttacgttcgtcggcctcagcctcgctcgccgccgccatttgggaggggagtgcgtctcgaggtcgtctggttgacggattcgtcctgtggatttgaaactttttttttggcttctccacccccgcaaataagcttcgatgcttttccctcgcgaatcgaatcgctcggttttttttcctcctgtgtgctcggtttgatggcgacgtgaagaggtgggcgtcgccgtcgaggttgagagcagccgcgctggcgatcgcgggcgagccatttgggttttttttttcggtcgtttggtttccgccaccgccgctgccgctaccgccgccgcgtcgtcgtgggtgtggttttgctttgctgcagcagctagtgctgtgtcgtcgtgcggcttgggcattgcggtgcccaaacacatcgccttcgtgggcgcctcttcctcaggccgccaccccggcgcttccgccgttgtcgtcaaaacctttttccactccccaccgccggggctaccggggtgtcctcggtctgcgccaccacgctgccgaggggaattgttgatctgaactatcgccggtggggcggcttcattcattctgagtcaccaccgaggggcgccatagatatgctccatcaccggtccttgatctgtgccgctaccgacgtgtcctctatctggacgacacgattgatcatagtggctgcgaagcacatcggtggctcggtaggtgaagaatatgaggatttccagcttgagtcagttgtttattttgtgtgtgaattttggggactccggcaataatcgagctattggctgacagatcctcgtttatactcacgctactctttgaatggttggaataaggcatcaacttgacgttctgttctgaaattttgatgaacaatgagattcaatctgaatatatttgtttatcaaattttgtagttccagattgatcctatgaactgaaatttctgttagacacaaatgtccatacacattgctatggccatgtaggattcagttcttacaaacagatgaagtagatcctagagggggtttcactgttatttttgggtaatccaaatttacaggtgttttacttaaaaaaaaactaaactcccaagcaggcccttaatgtgtcacaaaattttggttccactaccattctactagtacagtatttagcgatttgttttatgttttgagtttactgttgtgatttttttgttgcattcattgcttgttttggttgtttctgttaacttgcattatattccagctcttattctgatctgtccttagtgaccttttgaatgtgttcccctaatttctttttatttttatccgttttacatgccaccttgagagcttatagtttactatacattggggttacattccagtggaagttgttacttcataatatatcataccttaaaataaggatcccaccttgggttccctagaatttttgatggagtcgttgttgatggtgaccttattaattcctttctcatgtcaccaatagcacgaaggactacgtggaaatatcggctaacagtttcaccggacctatcaaaattagtgccaactaccttgtttctaacattgtgcccgattgtatgtaagaacatagcaacttgctcttcaacagacatatatatagt

SEQ ID NO: 17943 - DNA, 4837 bp, Oryza sativa
gtgagtgttgttgcactgttctcctatagatgaaatgctgtcattgatatcatttgctattttttttgctagcataactaatattttttatgccatttatttcctagatgactacctagttgaaactgactctgaagaggaaattgaggtcttagatactggccaacttcatcccggcatcttattctctgatgaatcgatggagcaaagaacagtgggttctgtacaagtggaagaatgtcaagtcagtcatgctgctgttgttgacgatgattctagtatttccattccgacaaaccagaacatttcatctggtcaacagcagttggagatacatcttgatgctaccaatgaaaattctgttccatccaatgttattatagatgcaaatgtaacggatcctcatcaagatgtcatttccaatggtggacttatagaagcatgttatggtgtaccattggatgatattgatctcaaacaatccaatatcttagatggtgaagagattactagccttcctatggctgacaatgaaatgactccactgaatgatcaaattatggaccaaattgatgatatgaaggaaattagtactatagtttacaacaatacaataagcgctgagcagcatgcaaattcaggttcagagtttgagaaaggaaatgaatccagtgaaaacctttatccgctagtaatgcccagttttgatacagaccctcacatttggttaccaccagacccagtcaataaggacgatgacactgatattgttgctaataacgatgataatagtgacaacaatgatagttgggtacagtcaagtttcaatattagctttgatgcaaagagaaacaagactagttgtgaagaccaattgcagaaagcaatgtcggaagttatgaatgggcaattcaagattcttgttagtcgttttttagctgctgaagggctctctttgtctgatggagaagctgacaagaactggcttgatatcgttgcttcactatcatggcatgctgcattacttgtcaagcctgatgccaatgttggaaatgcaatggatccttgtatgtatgttaaggtgaaatgcatagcttcaggatctattgagcaaaggtaacctaccaacattcttcctcattctgcttttttttctttgcttagtcatgtagacatgccttaactagctcccttttctatcttttttttttgacagtgaagtcatcaacggccttgtttttaagaagagcgctgctcataagcagatgcgtgccaacatgaagaatcctagactgttacttctgcagggtgttgttggccattcttctgcagggctattgtcaatggattcaatgaaacaggtgtgcatgtatgcccttagtagcatatttacattatgtacagagttatgtcatatgatacaagatatgcaaatttcttttcattgtcattgatcaggaaaacgatcacttggagaaaattctcagtgatgtaattaccaaatgcaaacctgatgctatattggtggaaaaagcagtctcacgaaatgtcaatgaatatattcatatacaaggagtcgctgtagttagtgacatggacatccgtcggctgtaaacaattgctcgtggcactggttctccaatgttcatgatgcagaatgttcttgcaacacccaaccttattaaacagtgcgagtctctacatttggataagttcattgaggaccataatatcagtggaggaggaaagagatcagccaaaactttgttatttctagaaggttttcgaaagcctttgggatgcacggtatgttcttttcctatcttgtttttagtttgtaggtcatctgttctctttatgtaggactgatcttctcatggtggtcagagttgttctttctctgatcccttgagctgcatttagtatattctttcagtatattatttacattatatgtgttagccttctatgataaatatttttttctgccattttttttgacaaactggtatatataatgataaaatataatcctgtccatttggaatcaacaaaaatatattaattaattttgaagctaatgaatttccttattccagacttgacatcatgatttagactgaaattgattgaatcagataatataatcttcattgttggggttctgaattagaatcttaccttgcatttgtttgtgttatttagtgaaattatgttgatagaacaaaccaattagctttttaaatatacttttcccccatgacattagagcttcacaccttgttacctgcttaacattgagttatatcctaaagatgtattagtacagaaattgggacaaagtttcatagataggattgagttgctcatattgatattgattatagtatttctttttgaagaaaaaataactttgatttgtgcgacaatgttagctaatagccatatatcacccaaattgcttttaggggctttatatgttatgcacaaatgcataagatatgaattgttacaccttggatgtactaaaccatttgtgttaatgaattgaaacaaaatctaatcagcttaaaactattttgtagattttgctaaaaggatcaacaagtgaagaactgaagaaagttaagcgtgttcttcatttcactgtttttgcagcttatcatttgatccttgaaacttcattctttgctgatcaaaggttatttgcaacgggaaaaaatgccatggagaaaggcaactgtttgaaaactgatccacagctgcttgttccttgtactgctgctccgtcctccaaattctgttctgatattgcacaaaatagcgaccccacacaacatgctttgaacattcttgcttctgatggacagtatgttaatcaggatgattttgttaatccagagaaatccgtatgcatgcatgattccaaaattgaaacatctagagagcacgcggacagaaaacttgatgacagcaacaacattcagtcatattcatcattgccagttcctgacccctcgagaaatcttattggcgatatgtcgttagattttgccaaattggcatcatgtgatgactttgccggttccacctctggagctccttcaaacaatggggttctgcagacgtatggggcggatggcaaagattgtctagaaactattagtgatggaatatctacagggactaggacttctttagattctcagaacatattgatttcgatgtctagccaacatatcagaaaccaagcaatctgtgagcagagtcatctttcccgcataacttactacgggtattttgatacatcacttggtcgttatttgcaagatagtttacttaatgaggtcatacatcttaactgcttgttgatttggcagatgcttattttatcttatgatgtttcaattgacaatatattatttgcagaaacacaactgcttatcttgtggtgaacctccagaagctcacatgtactcttacactcaccacaatggcactctaactgttcttgtgaaaagccttcccttggatgtaactctttctggtaaggatcaaggaagaatttggatgtggactaggtgtttgagatgcaatggtaagcccacccagagggttataatctcttcctctgcgcgtaatctgtcatttgggaagttcttggaactcagtttctcaacacattctgctgctaagaagctatcaacatgtgggcatttgctgcatagggactgcctacgcttctttgggtaagtgcgttccaagatgctcttacctaaaggacaagtctttcctaatgacatcactaaagttacttttttcatgacttgcagaatgggacccaaagttgctatgttcagatactcatctgttgaaatatattctgcctttaagccaccattgactttggagtttcataacccaaacaaaaaagaatgccgggaagttgaatttaataatgtatgtctctccaaaaaaattttctgaaacatcctctttttagctaattacatattttaatcctaatatacttggttattcaaggtacttcgaaaatggaggctactcttatctgaagccgaaaataaaatacaaatcttgaaatcaggaggctctggtcaagccttgggggaaaacaccaaagtttcagtacatgaggaattatttttggaagtcaataggatacttgcacaagaaaaatatgaatttggggtaagcttgatatcaacttctattttgttctcctattccttcccagaagatttggatctacttttgatatgctaacatatcttgtcaacacgaggtttatccgaagacatttgacttccttgtaaaatctgggacttgtgctcacgagatccttgggttgaactggctacaccagctacttcttcttggaatttacatttgggatgtccggttgcaacatattcttcaatactgtaaagctaacgctgcatctccagatagtactatccagataaaaacaccagagaacaagccaaagaattctgaaataacttctgttcatggggacacactatctcttaccaacgttggaatggaaaggcaggaagcacgtatcgatacttgtcattcttttgatagttcatttggcggtatgattttggagaatgagcagctaactgagaaatcagtaatccaagagcctgggtcacatgttagtccagatcatcgtgaagatggtggatcatatgaagtcgacaaatatgcacatatctctgacagtttttgtttagaaaagttaattgacttaccagttaagaataatgaattgccagaactagccagaggtaatgaaatgtatcctgtt

SEQ ID NO: 17944 - DNA, 13308 bp, Oryza sativa
caagatcataacctatcaagaaatgtgtcatcgttatcatccgaggaatcaacatctggattttatgattcttttctatctgccttaaaagatctgcatcctgaattttgtttgaataatgaaaagctaactttgaagagcaaatacactgttctgtgtatatatgcaaaacaattctacgatcttcggaagatttgttgtccatcagagattgcctatatttcatctataagccgttgtaaagaatggaatgcacaaggtggaaagagcaaggcttttttttcgaaatcaatggatgacagatttatcatcaaacaaattaagaagactgaatttgactcattcttgaagtttggccttgagtacttcaagcattttggtgtatctcaggcctcagttaaccccacttgccttgccaaaattctgggaatatatcaggtctgccaaaattttgagtacttcaaacatttctgttgaatgtaataaaaaactacttataactaatattgtaattctctctaacaaccatgtcaggttaaggaaatcaggaatggcaaggaggcaaggaccaatttcatggttatggaaaatcttttgtttggacgtaatataatacggagatatgatctgaagggtgctcttttctcacgatatgttcttgactcaaaaaatcctgagaatgtgctattggatcaaaatttcattgaagatatgcgtgctatgcctatctacattgaaggcaaaaccaaaaacctcttggagcgtgctatttggaatgacacggcgtttctaagtgtatgtgtacctattgccagaaacggatttccgctagtgtatatgtattatttttcttcataagagtatattcaggatgctagctcttctttttttgtccttttgcggcgacatgatgatagctctaaagttcacaatttgcatttcttttatttgcagcgcatgaatgtcatggattactccttgtttgttggagtggacaaacagaagaaggaacttgtgtttggaattatagattatttgaggcaatacacctgggacaaacaattggagtcttgggtgaagacatcactttttgttcccaagaacctatctccgactgtaatttccccgaaggagtacaagataagattcagggcattcatgtctcagtatttcctatcagttccagatgcttgagttgatgagttctgaggcgttgaacacactctggcttttggtggctgaacttatgttgagtatggtttggttaaatgcctgtttggcatacagtaaatcatctcatgagttcaactttaagtttcattttattcattttttcaagtgtgggtctatcaccatccatactgcttcgcagctgctgtacatagcatttaggatataggttccctgggggaccacaaattttaagcaagggagcggtgactggacctacatataaccaacatgttccttttttgatgagcattaaggtggagttcaccttttggacaactagcttggagtgttatagagaatatggcattcatgtattcatttgtgttattaggagtaggtttctggaatcaaatacatatctaaatatgtgtcaattatagcttgttggttaagcatccatagtggtatgacgtgttattgtcgtcctaaattcctaatgctatttaaatcagtcaatgtctcttataaactgttcacttatttataagttacctcctaaaagatctgtgacaggtgatcaatcgaaaaaaatatttccatgatttgttaggatttagaaaaatgagttgtgattaatctgcatatatccggacaattgtattttgttgatttagatatatggacagaagtatatttctcctgcacctgtgtaaactttggggtcaacatccaatcctacacttgtacctttgcattctttagctgtttacacaggtctcctccccaaagaccaccacgggacttgagctgccttctggtggtcatgtaagctgtcgatactgcacaccaagtggtaagctgtctagcgcttctgtattcattgagatggagatgtcgtatatggtgaatccacaaactgggtatgttaacaagcttaaggaacgggcaaagatttctacaccaagattctcatatttaccccagagcgggattttacatggatgaggctcattgctgataagtgcggtgcggtgctgtgttgtgctcatgtgcgacccggcgcacatcagcaggcttgtcaccacgatggtaaataactaccagcatggaacatttatttatcttgtatgtgtaatgtagcagaatctcttattaatacaatcaaaattagttgctagaattgttttgcttctagttgccctggaaactcattgcaaaagagcttcaatctttttgccttcttagtcacttggccatctagtaaggcatgtctgtttaaatcattgaatgtcacaatgcaacctttccttgtttcaggtttttagggtgacaaatatgtatatgtttttgtgtacgttgattaggttgatactatagttctgatgaaactattttgcaggtatcatattcaaactgagtttgaacttagtttatcaaagatcattctgattttcagaataacaaaggtaacattttgaggtatgtttacatgagcatgatataactacaaaattatattttccactagtccggacaggctgattcttaagttggatcatttccatagcaaaattattgggctatttatggttttttcctctggtgatggaaatcattctgatggactaagtaatcagcatttcttgttgttatcaactgcagtgtcttgttaatttttacaccttttagaaactgcactctccaaggggcatatacacaagataatatcacaagataactatttcttaagcagatttattggtaccattttcatatggcttgttgagaattgagatagtttccgaactttgagaaagttgactgtgaataccataacgatacatttataaatagatagagtaacttttgttacagttgtcgtaaatctctttgttgcatttttcatgttttacatgctatctcgcttgggaatgcaagcaagccagcctgcaagagggttcaacgctggcttgcttgcatattcttatgcttcgttaccctctagaattgttttatttccctaatatgggctccccagctaatgaaaagaaactccagaataatatgggctccccaaataatgaaaagaaactccagaaaggtcttctatgttgctggtgctgcttaatttggcaagttcaatgttcttaacgtccatattataatgacaatattgttccatgctccactgatacaattttcttattcctacaaggtagtcatactttggttcctgagcatttgctgtctattgatggtttgaatcttgttgcttttgcaggaatgccgtagtctctttaaccactgcgatgtggttacatcaactaacaagaatctaacaggtcctagaggtggtacaatatttttcaggagaggaaaaaattaaggaagaggactgttcttttttctcaaggggatgaaaatgaattgtgactttcaggacaggataaattttgttgttttccattcaaaacaactatgccaggacgggaggtccccatggtatatattgcttccttggtgataactctgaagcaagttgcaacacctgaatataaagcatagattcaacaagttaagaaaaatgcaaaagttttggcaacagctttgcttagaagaaaatgcagaattgttactattttagatgatggaaaatgattagtacatgccgactgctgggcgatggcacagataaccactactttgggatttaagaacttcaggcctaaccggtataattgtgcctaccattttcttaattaatttattttttaatccgtgagcacggttgtatattcatttcattaggcctccctagaaactgaaatgtcattgcatgataaacatatactccttccggtttcataatttttgatttgtttgacaatgacacggtctgtgtttttctattataaatgtaatgtattcctttcttccaaaaaagtcttatttcttttttcaccaggatcaaggtgtaaactcattcatcgtgtaacacaaccaatgaacatgcaaccaataagtattaaaatgacttattggattccaataaaaaatttaatatagcacatattgactccaaataggacttagacttttagaaaaaccaaaaaataaaataggacttagaattttggaaggagggagtatacaataaggctcccatcggatggcctaatcagtaaaagaaaaagccagattttgaattttcaaacttaattttgagattgattttgagatattttcaacgtagtttcttttacaacattggcttttaagtcaccaagaacacatttataaaaatttcatctataaatttatttttatttcctaataagccgttttgacttattaggaaataagccaaacgatggggacctaaataaatacatgtttacttttattatagagctttgaaagatagatccatatatgttattctagttcttttaaactaaatacgtttaaagttattgatagtcaaagttataaaagattgactgcaatctttgtccaaaacgttatttcctccgtttcataatataagacattctagcattgtctacattcatatagatgttaacgaatctagacatatatacgaatctagacatgtatatatgtctagattcattaacatctatatgaatatgtgagatgctagaatgacttacaatgtgaaacagagagagtaactattatggaaccagagggagtatgcttactaaacttgaaacattagtgcctgttattttcttgagttgcttaaagtcttgtcagtggcactattcctcttggacccatttgtttctatagattacatgatgtgtacatgcatatagtttataagtagtatgtaaactagatggatgggcgcgccctggcgcgccgcctgtggatagttggattgccgggtgtaaacgttaatgtcatagcattatcagttcagttaatggagtggatatggtgcaaagaaactgacttagactgtaagagtataagtgtcatattactaaggtttatgaaggtaataaaatgatcagcaacataatataacatagcaagttatacagaaggtggtgcatcgttcattgggtatatgagtaaacaaaatcgtcaatgacagtgataaggttgttcttaacaactacactacaacagtaggtgaagatgatgtctttaacataacatttacagagaaacaagcagcatatagcagggatataaaggttataaatacttagcatagtggggttgtcttacggcagctagtaggtgttgataaagtattttcatgatagtacaaggatggttcttctgcagcgcatgatcaatgcattcacgttatatgtattgttgcttgtagctgattcgtttcgtagaagtggaaaatgcagattattcccacttgtattttattggccgttgcaaactctgaccatcctgcttttagattgtaccgatcatctgttgacttgtgaagaaccatggtggttgatgtgtttcctgcagtatgcacttgatcctttgttgtcttgtgttgggtgagtggctgaatgtatttttctgagaattcttttgtgaagtactgttattaaaagtggatgttaggcatttatattgcataagagtggaatggtagtgagcgaaagatctctccactcttgtcttacttcatgaatgtctggttgatagtaacaagtagaattagaatttgcttgagtgatgcgggaatgtcgcaatatctttcacgtagttctttagttcgcttgatagctttatacttttgttgtagtagcacatatctttgacagtcctttttggttggctgtgtaaaacaaaagtagaaataatagaagtagataagtatttcagttagtatgggaaaaaatattgatgaattgcattgcaattagtatgtaaagtatttggacctgtagaagatgatccagtatgtttgttgaggctgagttggatgtggtggtttgtgtgctgtttagtcttgctagctctatctgctttttctacgtttgaccaaagcttcgtctgaagtgcgaacggagcaagaaagacctgaaaaaaaagttaaggcaatgtatgaacgaatttgaatggcaatctgtaaaaaaaagagaaagaagtggacacgtgcaattggaccaaataacagaaacaatcaaccatagccgaaaacgtggtcagaacataaaggaaagcactaaacactcgaaatggcaggaggaacaaacacgggcggtgacacagaagaagagtaggatgatgattaccaacagcagatgtcctatgaaagaacgaagctataaaaaaaacaaaacaaggaaacatatcattggaacgaatataaatataaaacggggtaaaaattatagaacaacaaaaaaaaagagataggagaatgtgcatttttttattccaaaagaaccaaatagataaatcaaatgacacaagcacgatggaaacatataatcaatgagaaacaaatatcccccgacgaacaaaaacaaatcaaagcaaaacgataagaaatggtaaatataacaaagaaaaaaaggcaattaccaagcaagaacgaaggttcacatgatgtgatgaagatggcgtacgacgaatcactgccttgtgatgagctctagcagccgatgcagatggcatgaaccaatgaaaccagcaacagcaccaaaaacctgacaaaaaaacatgaaaaaggaccatgacaaaacatgaacctgaactaaactaaataaaatgaaggggacaaaaaaaaagaaaaggaatgggaaagaccattaagagaacaacaacaacattgcaactagggtaactatcacgagaagccattcagacatacttataaaatgagagaaggagcaggaagaacgagaacgtgtacaggcatgcagcaaagaaagacatgcacagtgacacctaatcaactaacagtaatagaactcgccagcacacccacgcaaaacagagaagggatcgcatgattgacacgcaaagagatggatcagcacaaacaagacactataataatcaattttagcctctataccccaacatatctgtgtattccaaaaaaaactcacagaaaacaaaattttatcttcttcacattatataatcaagaaagacaagtactaaacgaaaaaacaacaagacacagacagaaagcacaaaggagccatagtgaaatagaaggaaaactgaaggcttaacaagagagagaacagagggagttaaccggaagaagccgtttacaataaccagcacgcgtgtgtaacacacggcgctaatccaggagattaaccggacagccgtgattagccagttataaccgcgggcacgaggaggcttcaacgcaaaccagcgacgtgtaaggcagcgaaatagccagaaaacaattccaaaaaaatgagaaaaccgggatagttaggagaattatcattaatcatagctgaaataactctgtttaacaataagaagaagaaagcatttcttggtacctcaaggccaaaagcaacattttattcttacatcagcactaacaaacgaaaacatccacttgtgtaagatgaataaatcatttttccccaactaaggtaaaaagcacagaaagatatgcatggttaacatactaatagagtgacgcatcaatgcacagtgctcaatcaagtcgaaaaatttcagaaaggtagcacaagtgctagtgcaggaatcacactaaaagcaactgaatcacaaagaacaaacatcccaatagaagacagaagctgacacatgtaaatccagggcgaagaacagacgcgtaaatgaaaagcaccacccgaatctctacttgttttgttggtcactgctacctgaggagaaaaaaaaggcattagcccgcgaaggcgatgtgttcgggcagcgcaatgcccaagccgcacggcgacacagcactagctgctgcagcaaagcaaaaccacacccacgacgccgcggcggcagcggcggcggcggtggcggaaaccaaatgaccggaagaaaaaaaacccaaatggctcgcccgcgatcgccggggcggctgctctcaacctcgacggcaaaataagagcccccatcttacacaagcctctcagttgagccccagaaatcatctgacattcagccacattattaaataccccctgaattcttatagtttccccatgttcttcatactctaaccatttctgcaaccaatcaattttcatgacccccagcccttccaaccaatccatgcctaatatggcatcatacccatttagaggtattagcttaaaattggatcgatagcatctaccttgaagccaccaacacagtcaggaagttgtttatcagcaaccctgaccttaactggcggagttgtggacaccactcctggaaaatggtgaatcatctgttcatcgacaaatgagtgggtactcccagagttaatgagcataagaagttcagtgccttgtattaatcccttaactcgaagagaatgggctgaatcagtgccattccaagcatgaactgagatggtcatgaggttgttctcctctgggttagactcaaggattgtctccaaactgtctgtttcttcctcaagttgaaatgcctctaactccaccacatgcaactggacggtctgagcacacttatggtccttactccaacgttcaccatgggtaaagcataaccccttagaacgtctataagaccttaattgagaaaccttgtcatccttgggagtagttctggcagactccaagattctcttttcctctccaggcgttgccacaggactcttctgacatacagtgccctgaactggtctagtgaaagccttggtgaagctagtaccctcagccttcctgaaagaaattttcttattcccatccaagatttcctcctgaagcatagccactgagcaagcagcatccagatccactggtttctgaatcatgaccactcctctaatctcatctttcaatccatccacaaacttggttaaaaaataaggaggggtgagagcattatcataagaaagcaggtggtgcattaagttgtcaaacctttcaacatactcagctacactgccagtctgtcccacatgaatccattgccttatcagggttgcctgtctatctctggtgaacttatgacagaccatgtcacacagctccatccacgaaatgcccaccatctggtgccgcaccgattgcaaccaaaatgaagcattaccagtgaaattcagcaaagccaccttaacccaattggctggatgcacaccatacacatcaaagtaaatttcacaattatctcgccataactgggtattctcaccatcaaattggggacaagacatgggggggacattaccaccgttgctagccataccatagtatccatatgctgatgactagaattttcaagagtgaaagggcttgcagaagtgaactgaggaaggcgatttccctgtggagtaaacaggaaaggatttggggaattaccattgagatcatcttcattcaacatctgactgggtccttggctgccttctgccttgaacaacaccttctgttgaacatcccgctggcacttctccaaccctgcctggatcgagttcactctctttgccaaatcgctaacagatccccccaactcgctcaccttctattccaccatgggtatgcgcgattccaccaccgccttcaacgactgcagctccgctagattcaacgcatcggactcctcccgtctcctccctcttcttctctgcatcctccatcatcttcaacaagagatcgagcttcccttcttgagccatgatttgagctgcttgtttcgtgatatacctaggtcgctccaggatgaatttttcccggtttcacctcgaatccagccaaccagatcaagggagccccaaaagcttttgcggaatcacactgattaacagcgaattcccacctatctaatggaattttcacgggcggaccaagggaatcaatgaaaccaggaaaggaatcgagggctctgataccaattgttagctacctaacaagaaaactgaacaagaactcaagaacagatagatcaacggggattccaacgaatttccgccgtttccgccgccaccaatcgccgcggatttctttcttatcatcgatagccaaaaacagagttttcttccggtctcacctcaccaaccctcccattacaggccaaaacataggctacacaataacacacgcttacagagcccattccggcccagacaaacgaacattagcctcgcgaagttttctttccctcccgccatcagcttccttctgcatactacttccaacatcctggctatcagcagcaggcgccttaacagttcaccgcgggaggacgccaccgctgggtcaccttctccgttgccaccgctgtacagacctctccaagctgcggtcaaggctcggtgagcatcctggacacccaagaaccccatgcatacactccattcacttagaaactgcctccaactcgacatgcacgcacatccgagatcttccaccgctcggacccaccggcggcgctcctccgatgtccactaaccgaggaaagtagaggaatggaatcgcaatatcatgctcttcatttcgtcttttggtcgcgcccccaaacgagtcaccatttgttgccggcgccggcgagcagaggtgccgccatggctgctctgctgctagatcgatgggagaagaaatcaggacttcactttgtaaatttaacaaactgtagagtcttttcctcaaaagcacaagacacatagtactgttgcaggacctattcgtaattattaaaaacaggaaggactcttaatgaaaacagctattcaacaagtgctgaattgttcaaatctactttaaacttcaaaaatgcataactaattcatcttaactccaatttaggtgaaaccaatttctgtagattcacgaaaatatgaacttaaaagttatgacataaaaagtggtactcacagtatgaaaatttatcactaaaactcatctaatttaagtcacacataaagcatgcacaaacttataaaatgcatataaaattaatcttagctcaaattggtgcaaacttaatttctatagatccaccaacatattatctaaaaacaaagtaaaataaaatatgtacatattttacatcaaatgccttaaaactaatatctttaaaatgactagatttagataagctgaactttagaaattcatatagaattcatcttaactcctttttgggtgaactcagatcctatagaatcatcaaaacatatacttccaggttgtaaaataaaaatatattcttactctataacaatagcccttaaatatttatataaggaataaacaacctagtgtacatttcaatttgtaaaatttgtagaaaattcatctttaatccaaatgaagtgaaccaaatttttatagaactggcaagtaatgagcttcaacatagtaaaataaaatatggcagcttctatacagattatagctctaaaccttaataggtaacctaagagctaatcacatagtaatggttaggcattatataggtgtagtggtatttaaatgcactctaactaaattcaactaaaacttaatagaccagataaaccatagttccattcctatgcatcaaaacttatcacacttagctcatacataaactacttctagattagcatagtgaataattaacatagatcatgcccctatttataaaacgtgtagtaaaatactaaaaactctaaaattatggaccaaagttaaattagttaactcaattactcattttgtacatcactggcaagatggaacaagttatggacctagaacctctatatcatacactatagggaccatatgcctacaacccgttacaacttgtaaaatacattagaaattcatagaaactctaaaaattgtgaaaccaaatgtgttagtcttagagaactcatatattcaccccagcaaactcaaatataataaatatcaccttacaaaagcatttcatagcagcacctaagcaaatactatactataccgataaaacttctaaaatccataactctcaaatggaatgagataaaatggaaattctttcacctaaattcagtttaaaccagcacctacccactgtgcacagatcatgcattttagagcattttggattttccgcatatttcggtgtttaatcgcataacatgtaatttatatagattgtcgcaataacggtgaagaagtgaattaggccctgacttttaccattaacaaggcaagtcccacctccctctctttgaatacattgctcctatgttttggaggttattgaaaatgtttgcaaatcctgcatgtcgattgtacattaatacgctaaaaccttgtaaaacttgttagaataacacctattgattgcattatcacttgaactccacatatatccataacctacattcttagccctagaaacaacaagactttatctttatatatatgagttataatgacactatgatactacgatgcttagccatgcttagtatgattttacttgtcatttgggatcatattaacatgaaaaatgattttatctaatttctggacaaaaatgaataaatggagaatttgagaaacaaaatgatgaaaaaccatgaattttaagtttgggcctcaagtggtacacatgtgttgattagttgtataccgatagggggagagtgtgcccaagctacttaaggacttcactcaatgtctgttcattatgtatatagtacaaccacatgtgctagttatgggatagtcctgtagatggccaaaaggcccgaggcccgacggcccggcccatggcacggcattttggcccggcccaagcacggcacggcccgatggaggtcgggcccgtgctggcccggtccgaccaccgggccgtgcctgggcccctccaccggcatgttgggtcggcccggcacgatgtgccggcagctaggcccgatacacaaaaaaataagggagtaaaaatagacatattatatgccatagatgaaagaatagg

SEQ ID NO: 17945 - DNA, 2022 bp, Oryza sativa
catgcctagccatggctgggccgggctgtgtcgggcgggccctttggccatctatagatagtcctagcttagtaatctatttatgatttagccttacattctagtaggctggtgtgtatgagttagtggttagctcagaggagcttcctgttacagctgaggcagtagtctaggtgactaagcgtgtccaatacaacggtattgtgccacgtggtgggtttactcgagggtagttcgtcaccacggcgttaagtttaaggcgtgggcccgccacttaatggttctaggtcatatttccagtatgcctaggatggaggaacgcgtatacccttgaattttgtttttgatcttgttcatacccattccgttagttgactgtttaattcccttgaaaaggaccattttgtccttagacatgaaggaaacatgaaaattgtaaactactcattccttctcaaattgatcatcatacaatagaattcaaaatttctcaaattgatcatcctataaacacatggacacgaatttcatcaaaatacaattaatgcagcatgagagaaatgtgtgcatgctaaggtgtaattgggatgatgttttaatcgatacatgcattgcgggagaatgtgtgcatggtgtcttgattgatatggtttaaattattcttggtcttagtgcataaacttatatgatgatcaatatgggaaagagggagtataattttgttacataagactactatattcatgattttttgttgtacaaggtattattcatggcaaagtttatttttacataatgacgtaaaaattaatatttatttacttattaaaacagtatatgtagcatttttatggtagttcaatattttcttttcccagttgtatatattatatagaaatgctttccaaagctatgtttatcgtttataaaatgctgcacgtacttttttaatatatattaaaatttttatgtacaacaaacttatgaatattatggtcacaaaacaaatttctatacttacatcaatatagtccataaatttctacatattccacatatattgaagggtaaaactgacttttctacatgtattaaacgggaaatttaactatttgtcacatttaggtttttcaattatccaaatacccttcttatatttgctcatattttttgcccatcttagatggtggcttcttaactatttgccactttgcctatgtggtatgccaaagtggcaacacaagagaaaaaacagtgtgggacccgcttgtcattctctcccctagctgtccagccggcgacgccagcgaagaggccaaggcggcggccggaggaaagtttgacggccgcggcagcactctcctcggtgcacagagtgggtcctcgtcttcctgcaagttcaaagaaaacgaaaccccttcgttcgggagcgcgttttgatgcattcatccagtggtgttcaccatcggaggtcgccgttgtcatttctctctctatcaggaccatgttgttggtcgcgtttctgcggttctgattttctttattgccaacctccatcatcaatggatgagtctaatcgtggggcacatcctaccatagtccttattaccgtttgatcatcagagcatccacacccatgttgagtattacgagaacatgagtatactatatatgcaatagtggtttttattcatcctaattatcattaaaatttctaatcaatacttagcctaagaaataatttatctgtagcgaagcatgtgtatttcgctagtacagtcaaaataacatatattttgggaccgagacgatgtttttaatttttttttaaaagaagttcaaacaatttgctaacaatcagccaaaaaaaaatatccgccgacctggcccaatcaacgcctcccctcatccacaccaaccatctgcgctgcgctccgcctccaccgccgtccttctcctctctcccccaatcaccgcccacgccacccaccaccatggcctcctccgcctccgtttctcccg

SEQ ID NO: 17946 - DNA, 19030 bp, Oryza sativa
  unsure (1)..(19030): unsure at all n locations
ggtgggctgttgcaggctggggatgtggcgttcgaggtgcccatgtcgctcgtcgtcacgctggagagggtgctcggagacgagtccgtcggtgagtgctcttgtgatctattctagtgttgaattctgtagtttggttgctttggggttgagaggaaatggcgatttttttgtttcctggatgcacatttcacagtatatgacctgaatttagcactgcaatagtcctcctgttgggggcattttgtgtaaatggcagaatctggttttaatttatctgatgtccaccttataagtacaccgaaatcagtaaagtatagcttcacttcaaggaattcataattgttagtaagaagtaagatataggttgaattagttgactttgttaagtaatcttctatctgttcacttcaatttatttcaaattttcaataccatgtagggcactggatttgatattgttaccatcaatattaatatgtgtgtgttttgaggaatgctttttgaatgtttttaatccgtgttcaactggttcaagagtctgaatctgccggtttgatatgcaactttagctaatcatatctttcttgcgtatcttcaggatataatcaagtattatcaatctctctttgtgtgaaatgttgtgcattgtaattaaacaatgggtttatagcaatttcatctttcaaccttaggtgctgattcgaattttctctctttttaagcagtctcttcacgagattgcattttctttactattgcatttgtcataaaaggtaaggtcacaatttttaataaattaatcatcaaacaatgttagcatgagagtaatataagaaagtagccctatgtttacaactttgttaaaaatagtttaatgtgaaattgtggatatgtttacattggcatgatatttctgttagataggtcttccatgcattatttcttcagtccttgtatatttgtttgctaatacctgatctgtgaaacttatttgtggtttatgtctgtccacttgcgctaacaccaaaagaagaatatggaaattgatatgtccttttcatgtatggtatttgttttcatttttgtactatggtaaccagctgatattttgaaccatacagctgaattgctaacaacaaacaaattatctgagctggcatgcttggctttgtatctcatgtatgagaaaaagcaaggacaagattcattttggtatccttacattaaggagcttgatcgccagcgaggaagggggcaattagctgttgaatctccacttctgtggaccgaaagtgaactgaactacctgaagggtagccccatcaaggttagtgttttttcctatccactatatgtcaatatattatgagcacattttatgcagtgtcaagtaatatacaacttagattttctaatatttcaggatgaagttgttgcaagagacgagggaataaggcgagagtataatgagctcgacacactgtggttcatggcaggttcattgtttcaggtgctttcttttgaccttccaaaatgttcctgtctctgggattctgttgcactagctgcttgttgttctcatgtcaactgttatgcagcaatatccttttgacatacctaccgaggcttttccatttgagatcttcaagcaagcttttgtcgcagtacagtcttgcgtggtccatttgcaggtaacataatgagcaatgagatttcatttatcaaaaaaattagatattaccccgattggttgttggttggtttaaataattatctctggtgttgaactgaagtttaagatttacttagagtgtacaccatttatgaacagaacagtttagtgctaaataccttgcccatataatagattatacaagcctcgcagtatttttgtcaaattcaataaatttggaaatttgcttcttcaaattatgtagatttgttctgtaagtatttttttttgtttcatatgttttatttgcttaatacttcagtttgggatcaacagttcatagcatgccagccttttattttattactggataaatactgaacctgctcgtcgctaagttatttttatttttcattgaagaacagaaagttagtttagctcgaagatttgcgctagttccattgggcccaccactattgacctacaagagcaactgcaaagcaatgctgacagctgttggtgattctgttcggttggttgtggatcgaccatacaaagcgggagaaccaataatcgtctggtataatattttcttcagatgcattaaaattcttgttgtacctcatcatatttggcaacttcagtgcttatttactgtttgcatatttcatttctgttgtttgtgcatctccactgtaacgtcaagctatgcaaattgtacaggtgtgggccacagcctaactctagattgctcctcaactacggttttattgacgaagataatccatatgatcgtatagtgattgaggtggaatttgttttgctattgttctacattcatcttcttattggatttgtgtaagcaatactgaatcattgttacaggcatccctaaacatagaagatcctcagttccaagagaagagaatggttgctcaaagaaatgggaagctggctatccaaaatttccatgtgggaactatgatttcctttttcttttccatttggaatgcaactacaaatgttgtatattgacatgccttaggtgcattaggtctgtgtgggtaaagagaaggaaacaattgcagaaatgctgccctatttgaggctaggatacatttcagatccagatgaaatgcaatccatactttcttcagaaggtgatacatgtccagtaagtctacttgcccttaattggccttactattagaattttcagaattttcagttacggttagaatttttaattacacatatgagataaaatggagcagggcaaggtgacagtgtcgtacattgttgttttatttattacatttttggggtcattatgcttgcgcagttagccagtttatagtttctgccttttttctttacaagactccaaaagcactttccaatgggctcagtttttatggggcttctgcctttaaatattgcttcaagccttgaagacccagaagtattgatctagtgtcattagtcattactatgtttgtaacaaattgaagctagacaaacaggcatttgatctgaagatcttgtgttatgtgaaatgcaataattacatctggttgaacatttaggaagagagaacatttcacaagtagataatttggaaaatgcctttacatttgaagctttcttttaggccatcacatttgtcattccaggtttttaggatttcattcaagttataagttcatctaacccattatttatttttagtcgggttgatctaaggtgcagattgttcaaaactaaaccggcttgctacaaagcaaatccatcatacatttaaagtgcaatattttgccatgcaaatatcccacagtagcatgtagggtttccattgagtttttatggaagttgagcaatggttctaaatagactatgtggtaatagtagtgttatgcataacactgtgtaaattgtgacatgtttccaactatgattataggtcagtccatgcacagagcgagcagtacttgaccaacttgttggatacttggagtcacgattggctgattatccaacaactttggatgaggatgatgctatggtaacgagttgcaaagcactatgtgtatgtttttttgtaaaatctctgatacgtaatgtaatgaagagcatttcatttctctggtattgggcagttggcagatggcaatttggaaccaaaaaaggaagtcgctactaggcttgtaagattggagaagaaattgttgcatggttgtctccaggctgctaatgagttcataaatgatttgcctgaccacactgtgtcaccttgccctgctccatttgctcctgaattgaaataaggtaggcaaagctcaataagttttcactgcttcccaaagtaaatttattagaccgtttactgtgtaccatgttgatgtaattgatctaatagactgaattttatggatgtgcagaaaagtaaagcatgcagcgagcattaattcttgcaacatgggtgtcacttctaatggtgttctcattaatgatcacatccagttgaagtgcattagaaggtaataaatctgataaattgttactcctttaaaatacattcaagtagtaggatttaaaccagtactaatattgctctggtattataatttttttattgttagaagtttagaacctactgaaagtgtgtaactgaaagataaaataccaaataaaacttatgattcaactattccattgttacttggggtacattctcccaacccttgccgtgcttttttttttcttgttgtgcgcgaacaaaaaatttaggaattgtctatgaatctctgaatattttttttctatttctgaactttcttaattttaaaatttaaaaatagacccttctaaaacttatttccaaaatctgaaccttttaggcacgcgaaccagggtggcgtcgcaaaacaacactgaccccacccacagcgggcgtgatagttttattctaccacgccaactatggtggtgtggcaagacaatgctaaataatgctaccatgccagccaaactggcgtggcagtattgtttttcctactgaaagtattgtttggcgtgaccaaaaggttcaaatcttgaaaataagttttggaagggtttatttttaaaattaaaaataaagaaggttttaaaaaataattcctgaataattggtgaagataacaacatagctatgtcaatggtagtcaccacacctaaatcactcaatactttttaacttaactaaagtagtttcttgagcataatttagctacttcatttcttcctaaaaatagttcctatagttataacaggtcatttggaacataaaaatggcaagaccagaataagaggcacaggaaatcagtaatgcaatgacagaatacaggaatgccctctgtcctgtacgcaacacaggaaagcatagcatggtaaaaatagtcccatttggtctgtgccttgttccttagtggttgggcactgtaaattaaatggccaatttttgacctataaagtagcctctattctctcttatcccagtcctgtcttttgcatctccttatccctcttctcacctgtgcaaacttgaggggagaagccagaccatccgctatgctgcatcaataactttggctaggttgcactgcaacacgcacaacagtaggagtatgtactgtgtagaacttactgtgagaagtcggatgtgtgatcccaggtcccagctgaataaatttctctcttttttttcattttgaaaaacatgtaatttgcagccatatactgcaatcgatttggggaactaaatttaaaagacagatgcatgaatgaaccacaacaagaaatcaaaatacagcagcaagaagtatctgacaacatcacaacaaatgagcaaatcgatttcatgattcatgtgcatgatttgagaaatcaaaggtagacctctagatctgatgcaaagacaacctaagcaaagtatgctgcttttaatgatcaagcatacgtctctgttccttggtgtcactctggagaatggctcgagaccatcatttctcatgggagccctgaggtaatgccagaccaaggcacacagctgctgtcactgaaggtggggatggatgacttagtgctggagctgggctgctggggaccttcctgaactggccaagctgaaaagtcactggatctgtatttgtttttggtttgaccggtggtttggtctgtctcttttctcggacatagaatagactgtcttggatgttgcagtgtagacgggggcggctaatgggcgggtgaccnncccaggcgatcaccccccatcccccctatacactactctctttcttcctcctctccttcttttcttcctactacaccataaattttttaaaaataaaaaacacaaagttgaaaaaatttatgtatagaaatactatatataaaaaaattgaattcaaattcaaaattgaaacgggtatgtaaacttttgacttataaactttgcgtctataaactaatatttaaattcaaattcaaatttgaaccgggtatgtaaacttttgacttataaactttgggtctataaactttaggtgtataaactttagatgtatagaaatactatatataaaaatatttgaattcaaattcaaatttgaatcggatataattcaaattcaaatttgaatcgggtatgtaaacttttgtcttataaactttgggtctataaactttaggtgtataaactttagatgtatagaaatactatgtataaaaaatatttgaattcaaattcaaatttgaataggatatataaacttttgatttataaacttgaggtgtacaaattttaggtgcataaatttactaaaaaaggaaagtaatgcggtgccaaaaaaggaaaccaggtggagggaggggattgatcgatcgccgggtagcaatctcgagtgtagactgtggaccatatttggtgtgcattgcttgtttagtgtgaagtggtaaagataagggcacatcagcagagtgtagactgtggaccatatttggtgtgcattgcttgtttagtgtgaagtggtaaagataagggcacatcagcagttgcgtgacattatgtcggtggcatcatatagggtagcttcccaaaagttagttgtttatctgttctttcaaaattttgtaaatgaatcctcagtagtgcttctttgcaggaaatctgaagcctggctgacgggtgtaatagggatttcactgcccgcatgcagatttggcgattagttgcattgcacacaagtgtgcacggatgttttgttaacctagtggcttttatattcactgagtagattctgtacattctgatgattgactgagatggtaatgccaatgtacatgttcagtctcatttgtcaatagagattctgtacatgttatatttttgggtgttggcatgatttccgccgttctcttttcatggcctgtttgatttttagctgtctgactacacagcagagaattgtatgcaacagtttactgtgatggctgccaaggaatcgcattcatttgaaatgctccaccatttttctgtctacagcaattagtctccctaccctgatgattaatacctttttactgggctgatttcaaatctggatgatccacaaagcatgaacttgagaacaaatcgtgctacataatttgttttcttcacattctgccactactgattaacagatggatgaatcgtgatgatgaaccatggcttgatactcgcgggacgatttgagagcccggtaatattagcagagatgataacagaaaggaagaacttggagtaaatttaggtgtcagtcattttattgatcctttgctggatgaagaatgctcctgtttaactctctgatggaacatgcccaacgcagtgatacaactacgatccttcaaacaaattcgtgacaccaccaaacaggaacaggtcttttttatagtccactcttacaagcagtgtaagtggtggcagctaaacacatttatttcagtgggcctcaaaaaccaataatctcatttaattcttttaatatcaatttttgtttgtgcatctccttccaactctctctctctcacacacacaccatctatgagatgaaataacatgatggcaagaggtccatttcccgagagtaaactagacaagagttgatggccatgctactgagtgcctgagagtcgtttccatctgattatcctatttcatttccccttgctgaaatcctctaaatgattttccttttcttcttgcaatataatgcatatgtacatgatgctcgaccacgaagtctgaccaatattggattgggagccaacaggaaatgataaagcgatttagccacatgtcgcacatcttagtatttaagatcaagtctccttgtggggtgaacaactcatgagtgaacagtggcttgcgctagttcattgctgtagtgatgatacagattgaaaaaacgccggctgggagaatgaaggcatcttcatctccatccatactcttcagcacatggattctgggctgataggattctactacccagcagctgagcatatacacatggtgaaacacataacattttcctctcattagctagggaaagagcttgaatgcttgatgcatctgcttggcctgagcatgctaaattaatccaatccgttatcatgttttcttcctcttgtaatgtattaagttgcttgtcgcgtgcatgtaatcaagtaaaaaagaactatactaattggattggaaggcgcagtgaaatgttaataaacaatattccacccaaatcatgagttaaccatatcgattagttcctcggcattaaatccttacttaattagttgcagattgatatatcatgcccatgcaacatgatttcatcctcacctttcaagtaagcatgtgtggctgcattgtgttatatgtgtaaaatggccaaattcaagaggaattgagcggatttgttaaactatgtgaagaagaattatacgatacatataccagaaccatgcctatgggttgataaattatctaaaagtattggacgttaaagtaaattttcaattaaagtatattaaacaagacataatttccccgcaaaaaaaaatcaacacatataattatgcaccaaagatgggtacacaagctacctcattttgtcttgttagaatctttaagaaattcgtccagcggagaattgatttacgcctgtttgatttttagctcagtctgactacccagcagagaatagtatataaaacaaaaggagtaaattgcattggtagtacacaaacttgttaattgcgtgtaatttagtacataaacttataaaatactcgttttagtacataaacttgtctatttgtgcaaacgaggaccaaaataacttgccaatgttgattttacgaagttgatgttgattaggatgtgatgtacacgtgtaatgagtatgaacactgctatatgtacgactgctctatccgaccggtgtatgacggaacggcagagcagcacaatacttaacggcgtaagtcggaacagcaccagcagcacagctcttgacgtcgtgtaatacgcagtcgtacgtcggtcggacacttaagtggtatgtatagcattttcgaatgagtatgcatacttacatgaaaaagtttttgacagcgtatatgaaacaatttactgtgatagctgccgaggaaccgccattgatttggaatgttccaccatttttctgcctccagaaattggtctccctaccgtgatggtaaataccatttactgggcggatttcaacatctgagtgttccacaaagcatgaatttgacagcaaatcactacttcgaaacaacacatcagtatcggttcgacaaaacctaccactgataatggtttttcatcctataaaacactcgcactagcattgatgagaagataccagtgtcggatcatataaacactactggaaaactgatttttcatgggtggtgtaaaattcacaataatcccggtttaaataggaaccgagactaaaattatttttagccctggttcaaaagaggcacgacactttatgatctttagtcagattggtgttatcaacctggactaaatatcatttttagtcctggtttaacacgttgtcaggctgtgtcaagccctccactatttttagtcccggttgtttataccagccgggaccaaagattgaaaaaaaaaccgctcccacacgcacctcctcttctccttttgtccttatctccttgtgctccccgtccttagtctttatctcttcatcctcgtcctccactcctcctctcctcccctcgatcccagccgcctccccttcccggccctctccgaggcgacctccccctcccctctccttagatccctcctccccttaccggccctctccgtcagccggcggtggctggcgaagccgcgtcagtggcgtcgggcggaggcaggcagcggcagacggcgggcgcagccgcgtcggcagcgtcgggcgaaggcaggcagcagttgggggctagtgacgtcgtcggagccgcgtcgacggagccgcatcggtgggaggaggcaggccacgggcgtctatggcggttggtggcgggcggagccacgtcggcggcggcgggcggaggcgcgtcggcgggaggaggcaggccgcgtcagcggcggctggcggaggcggagcctcgtcggcggcggcgggcggaggcgcggctggcgggaggaggcaggccgcgggagtcggcggtggcgggcacgattcggtggtgggtggtggcgatttgatttgtgaggtttttgtgaatgtgttgtgatgtaacatttgatctgtaaattttttatttcaatatgatctgtgaatttttgatgtcaatttgagtatgtttgaatttgtgatttgatgatttgtgatgtcaaattgagtttggtgtgaaatcaatatgcaaacaacaaaaaaaacaatgaaaaaaaataagaattttagtccactaaaactgggactaaagatgagtatatttagtcctggattaggcgtcccggttgtatactcggaattgaagggagttacgaattgggagtgaagatggtttctccagtagtgaaacaaccggcactgattgttccacgtaccatcagtattaatttataagaacattgatactgataattaaccaatcggtgtcggtttaagtcgcttggagtggatgagctggcgtattggtgggaaaagtcacctgtcacttatggtcattacttcctctgtccaaaaaaaactcaacctcgtactacgatgtgatacatagtagtacaacaaatctgaacatactctacgtccagaatacaagcaactgctattctaatgattggacaattatgacctaaactggatgtgtcagatccaactctcatcatgatggccaagtggaaataacccgatctctctcacatacttcctccatctaaaaatgcaacctacaaggagatgtgacccctccttcttctagtacaataaatcatgtgacccctcctagtacgacatatctggacaacgtatgctcatattcgttgtacagtaggttgaatttttttgaactgagggagtatgcaatcagcgatatcgaggttggacagtatacttgataaaaaaaaagattggacggtgcaggtaacgtgctattacagaaacaaaagccgaagcgaacgaaatcaaacagctgagaaactgattgtgatcaaggagattttatagcgacttaaatttagtaaatccgattcctttataagttttgtttgtgcaactccttccaacttgcttatatatacaccaccatctatgagatgaaataagctagaagagatggtggtcatgcttaggtgagtgcccgagtgtggtgtatccatcttattatcctatttcattttcccttttgcagtagtccagtaaaaaaaatgtcctttcttcttgcactgcataaatatgtgatatttgctcatgatgttcgaatcatatgggattggaagccaccaggaaatgataaaatgatacagccgtatgtgttgctcgccgtgtgcatgtgtttcacacatcttacctagtgaaaagtaaatttcaaaatgctactaggatgagccacatcatcaggtgaacaatagccattggatcgacaaaaaaataaaatagagagaagagagttgaaccattgattatagaggaaaggaaaagacgaagaactttcgaagctttccagcaatgcggaacgcgagagaaagggaaaagaaagaaaagcagtattgaaagagagtgggggcgttggctggtttatggcatgtgatataatttgcactatgcacactcagtaaaagttattttataaataatccttcaaaattatttataaatggactcttggcttataggctcatatgttatctatagataatccttacaacctactaattctaaattatcactataacgttaatatcacaaagtttgttatcacataaacatctaataaaattttctatgattttaatgttgtaccctggatcacctctttagcgtaaaagctactccctccatcttattttgatcatctctaaagagcacaaaggccaatattgaaattaattcgtatccaataaggtgctctatcgtttcattttcaacaaaaattaattcacactttaaatgttgcatgagttgagccaattaaaattaatatttattggttgcatgcatgcagggcgttgctccatgcacatttactctttacacaaataaacaaagaaatactttgttaggtgatgattattttgggaaaacctcaaaaatctaatgtgatgatcaatttgggaaggagagagtgataggtggggcttaagaactagtgtttcatctatacctgttgctttcaggtcattactgatccattacacttctcccaagcacatacttaacaaaatgaactttgtttactgatgccaatttaaataacatgctcatatacacatataacatgatggttaaagtcgtgcgaacgtgtgacatcataggccaattcaaactgaaaggtttgaagaaggttgcaacaaccaactatgccacgtcagatagacataccaatctcacctatgcatttaatgtttttaatcttaaaatatgtgaatagctagctcttgcatgagacccaattctctttattttttaattttttcttctccacataagtttatagcctactattatacttgctctaggaggtgagctaggctaggtactatttggatcgggcttttctttcatgggttgcatcgggagctagagagtagtgcaagcaaccggcacatcgcatctttatttcctcgctcctcatccgcagcctcgttttctctttcctctggcaccacagtctaccggcgatgggccgacctcgagccagtgacatcgcagcctcccaaagaatgagatgctcttcgtcaacctcaagggaatcatcgctgttgctgcttgccacagccgatccaagttcatgctgcggctaacagtgtatctagaatttaggatattgatggtccaacttaaattttttttaaacaccgtagatctaatgatgctaatatataatacaagtatagataatgaaataaaccaaaagtgtaccatgataaataagacatcttaaaatacataaaattagtaattaagtaaaattttgacttatatggacaaaaaagtttgaagaagattaccatacttcttctagcttcttcttatcgggtctacgcaatatctctatctttctttatttttaacaaccagtaatctacaatatagtactaatatcacaatgctcattgcacaaaagttaaaatcttatatagtgaaagtagcaagctttcttgcacaaggatgtgccacatcattaaaaatatattagccgtcggataaagagttcggataaataatggtcattagatcgaaaaagtgtatgtattaaaaaaaatcacaaatgagctaaacatatggaaatttttggaggtttctgttatctattgtcctagccaagtatatatactttgtaaacaaattaacttatattaaaatcttattaagggttaaggtaaactaatagaccatatataaaagttcttaaacaggatcaaaagtcacgcagagcgcgactatatgactagtttaaaactgaaaattgaaaagggtaaaaaacctaaaattgaaaaatcaaagtcatcccgtcggccgtcgcggtcttgcggaacagaacggagagagtcggagacgcgcgcactcgcagccacgcaggccggccgggcaccgggcacgtggtggcgcggcgcagacagcggctggctgcgggcggcggcagggcgggccggcggcggttggagtaggcagcgtcagttaagccgtcggccgtcgcgtggttggtcctcactcatccgttgcgaatgcgatgcgtgcagcggcagcgagaggtggtggcactcagcatgcggcgtagcagcggggcggccgtgcggcgctcggcgagtcggcggccggcgctcgcggagtcgcccgtcaatgaagccgtcgccgtgtcgcgtactcgctttgcctaactcgcgagtcgcgtcgttaatcatgatgcgatacaatgccgcgcgtgagaaatgaggagtcgacgaggagaggtgcgtgagtgcgatgacatgtcatagacagtgagtggtaaatcattaattggcacatcttaaaagtgacaaataatcaaatgtcccgatcattggagtcattgcaggcttacagctcaccgggttcactcacctcacaccttcacccgtataaactaaaaatgtccgttccaacacctacatggagaaggataggatagagaacagccaacactatgataatagcttaacaagaacatgcatatattggggataaaatgactccactgccaagaagaaatcaagccatgtccagaagcttttattccattcaggattcagctcatcatttcataaaaaaaaaagaaagaatggaaaacagcaaggaacatgcatgtgattgaatcctgattcccctccgcggttgccttgcctgcatgcactcgatcagcagcagcatctgcagtggcgcggtgctcgctgccgcagagacctcatcttggctttggctccaccgatgagccgtggtgtccccttcactttcttcttcccaagaacgccatcatctacttctgtgaggctcctcttttgccctccagaacaatcacaaaccaaagacttgagtttacggagcgctcctgctttaagtctagagagttcttcaagtttatcggccttgcgatttatggaataatatagtgagcaatcaactttttcccgtgcatcatctgccgcagcatctgcctcctctatctttcgtaccacatcagctggaaaacactgtgtcaatccataaaaaaacacatttatttgttttatctatatatttcataaatattttttggttgcgaatgttaatttatacagatatgaattcatctactaccttggagggtaaccattttaccatcatttgaggggtcagaatcatcaccataacatttgcatacttcgcgtgatccttgataatcgtgccaatgccaggaacaagcttgtcacattgctcacgcagcatcttgccgtatgcatttagcagaacatcagctcgacacagctcaccagcacaagctataaatgttcttctatcaatctggatggatcaacatgaacatgataaaagaaagcattacagaacttggtcaggctgtaaatgacaattgattcaaagcagcatcaaccatctctagccattaaaaatcctggacttagaaataaaccagacactaaccattctgaattcatgaatgaataaatttttcaataaaaaattgacatcaattagacacaatagagatatcaagttttgttttctctgggtcatcgggccaaccaaaaactcaattaattgaactaggtcagaattcaatgaaaggaaagtgtgataactgataactactgtactagctaagggcaagttttatagtaaggacagttgccacgtttaattttatctatttaagataagatgtgatatatatatatatagacaatacaccacatctacactacctccaacatactaagccaaatgattttatttgtttgtccaatcccctctttctttcatctcatttttcttagggtttgtatggaggttgcctctaacatgaggtgtggctcacttactctttcctcacttaggcccggtttggttcccaaaaacatcacatcgaatctttagacacatacatcgaatattaaatatagataaaaagaaaaactaattgcatagtttgcatggaaatcacgaaatgattcttttgagtctaattagtccatggttagccataggtgctacagtaacccgcatgtgctaatgatggattaattaggctcaaaagattcgtctcgaggttttcaggaaagttatgaaattagttttttcattcgtgtccgaaaaccccttttgacatctgatcaaacatccgatgtgacacctaaaagttttcttttcgctaactaaacaatgccttatttcttccacctcatcatccaattctatttggtatttttagaggcaacaaatcaaccattacagtacttgccctaaatgacccacactatgctaccaccattggtttcagtgtttcactacttggatccctacacatacagcataacaactggcacaacagtaagtctgaaattaagcagaaaatataagggtgcacgctagaaaagggcacaactgcaagaaagctcagttcttaccgttattttggacatattgattctaaatttagtcatgcaatcttttaacacttgaggtaatgggccaagatactggctagtgatgttttccctttctgctggtacaaattcacacagaagattccttaacccccacatcagttcaggcataacacgggtggagaagtgctttttactcccggttcgtaacccccctatagtcccggtttttcaaccgggactacgaatatgggactaaagatcgctatctttagtcccggtttaaataaccgggattaaagatggatcttttagttccggttggtgttaccaactgggactaaagatccttctttttagtcccggttggtaacaccaaccgggagtaaagagagaatagcggcagttccagatggtccccttttttttattttctccctattaacaaccaaatttggtaatatcggcatcgggaaagaagattagatcgaagtaaagtcggaggcggagatcgagttcggaaacagagcaggaatcggttgtagtccagatcggctacgattaggatcggctgggtctgagtcgggctaggtaagccgatgcagccgattccgacaatgcaacttgatgtatgacatcgggttgaattgaggtgcttcaaggtgattgccgcacatggatagagtcctgagaaggcaattgtatctattaattaggatgttttatgtaattttcttagagatatgcttgggcaaaagtctgccgcaaagacttatggtatcttagagtttgttagagatagttgtcgtgtccgttatggacatatcttgtaattttcgggtataaatagacccgagccctatgtaacttttaacacacacgttcaatacaatctcggcgcatcaccaccttttttgctttagttttatttcgacgagttcttgctttcgggttgagctgcatcggtttcgatcttcaacaagaggtaaaacttgtaatggcggtttgcattctcgggattagtgcttccatctttatgacactttaatcttgtttatgtaattcgtcgagttatcatatatcctacataatccttggcaatatcgatatccaacctacaataggctaacatccgtcaatagaagacagccgattaggttaaataccgatgttgccttagattatataggatatctaccactctatgacacatccaacggcttgattgtctagatattgtccttcttttcatacttatagctgcatcagttaagtttgaccttatgagtcgtgattagaatctcaatctctagcccgcttcttggttgctgattagggtagtatcggagtttcagccgatcttacctgatttaactacttttatccctttacgttaagatcttgctgcatttaagtatattaggcttgtgtttagtatattctacttgctttaatatcttaatatagagtagtatcggagtattagccgatacatgctagatctatctgatcggctatgttatgaacgtatatagtctcattattaatatatatttcgatctaagtgatttatactgtctcggcatggcgaccgatctatcccaatcacttgatttaagtatatatcgatataaagattatatattggtaatatctgcagccgatcgagtagattcagtccttccttatttattaatgactgccgatcgacgcatatatgacattggctcaaagataaatgatgtcatcggcacctagctgatcagctatcatttatagatttaactgcggtttctttgcttctatttcttgttgattacaggatcaaatcaactggcacgctcatacattcgaaggcgagctttggacctgcactggagttaagcagatctcccaggcctcgtattttctgtcaacactcccaaatcttattttctcccaaatcaagtgggaagcatatccccaaatcaaagtaacatcccaaatccacatcacaaataaagtaacatcacaaatcttaaagttacatatatacacaaatcaaatacatcacaaatcctaaaaaattacacacaaatcaaatacatcacaggtcatcttagatccatccaataaatcacaaaattatacatgtgaatcacaaattaaaaaaaaagagaaaacaactccgttgctgccgcccgccatggccgccagcccgccgccgccgtcgccccagcccgccgccagcccgctggccgccgcctgccggatgggaaggggaggatgggcaggaaaagggagaggaggaggtggaggagaggggaggggatgaggaaggggaggaggtggaggggaaggggaggatgggcaggaaggggagaggaggaggtggaggagaggggatcggatgaggaaggggaggaggtggaggggatggatcgggatgaggatgtaggaag

SEQ ID NO: 17947 - DNA, 30156 bp, Oryza sativa
ccccctgacatcaatctgacaggggatgaaccgagactaaagaaccaactgggactaaaaatcatagaatgcctcttgggttttcaaccgggactaaagatcatttttagtcatgggattattatggttttgggtcgacccagcaaagatcatttctccaccagtgtaatatgatctttctgggagacatcaactttctagcaagaaaaggttacagagattagtcaactgtgactacgattcatgcaaagacaaaaaatactactccttccatttcgaaatgtttgataccgttgactttttagcatatttttgaccgttcgtcttatttaaaaacttttgtgaaatatgtaaaattatatgcctacataaaaatatatttaacaatgaattaaatgataagaaaagaattaataattacttaaattttttgaataaaacgaacggtaaaacatgtgctaaaaagtcaacggcgtaaacatttcgaaacggagggagtactaaaaatagatgtaccgaccagatcggtttcgatggcacctctaagtttttcatcctcaacaatcaacggttttccacatttacagtatctcaagatgcgctcagcaatctcctcaggaagaccatcacaatgccacactgtcgactcatcaatcttaatgaatttgatcaataagatgagctggtaacaacagtcacagcatgatattaggtatacaaaggttaaggcgcaaagtcacaaatgaaacataggagccctgcatctttccaacagattgctttttgtcattattattttctggtgtagggtggctacttccgcattattattttgcagtctaagattatttgattttagtcgtgatgtacttttagttgtagcaaactctttaaatgacagtgatagccaaggaaaccacataaaactaaattaagctagtttatctacggatatgagtaataatcctggatgaaagtaccaagcagaaaactctctctaatgaaagtaaatatggtagaatcaggaagacccaacttgtctaacaaaatcaaacttggcaaaacgcgaccacagatgctgcaaaataacaatacagagtgaaaaatcataagaataattacagacaataacctgcaattaatgatgacttgggatatatattgcgtatacatacctgttcagaacaaagtgtttgaaatgcaacgaagagagcgaatcccgacggcgtcttcagcaccactagattgtccacgtattcgagttccatatatacgctcaggccttctttaattgatccagttcacaagagcacaacaaattaatcctagttagttcagcgcacactcaactcgattagggcaactattacagtgacgctttgcatctggatatcacaaaaaacgtacattaaaatcagtgggactgtggggtacaccagtttacaacaatatatatatatatatatatatatatatatatatatatatatatatatatatatatataattataatgattcgatcatatcaggaaatgcctcacacaggaaagaaatatttgctcatggatagatcgatgctagagatgactaaatcaacaagatcgttgacatggaccatcgataccaccacagctcgaatttgactacaatatcaagctactacctatatacgatatcccgatccagatcatcgatgccaagaaaggactcgacgatgcatagcaaaacgaggacccaatgctattacaggagaggtgtaggaaggaagaaagcccgtggacgcatgcgcccgcgtacgtacctcgagtgcaggctgcggattcagcccacggtgcacacgaggtggagggtggggttatataggagcattcctagccgcaaatctaaatttgatccgttatattttccatccaattggatggctatccagaaaaaaaaaatcctctccccatattcctttttcactttcttctatattttagtattacattccaactaacgttaataacgcaatatatactttataatggcaatatctgtaaatcttgctaaaaaatccaaatttattgcattacaaatctatatctatatttatatctatacctaattaaaaaatacataagggttccgacaattttttttcgtccgtgcgtattcttttcgccgttttttttttcgtcgtctttttcggttttattcccatccgcttcttttcatgggttggcatggctgttgggcccgaggatggtggcccgaggaggaggaaaggaagagaggtggctgctgggcccaagtagagatagggatgacggcccaagagggagggatggcagcccaagagggaggagaaggaagaatgggccagatttggcccagaattaggagagggtttttagtttgtttttactttaaattaattattaaaattatatttgtattattaaaattagcaattgagctttgaaaaattcaaaacaagtctagatagtatggttcattcgtgaagaatttaataaaaaatatattcagtattttattttaataataacatgttatttaattctaattctaatctatacctctatacctaataaaaaaatacgtaaggatttcgggtgatctgtttaattgtcgggtcaaaaccgcggttgatatagtatatgtatcttccatgtaatcacctctctcctttttacacatatattacttgcactgtgtatatgtgggcctctcctggaataagtctactttccctccctcctgtcaaatcatatttgcgcgcaaatttttttttcctcgaccactagcacggaacatgcacatccggttgatgaaaaatcaaaactatagcacctctttcttcaacaattttttgatgattataaaatcttataatgaactagtttttaattcaaaattttaatttaattatattatgtacacaaaaatcctaattgtaactcatgatttttttaaaatatatatattcaagcaaattcccacattgaatttcaccttaactagaccgtataacaacaataagattaaaataaatttcagccgttgcaacgcatatacattttttctagtatatatcaattaccctaatctcatttttatgttcctctgtcatatttgtccaatcatatttctcttcctctcttctttatacctatcgacatgagagagtgatagtgcaggctcaagtgtgggcgcgggtggagaacaaaatgtcgacaagggtggcacgggtgcgaggcacagtcggcgtaggcacgggaatggggagctagggtcggcgttggcggcacagcctcgagcgttggtggagcaggcataaggcccgggtggcacggccacaggcgtgggcggaggagcgggctaaatttgggggtttctttcaccgggatagtgggcgcgctaattttggaggcactgatgcgtatcagctgcaatttagttgatggattggatgggatagatgagctgctgagaatgctctaataagataatgttgtggtctaaaaatggtgaggtattggattcggttttgacagtgttagtgatatgccctagaggcaatcatagagatgattgtatcatatactatgtttacatatttatccgatattgttccttgaaatagataactcattattggttaatgaatatgtgattctttcatgagactctttatgttatgtgttactatttctaaaggattcctgatcaaatatcatatgtggaacaaatatgtttagatgatcagcatatgtattaattgatgatcatgtctcatcgatcatggtatagagataccaaaataataatgtggacacatgttagtgaacatgttattagatagacccaacatgagacactgcaagagccatatgtgttgtgtcatcagtgatctcatttagtgttggtgttgaatccatagacctgaggttatcatggtttctaacatgtgtagtaacttactcagggactgctaaacgctactccgtaactggatagttataaaagtagttttcgggtatgctatgaaacatgcagtgggatatgaataatcaagatgggatttgcccctcctatggagagatatctctgggcccctcgatgttatagattatggaagtgcatggccataccaaaggtgattgaggagtcaatcacaagttatataatctatcaacaggttcgagtgaatgattaagctattagaggatgacacatatctagccttgagcttaatcgatatcgtgaggcaaaggggttcatacaagtatacactataggttcatccgatatgatctttatgtatgcccggtgggtcaatacgttctgctaggggcagctgttgacgcgtggaccgaaaaggagttttcgggttacagccgagtatatatgaacctacagggtcgcacgcttaatgggccggaataaggggattgcatagagatccaatatgagcttaattcggatagggatccgaataggagtcctacgggccttggaggcccgagtgatagatcctatatattcgtgaggggtgtgaccggcagaggcattgcatcacgtgagaaaccctagccgtcacttccctccccgagtaaaaccctagccgcgcgcgggtgctagcacatctgcgcgtggcgttccgtccctgtacgtgtggataccggtagaggcgccgctggtttgcggtgctgatcggcgtgggagtacggcgaggagaacgcacgaggaggagaaggtcgagccggtgcgatcgactacttcctctacatcgacgcgcactgcttcgcgagagtttcttcgacttctcagcgtcttcttccgctgcgcagcgcgtcgagtggtaacgatctatgatctaatatttgcatggttcctggtttacgtgatagaaaattttgatttatgctatcgtagcctacgcgtatcccaacagacagcataatgtagcttggtgctctggcggcttggctgatgttcaaagtggatagtcggtgtcttgctcgtttttgcgatgcctttggcaacgatgatgtgataattgtggagttggagctgctgtgtcgctaagcgacaaggtcggcaacaacacttgcctcacgaagtcaaagcctttgaattacttgcaacaagctctttatcaatggctgtttttttgggctccgctattgtccttttttcacggtcttagttagaatgttgtggttgtggtttttgccagtttctcctaattaactgtgcattgtaaggtttggtcatgttttcttcttaaaatatgacacattcttctctatataaaacgccgcaacggcatgaccgttcgaaaaaagacaacataatgtaggggcctaatgtgcagcaaacatatatttttgcatacaactattggccaagttttagttaactccattaactatccaagctgtgttattttattggctcctttttgtgatttgcatactggtttacgctgatgtgctaatgacatgggactaaatgagcgggtatgttggatgtttagatgccatatggcatttaaactctcttggtgcgcacgagtagcggcaaaaggagaggaggaggatgagcgccattttataggccgggggaggaggggaatggctggcaagcaaggtggccggccatcaatggcgacagtttgtcggagattaaatttagcgaattaaatccaaattgaaaggggcaaacatgggaaaataaagaggaggaagagaggaaccgatttttacaatcaactagtaaggtagcccgcgcattcgcataggcatgtatcgtagactgtgtttgagaacttataatgatgaaatgttaatcggaacttataaaagatcattttatttatttatattatttgagcacatttaaaaaaacattaagtaattggactattttctctaattaaaggaactcgatgttttatgcagtggctcaaactattcatatttcagttagttatttttgtttacgaagtgtatgtttaatttagctatacatgtttcaaaacatagcatggtgcgactctatgttgttgagttatttctttttcttttggcaaattaaatataaaaattttgttctggtactattgatttaatttagctatgcatgtttgtagaatttttcataatgacataatatttattgtcaaaattttaaggtatttagatgtggtgcaaagtgcatgggtggactgtgcccaaatgctataattcttatgcagcaaaatatatgcatatataaatattacattgttagtttaattataaatagagaataattagatagaaatcagaaatgtatagcttataaaaaaattgtagttgtttcaacattgattgtttctcttctagtttagtagctacaaaaataaggaatgggagggcagtgttttctacatgtgagatagaggaggtggagggattttagtgaaaactgttgatgcaaaaacacgaggcctggaaaatctgcttaacttcagtgcaggtccaaaaatcttgcttttaggttcgtgagtgtgccagttgatttgatcctgcaatcaacaagaaataaagacagaaaccgcggttaaatccataaacgatagccgatcggctagttaccgatgacatatcaattatctctgagccgatgtcatatgttaattgatcggcaatcatgaataaataagaaagaactaaatctactcgatcggctgtagatattaacaatatgtaattcttatgtcgatatatacttaaatcaagtgattgggatagatcggtcgcgatgccgagacagtataattcacttagatcgaaatatatactaacaatgagattatagatgtttatagcatagccgatcagatagatctagcatgtatcggttaatactccgatactactctatgttaagatattaaagcaagcaaaatatatcaaacagaagcctaacatactttgttgtactaaaatcataacataaagggctgatttagcatgtcaattatgtcaattatcaattatcattcataagatataaagctaaaccaggtaagatcggctaaaactgctaccctaattggcaatcaaaagcaggctagagattgagattctaatcacgacttataaggtcaaactcaactgatgcagctataattatgaaaaaaaggacaatatctagacaatcaagccgttggatgtttcatagagtggtggatatcctatataatctaagtcaacgttggtatttaacctaatcggctgccttctagcaacagatgttagccgattgaaggttagataacaatattgcctaagattatatagaatatatgataactcgacgaattacataaacaagattagagtatcataaagatggaggcactaatcccgagaacgcaagccgccataacaagttttacctctagttgaagatcgaaaccgatgcagctcaactcgagagcaagaactcgtcgaaacaaaacgaaagtaaagggtggcgatgcgccgagattgtattgaacttgtgttgttgtattacatggggctcggggtctatttatacccgagattacaaaatatgtccgtgtcggacacgactcttatctctaacaaactctaatataccataagtctttgcggcagacttttgcccaaacatatctataaggaaattacatgaaatatcctaattaatagatacaattgccttctcaggactcaatccgtgcatggcaatcctcatgaagcacattaactcaacccgacaacgtgcattacatcatattgtcggtattggctcaatcggccaacctagtccgacttgaactctgtctatcctgatcatagccgattcggactttagtcgattctcgctctatttccgtaacgatctccatctcgaattccgctttgattctatcctcatctccgatacttggatttccaaatttggttgttaacacatgcccctcaagtccggaatatttggtaatgtttcggatttgccatatccgtgtctccgagagtatcgctcattgccatttttccgaccgttaccgcctcgctttaaatactaaccgtcgtccccgagaaatttcacaccattagctccgttttcaccgcttaagccaaccttgtttctttctctccggcgatcccctcggagcaccatacgtccccaaggcgatttcccctccggccaaatattctgcccgcggagatgtcgtcctccgctagtccgttcgtcgcgccatcggccgaatacgcagaggtaagtatccatcggctagatcctctcttttcgcaatagattggttcttccttgcctcatcttgttttcatcttctctgttcttgtttacatctgtagcacttgtccaatctggtcgcgatcccaagtttgtcacatgagcatcactattttcttggtccgatcggcaatcttgatcccactgagttcatcatcgccgaaaccaataggatcccttttagattggccaacccgaatctaggtcactagaagaataccttcaaatcttggccttctcttgagaaaactttccctgagaaaagttgggctgtgtggtataagtgtgtatcggctagcaagcaagttcgctgggacgaattaggaatcggccaagcgcttgctcttactctagcaaattcggccaaggatgaacccctgatggcctccgcagcatacttttggtccaacaccctcaacgctttcttgttcaaccaagggccgatgattcccactctgctcgatatcaccatgcttactggattggatgtaactgcatcggctaaccccatgagcttgaacaccaaaaaccagtttgattttaggaccaagagcataggtggctggtctggctatgttgctgcatacacgggcaaaggatctgtcacccccgggagcacacggcttttcttctgatgtggcttgagaaattcctcttccgcggatcaagctgtggccctaccaccaattggcaattcttagccgaagcccttgagaccaagaggcagttccctctgggtaaaattcttctcagctatctgtaccaaatgttgagcaatgcatcggccaagatagccacaggctcagtagtgggtgcaggtggaccatggtggcaattgcaaacatggcttaaccttgttgtcatgatggttatgaatcgaccacctttaacatagtctgaatttccaaggttggagcccactactaatgatgatggggcgccgatgcctatcatatggtgaagctgcatcaacaccagccaattctggagcaaagctatcggctaaactgctcaaagactggttctgcagtttctatgagggcttccagagagatgtagggtttggttcccatatgaggattcagtgaattttgatctcccggtagacttcacatttgaggatatcaattctgaaaaatttgacaaatctagagaagtcttctcgactgctattagtccatgcatccttcctgtcggcatccatcaaggaagaaacatacaagcttcttatgagttttaccatccaatgagctcagctagatagtttggaatgggacagctatcaatcgacttgttctttgccgataagatccagtacagaggagaaatctcatcaacattgatgatggatcggctgctcaacatcccaggacctcctttaggcagtatcgagaacatagagctggcaaggttcaggagtaggaattttgacagatggtgggggtgaatggaagcagcatatattccatcagccggcctctatgtacatgatagatttatttccagatgttgtccctcaggtatatttttactttgtcaattctgttggaataattgttagccgacttgaatcttgactaacttctttctttgccttgcagacaacagaatcttctcctcctcgcaagagcaacagtggcagggacatagaatatgctccaggccttctaccaaatggaggtggattagctcccccagtcatcggctatcatgcccccaagacctcaagtctgcttcaagggcaaatgagagaaccagccgatgttggcaggttatgcattcgaaatcatgaatgactaatgcataaaataaagatatagaatatagggcatttatgctcaaaggagaggaataataacttgccttgctccaacgcaataaatccgagatagccaacctgattatccaatgcttgaaataccaaaggttgccatccaattataatagactctactgaagaagaggaagaactaaattcaataaaagatcgataagcggctaggagagctagggttcagggtatagtatctcctttatagggtatagggattattgggctatcatttgttggcggtaggtttaggtagtataatagctagggtttagttatatgagagtcgattgtggaataggatagcatatcggctaggctctatattttatatggaggttccagagggttggaggctagaggggattaagcaactactgtcacttatattttatgtgaaggctctcgtggtttggatgatagggaatatactagatatttgatatggttaaataggtatgtggctaatatgggtcaaggttgggctttggtagaatagtggttagggtttagttgtttaggccggtatcgagataggataaatatcggctagggttttgggtgtttgctagtcgtcattagagttgggcaacatgacgactagatttggtatcttctctagccggtgtcggtggataatatatcagctagagaaataggaggtgggtgcaggtttagtggggcggaagtgttactccgacaaccgtgagttgtgacggagtggctaagattacacagagcttgagagcaaactgtgtggcctgctgtggaggtcgaggaaatagtgaagctccaaccgttgtacgcgtcgaggcgtggggtgctagagtatcaattcaaccttgggtttgggttttgctaggttttacaaccaacagtttgacgtcatggccagtagaccgtacggacgtccacatagaaggtgtaaagttttaaccggcggcttttagtggctaaagggtattttaaaaataacaggaaatatttgaaaggtaaatataagtttcaattataagtttaaatcaaatatttattcaaatggtatttgaataaattaaggaaattcaaataaaatcttaaaatagcaaatttgatatcaaaatgaaggatttgaatttaggtccaagttttactggaatcggattacggtttaggagatatgggcttctaaagattggattttgaattaaatctagaaattgcgaaatagtactgtagggggcccacctgtcattagctgtcctttttctttttcttttttttttctcttcttcttcctcccgattcctcttctctttttctgttggcaaccgagagggagagagaggagagggcgagcggggcgccggccctccggtggccggaatgcggcgacgccggtggcatatcgtgttcccgctcgatgcgtactcgaggaggtcggtggctggtagagaggaagaggaaggaaaccagaacggaggcggcaagaacttgctctgaccgcttaaagaagtgatgatggtggctgctatggagtgggagagaagggggaaacgggaaaaatgggctcgtcggagggaggcgaagccggtggtgcgaggagaggggaagaggagctacggatggggagatcgaccgacgacgtcgacgatcggccatgggaagagagagacggagctcgaagagatcggtcgatgtgggaaaaacagagggggttcgttcacttatataggccatgagaggcggtggcggatgacggttgtagaggagaaacacaaggacgattttgcgacggcggcgtggaaaagaaggaggcggcgccggcttcttcctgcgattggttgggcagtgatggcgtgaggacgtggcggccgtggaagagttgggcggcggagtagggcgcacggtacggcatcgacgtcggcgtatgaggtcagcaggtgacggtggcacaaaccacggcgacggcgacgctgtgggcggcggcgcactaatggcgcacggcagcggcggctgtggcgctacatgcgcccacaggaagaggagggaggtgggaggatgcggctcagcagtctgggccggcttgggccgcgtgagtgagagaaattcggtccaaagttaaaaaggaggaagtctaattttcctagagattcaaataattgatttagaggaatttggacggctagattttgaaaaggatttgaattcggagatattgatacatggagaaggattttaaaataaggatgctctaatttatttgagtgcaatattttgagagatagaatataacgggatttatttaatgcactcaaatgagagggaggggaaataaataggatgttagccgcaaattatttggcaaggattttggggaagtatttgaggctaataggggacttggattttggatgaaaagataaaacctattttcttggcacaagagtaattattcacaatatttgtaataatattattcttgcaccgagaagggtattctagccacacgattcaaatcggtggctaggtcaaaaggaaggatttggatatttgaattgaggtttaaggataggtttaagatcaaaggattggttaacaattaattccaataagattggaattgctttggtttaggttctagcacaatatgggaaggtttcttggaccataattcataatagtaaaaaggttttcaaactaaatttaaataaaagaaattttaggaaaaagaaggttttagattgaaaccaaatcaagaaatacctcaagataaatttaaaataaaaatcacaaaagattttgaacatcaaagagagattttatgcaagttaattttaggagggccctctaattatattgtcctaggtttaggaggttattgagaacataagaatcatcatgatgcaagattagaaaatagttaattttcaggatgttacatgtcacttgaacacatacatgacgtgtgaaggggtgggaagtgggtcttttccgtttttatattgttaagatagcagtagaaaataataagtataccatgtttaagttaaaataatcgatggttaggtgtattatgtaatttctttagaatttctaagatttattgtaaactactggaaaaaccatctttggtcggtcgcccaaaaaccacaatagtcccagttcgaataggaaccgggactaaagattatttttagtcccggttaaaaactttttgatctttagtcccagttgatgttaccaatcgagattaaagatcatttttactcccggttcaaagaagttattgggtcaagttaggccccaatcatcttagatctttagttccggttctttatactacccgggaccaaaaatcctcccgagcgcacgtcgagtcctctctctcagttttatagataagaccgataaaaaccatatccacttcctctctcattaaaaaccatctccactctccagcctcctcgatcccatctcaatctcaggtgttctccttctcgatcggctctagcatttttagtcccggttagtaacacgaaccgggactaaaagttgattttttttttgtctcggttatttcaccagggactaaagatttatactcccggttgcaaaaccgggagtatagggggttgtaaaccaggaggaaataccatttctccaccagtggtagtgtcacatggtggcttaggagtgttcataggagtcccgtgtggtggtttgagagtattttgtaggaattttagttgacttttagcatataatggatagatatggcatgctaagttgtcgaaatgtgtgcctaatatatctctacatgtttctttagggaatatatttctacaagtaaaattatactggtgtaaactacatttttctgacattgtagatctattttatttacatgccagtgaagttattatatagcatgaaacaatataataatgtcactttcttttcataatttttacaagctaaattatagttaagaggtgtattaaattctaatttgtgattttagttataataatgacacaaatagaacatataatttcatccgatagcaaaaaaaaaaacttcctttaaagagaaacagagaggagttatgtacatgcgtatgcacgggaagaggggacacctctttgtaagaaatagaaaaatcaaactaatccaagtatccaacggcttggagtggtgtgcctattaattttagtgaaatcaagggctaggtttttttctcagattttttctaatttattggagcgtcacgtggcattatagaagcatttatataagcatcatgtgacagcttagaagcatttatagaaattttcacggacttttactatataatataatagatagattggatatcatcgatataatttagcgaaacatatttgtagaattattgaaggtgacatataatataatatgccaactagagatgaggggagagagggaatacgtacgtacaggaggccaggaggggaatgtacaggtggtggggaccagtgtggagagaggaggattttatttttttatttgatctaatggttaaaaatgttggagccaccaatttaaaagaaaatcaacggttatatttttagactgtcacttggcatcttaggagcgtttgtaggagaacacgtggcggtttaggagtacaggtggtggggaccggtggggagagaggaggattttattttttttatttgatctaatggttaaaaatgttggactaaccaatttaaaggaaaatcaacggttagatttttagactgccacttggcatcttaggagcgtttgtggagaacacgtggcggtttaggagcgtttgtaggaagtttaatggacttaggaggattttattttattttatttgatctaatggttaaaaatgttggagccaccaatttaaaggaaaatcaacggttagatttttagactgtcacttggcatcttaggagcgtttgtaggagaacacgtggcggtttaggagtacaggtggtggggaccggtggggagagaggaggattttattttttttatttgatctaatggttaaaaatgttggactaaccaatttaaaggaaaatcaacggttagatttttagactgccacttggcatcttaggagcgtttgtggagaacacgtggcggtttaggagcgtttgtaggaagtttaatggacttttagtatataatagataaataatagatttggaggagaatcgatcatgaagcaagatcaagggattggaagcgcttgagttcgtcggctgggagaagaacgggtggcggctggggaagacgacaactcgtcgcgtccctgggtcggctgggccgagcccgagcaaggagggaaggtaactggggtgaggcggctgcagcccaagggaaggaggggagagggggattgttcaggagagatggtccgagggagaggatggccaagagggagggagagaaggaacaaattcaccttatatccataatttgtcaccgagtttaaaattcatccacaaaccaaaatactagatataatggatctctcaatttacaaaactggatcacctgaggttctaggtagtattatgcccggttttagctaacctggcaaactgagtcagcgtgagacccatgcgggctccacatatcaatggcctatcttcctctctctctctctctctctctcctctcttctcctctctccgccctctcttctactctcttcccaatcatcctggatgccgatcggccgaccgacgccatgaggaagctgttgctgccggccccacgccaacatgaggaagttgctgctgatgcatgattggacacggcctgtgtgaactggaagttgaggggccaagcgcggctttggccgatggactccaacaatgacgacggtggctccgatgggggcacacgacggtggtggcacgggtccgcattccagcggccacactccataagcacccgatattggctctgtttaaaaaggaaagattatgaatttctgacatcaatggtcacatggcttaaattacaactgactaattcctgagaggggcgacaacgacaactgacaggtgggccccacacggcgcgcccagaggtagccagtatggtgcaatcagtgggaggaggcgcctatgcctgatgatcactgccagcaaccatcggtgcggcaagacaaggagagggggcaggtcaggaagaaatgggtgaggcctcgcaactcactgagacgtggcgggggcagaaacgagatgaggcagggatgggcgacaagggggacagtggcattccattgatctccaggctcaacaaaggggtggatgaggacagcgaggatgaaggtggtgaaaccggcgacgacctgtaagtggctgcggcggtgccggcccgcacgcacatgctaggccggcccaaggccaagcggcgaggaagagagggagggaggtgtgtggggtcaccttgctgttgttggggaggaggaggaagaggggcagaggctgtccctcgagatctggcacgtggatgtggtggggccagcagggactgacgacttgttgacggtccataagtaaaaaatatatgaccatcaattattgcataaaaccaattggaataaaacatcaaacttagtgatagtggtcattactaatcatttccgcacgagttggtgaatatttgtttgtaggtgaattatggacgaaaactactagccatgcgatgaaagacacccccggacaattggaaacgagtacatggattggaggccccacatgttaatcaaaatcacctaaaattaaacccatgtaaggtacaacatgcagatggcccaccatgcaacctctcagccgaaggattaagtttgttttagttgcatttaatttaactttccttcacaaaattgcgagagcatcgccaccggttggacagagcaccactgtcggggtgtgcagccatagtcgctagcatcactagagcatgcattgcttatcacctgatgcatacccagagggcattggttaacacctgatgcatacctagaggttagacaaaggagccgacaaatgcattccaattggacctccatgtagccgaataatagattctcactgcatctagtgtgttgttactgaaaaaaaacagatatacggttttgtttggaatctatagagctggacaaatagaacattttctaactagtgtagctttatagcaactagattgtctagtgtagctttatagcaactagattgtccagtgacgttaggggatttcaatataataagaaaggaaagtgagaaaagtaaaaagggttatagtagatagagtttcttaatgcaataattgagcaaaataatttaatacagtttatgagaaattagatagtattttggtctcaaatgaatcattttcccatggtcatggtgaaggttagaagtttagaaaggttaatagagcaacgctccgctgatttctacttgcagtattctactacaagaagaattaatctcgaccctttattttaaagggtagattagtaatctcttaataaagattaggggtaattttggcatgggatatttctctgtcttgatcgctcgcatcaggtccgatcgctactcccctaaaaaaagattattgctactcctggccggtggcggagcgactggcggcgctgccagcgttgatggaaaatcgcttcaatctgcttgcacacatcgggcgtccctcgacgcgaaggaagccaacgcggtgatcctgcaatcaaatcaacaagaaataacgacaaagaaaccatggttaatcctataaacgatagccgatcggctaagtgccgatgacatatcatttatctttgagaagacgtcatatgtgtatcgatcggcggtcataaatagataagaaagaactaaatctactcgatcggctgtagatattaacgatatatactcctcatatcgatatatatacttaaatcaagtgattgggatagatcggtcgtcatgccgagacagtataaatcacttagaccgaaatatatattaataataggactatatatgttcatagcatagccgatcagatagacctggcatatatcggctaatactccgatactgatctatactaagatattaaagcaagtagaatatatcaaacaaaggcctaacatacttaaatgcaacaagatcttaatataaagggcagatttaacatatcaacgaagcatatagagtaaatatagttaaatcagataagatcggctgaaaccccgatactacctgttggcgatatagcatgaggcccttcgaccaaacctgccgaaaccatgcgaccagtgggcccatgaacctcaattatattgtgtacccatgtaaatgtctctttcataagggcaactatgtaaattcccctgtataaccaaaaccctagtagtaagaacctataatggggctataaacatgtaatagggggatcccccaagaaaaattctcaagttaatacacttcttttccaactactgttgagtaaccacgtctttcgacgtatgcagttgtcgtttcgacaacactaccctaatcggcaaccagtaggcaggctagagattgatattctaagcacgacttaatagatcaaactcaactgatgcaacattaagtatgaaaagaagaacaatatctagacaatcaagccgctggaagtttcatagagtggtagatatcttatataatctaaatcaacgttgatgtctaacctaatcggctgctctctaccgacagatgttagccgattgtaggttagatagcgatattgccaaagattatgtgagatatatgataactcgacaaattacataaacaagattagagtgtcataaagatggaagcactaatcccaagaacgcaagccgtcataacaagttttacctcttgttgaagatcgaaacagatgcagctcaacccgaaagcaagaactcgtcaaaataaaactaaagcaaaagggtggcgatgcgccgaaattgtattgaacgtgtgtgttaattgattacatggggttcggggtctatttatacgcgagaattacaaactatgtccatatcggacacgacttcttatctctgacaaagtctaaaataccataagtctttacggcagacttttgcccaaacatatctctaagaaaattacataaaatatcctaattaatagatacaattgccttctcaggactctatccatgcgtggcaatcatcttgaagcatatcaactcaacccgatgtcgtacaccaagtcgtattgtcggaatcggccgtatcaccaaaccaagtctgtctcgaatttagccgatccaatcgtagctatcacgcccagaaatttagcccaaatttccagactattttgtgtattaaatccctgtccaggactagccagggtacacaaaacgacaagtaataaacagttccaaacgtaaataaagcgtaaaatacttacaggagaggcacttagtcctcacaccgaaacaaaagcagcggcagcggaaaagacgatcctagcggggcttcagcaccactccacaggcaaaactcaactgaggtctaagccttggtcctctaacttcgtcctcagctcagaagcactacacttctgaaaagggggaataatagcaaggctgagtacaaccaccgtactcaacaagccacaccaatgatgcaggcgtgcaaggggaatacaaggacggtttgaggctatttgcataaaggcggttgtaaaacattttattgagcaaaaccgtaaaactattgagtaattaaagtagcattaaatctccactgatcaacgctataccacgttgaacaggcccaaccaacccacctgaactacagtgcattgagtcgatttattaaggtgggactaatcacggtgaatctggtcgaccgctcataaccgcgggcacggctattcgaatagttttactctgatcagagatgtacaactgtacccacaagacacagccccacgacacgtttccgtgcgctgacatgccaccacgacataccggaaagaggccgtgacaggacccttcgcataaccccctctaaccaagcacaccacacctcaggtttcacccccaatcctcgcaaggcagcgggcagtcccctctcgtgcctaggtgaatccggaagccgcataggctgtcgcagggcccatccaaactccatcacgcccacccttgtctggatgcgtcagctagaggaaagctacactacaagcccagccgttgcccacgctggcttgtggtaagcacgataaattcttccagggtttccgcgaaccggtccttaatcgccatgggcacgactagcaaaaccatgcagccacagcctaccatgtagtcacattttagttggataattacgaccatgaagcatggccagatgtctcgagcacgcagctcattctgatactaaaaaggtctaatactgtaatcagctcatcaactgagctagtggtaattaagcatggctaagcatatagttctagctaggtcacataagtaagatgagctagtcgatttattacccaaggttgacaaaggacagatatcaagtaaatatggcacaagcaaacagataggtaatacccggatcccatgtaattagcaacacatgcaattttatttgcaaacgataaaacatttataaattaggatcaaaatgctcaaggggaatgtgtgacttgccttgcttcttcacttggatcttctgaactcttttcctcgcgaccgcgatcttccgaaacgacggattctacacgctggcaattctacacgctggcacgcaaaacgaagaaaaactctaataaaaaccaaggaaacagtacataaaaagtaaaaaaacatgtagatctcaattttagatgaattttgcaagttgaatggcccaatttggagttcgaatgaattagatatgaattttagaagttctgagccatttaaatgaatttctataattaataccaatttattgcgcaattattaaatatttttccaaaggaaatgataagtgctgacgtcagcaaaggggaagggtgccgacaggtgggccccacacgtcagcgggtcaaagggggtggctcatggtggactcggtccaccgcagcacaggcgcgcgggcacaccacgtggaagaccacgtggcggccacgacggcacggcggggcgaggtggcaaaggcatggcgccgaggtggcgccacgtgggacaccagcgcggggcggcgccagagccacgtggacgacccggatcgccccgaaggggatcgggcggccacagctagcgggaacggcaaaactcgccggccgaccggccggggagcgacggcgagcagcccagaggtcgccggcgacgaccaccggcgcgacggcacgcgcgagaggcagcggagggaggcagaggagggagatggggagctcaccaagcgcacaaggcacgaaggcggtgcgggagagcggccgacaacgaggaaaggcgacggcgtttcctcggggaggcacggctacggcggtccgatggcagtccgcgagcgaggagtggcggatgacaactggaagagcctgaggaggacgaaggggggattagaagagggagaggacgggcatggcgaagggcaatagtggccgaaggccgaccgtgagtagaggagctcaccttgcgcggggaagatggggttcgagcgacgattgatggaggcggagggatggccgggctgcgggcgacggccgcggtgccggggaggacaacagcgcagcacggtgtggaccggagaggcggcgcgacgcggccggaggcagcaaaagcggcgccggcctcgggcttgcggtggaggtggtgattcggcggtggatcgaaggagcggtgtggtggccaggcttgcccgcgcaacggcgaagctagcggtggcggcgacgcggcgcggcgacggctagagcggcgagaggcggcggctggaggcggtataggcggcggtggctcggcctcgcggtgggacggtgtttcgcgggtggaagagggaagggaaacggatgccggggtgaagcgtggggcggcgatgccgatggtggcgacgacgcagtgcggcgatggcgagaacggcggctagaggcggccggagctcgccggagagcggcgacggctcgattttgcgtggggagggcgggggagagtgcggggagtacgggaaaattggggaaatggacgagggtcacatgggaaatcgtggccgagaggggcggaatcgggcggcaaccggccggcgacgtggggtggtgtcacagcctgaattttcgttttaggatttataaattatctaataaattattaatagaatttttattaaatgttctttaatttacaagtgaagttaaatgtgggatataaaatttcctaaatataaagcatggatggatttaatttttattaaattctccatgattaattacactctctgaaattttctcggatttttcagagctcaattcctaaatgatacaaagaacagttcagtaattagttaatcaattaatgatctaattataattatgttaagtgcttttcttgtttaaaaatccttaatttataaattgttgtctaaaaggaattattagaaatgatcttaaaagcctagaagagaagatctattttttttaaaatttgttaaatctcaatataaaagtgggctagaaaaaaattcattaaatactttacttgattctatagttcctagatttttctgggatttatttgagccaaggaagtatttttaatcaatggaatatcatttcatgaataatttaaatagaaaaaggttttaaaatctttcttttggttttgggccgaaagtcagcccaagtctctctttctccctctcctcggactgcttgcatctggcccagccggcccagtccgccgcgcccctccctcctctctctcagccgctgacaggcgggacccacctgtcggggtcgtcgccctcctctcgtcgcccggccgcgcccgagccgccaccgctgcccttccaaattccgttgcccctctctatttccggtcaaattgattgagggcaaatgatccttgagatctcctcttccttttctcttttggaaacattggctaattttctttggaaaccagtggatttgagttggattcggattcatctctctcctctaaccctagagtttccttctcgccgccggtcaccgtgggcctccgtcgccgcctcctagccactataaaagcatccccgggacctcctctatccgccgccacctttgccttagcccgccatcgcgtctagcgccgcctccgcgtagccctagccgtcgccgtcgttgccgtcggtccagccgtgcgccgccgtcgctccagtcgtcgccgtcgctcggggaggtcgccatcgtggtcgccgttgcgtcgccgtccccatccaccgcttcgccgccgctgtagcacgccggagcaccgccgtcaccgtcgacccgaagaccgccgccgcttcaacctcgtcgccgtcgtcatccgtcgtcgtttgtcgtcgtccaagagctcggtgagttcgccgcgtcgctctctacccgttggtgtcctccttttgcgtcgtcgcgccgtcgttcgccggcgagcatgtgttgccgagccgccgccggtgatgacgtcatcgtcgctgtccccgtagacccgctgtggaccattttgaactcggccgcccgttttggatagaatcgatctcggccgttcgtttccttagactgtcccgtgcacccggtttaccgtggaccgccttggatgacgcaataatcctccttttccttttcaaaaataattcattattgcgtcataattcaattaaaatccatataaatgctttaatccggtttaatctttaaaaattcatatctaattcattgtaactcggtttaatgtggttcaagttgcaaaagttgtgtaaaataaagatctacatattaaaattatccataaattgaattaaatttatttaattctttttaaatgggctttaattagatttaatctagtaaaattcataataaattcatatgaagtcagaatgaggccgttcaagtctcataattcatctaaaattatgatctacatgtttgtttactttttatgtactgtttatttggtttttactagtctttttcttcgttttgcgtgttagcttgtcgtttccgtcgttttgaaggttcgcgagtgcgccggaagtattatttaatgatggcttaataatagttcacgatggtcaatcgtgattggttaattaattacttgccaactaaaacttgataatggtgggttgtgagcacatggttttgagagtcgtgctcatgacaattaaggaccgcttcgcgagctactattgtgaaacattaaccgtgccaaccacaagccagcgtgggcaacggctttaccttttgtatagcatggttcattgcagagcaccagactgagaagtggcggagataagcccacgggggtcgctggggagtccatgccttgtttataagggggtgattatgatccaggaacggtgcactgctttgagttgtgttgtgcgaggggtactgtcacagctcctttccgaggtaccgtggtggtattgaggcgcatggtgacatgtcgtggggctgtgtcttgtgggtacagtggtacacctctggccagagtaaaactattcgaatagccgtgcccgcggttatgggcgggttgagcaatgtttttcgtgattagtctcacacctctcacaataattattgatgctataactggtaataatttgtttagctcctggtttggagttagatctgtacagccgggtatggttgttcaggatggttgggcctgtgcagcatgggtgtgctgttcagtgttgattaaaatttctgattaattactctactgttttactactcttaactctttgctaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatccagaaggggaagacgtttggtttataccccagttgagctgcttgtgggagtggagccggagcttcgctagaccgttattccgctgcagttttcttttcttttgtaagtatgtaacgttattattgatgattctgtatattaaattgtcagtttgtgtacctcggttgattcctggacgagggttttatgcacaaattagttcggaaattactagtgaatttctgggcgtgacaggtggcgacgtggagcttgagagaggtcaaaccggcgtgatttttggggaaaagtgggggaaaatgaggaggagtgggtggcgaccacgtccgcacggtcggacgtgcgcgcgggaggcggcggttttagcggcggggtggggcggcaatggcggcagttgccagtccatggcgatggggtggctggaggtaggggaaggggatgacatgtggggtcgcaggtcccacctgtcaaccaatggaagagagaggggaagccgggtgggggttttctagactttgggggggagaggggagccgagctgggccgagcggcccaaagaggagaggggagggaggcgggccagaggggaagggggaaggaatttgggccgagcccgaaagggaggaaggggaagattattttcttttctttttatttaaattgattaaatgaactttgtattattataattatttcttgagctttgaaaattcgcagaaaaatcctgagagtattttagggcacaaagaatattacaaaatattctcggccaatgatttttaaaggaaaatttcaaattctcccattatttcacttgattgaattgacttaacttttatttaatttctagaaaatgcattatttaatgatttttaatcctgaatgaaaatcgggtcgttacagtagccgatccgaactccagccgattcttactctgttctcgcgataatctttatctctgattccgccttcctttccaatgccgatgttaccaaatttggttgttaacaccgcggccggcgtgccagtgcctcgcagcgtgcgcgcaactgtacatgtccgtcatctcctagctccaggagaaagatgtacctataaattacaatagtacccctacgcaaattattatccctggacgaatatacccctccatatttctactaccactaactttggtggaagtagaactaaatcgcaaccctacaattaaatatgatcaacgtctcagattactttctactctaagtagaaagcaccggagcaggactctattttctgatcatgtgccaattctggtagatacagtacatatgtttgtccctcagatatacataggtttatttgagcaaactttattttaacttaggttaggttagtttttttaagtgtcctaatttacgctctttccattttaattagcacatattcattttaaaatagattcacttttatcctcttatctacccttcgttaataaatccatgagttttatttccccaataccccttatctacttattcactaacactgttttcttgttaattagaaatactttggtcttttccctattaatttgaacttaattggcaagaaatgaagttagtttcacgtacggaggtggtaaaactttaaaaggagtggggtcctggataatggcatggatgaatcgggatagtttagactgtttttcctcacccaaataactataacttgaccaatatagcatccgtaggaaatacgtagtccatcttgacgatctagctagatacgtaccatgtcgcataaattgtcacttggggtactattttttgtcttgaaaaaatgaaagaaaagacggtacatacaggactttttcatcagtttgcaaacttttcatctcaggcttgtaatcattaacgcctggcacacgtggcgtagagtggccgacgcgttaacagccaacgaaagagtcatcagtcacggaccgcatccacgactgttttcacatgtacgttttgctagctacaacaacaatttcaccgtctcctagctcagatacgcctgctacaacaacagagttgaaagcatttgcctcatactcctccgtggtgttggaaacgcccatgagtcaattgggagcccaagggacaggaaactccgagtcaaccaaggcggctgttggtgaggtggtgtactccgacgaggtttcgacacagctagtgaagttggcaacgactaaggtactttctactgaggttgctgtgcagctagcaggaacagatgaggtggttacgaatggcaaagagcaacaacaagaacctgtcagcattgcacaagaattacagcatgtttcagctagcttgttgtctcccgtggagcatgtattggattgcaacgtgcagttgaattgttccccgagaatagccggcttgcaggcgatggaagagtagcatcgactaagaacttgatggcagtactagcaaccaatgaagaccaacttagtgcctccagggctgccacatctaaagcccaggattcagcacaggcagttggagctcgatccccgacaagaaggcgacctcgtcgcccagtggaccctattccaactaggcaaagtgaaagatagaaggcgatagcaaatgcagatgcgccggtggcaaaccgggcagagctgctaaaaaaggttcataaccttgagacgctaacaggtaacaagtttaataccacaaattctgttgtttcaattccagataagactcttgctacaaatttttctaaattaggggtttctctaggaaagaatgatttacaaataaaggaatccattaaccagattaaaatttcagaagtggatagatttgctactctttatagtagtgctgtagcgtctactagtaatgtagataaaaacaacgatgaattgttaaaattgtcttctctccagcacttatgtagtgactggctagaagaggctgagagtaatgacgatgagtctatggattctcaggccatacctcgaatgaggaagatttcgaccaaagtcaaacataaagtggtatgtcctcttttgactggtccaaaaaagaaagctaataagtttaagaaatgaaaggaatattttggaatagttgtggctttggtgatgcatctaaatttagatttatatctgaatgtgttaaggagcaaaatttggattttattgccattcttgagactagaaaaccatgattcaccccttcaaatcttaaaaacctttgtggtggaaaagattttctttggcatgagaaacctcctatcgggcgatcaggaggaatacttttaggagtaaatttaaatgtttttgatataggtgaaatttcagaaggggacttctatgtgaagtttcttctaagaaataaagaggatggtttcaaatgggtttttaatggcagtagcaccaataggattacaacggttgctcacaaagtcattcgcccgacccaaacggcgtttttgccagatagaaatatcatggaaggggtggtgattttgcatgagactgtccatgagttacacacaaagaaaatggatggtatcatattcaaaattgactttgaaaaggcttatgacaaagttaaatggcagttccttcagcagacattacgaatgaaagggttttcacaatcatgatgcaattggatttctaactgagttgaaggaggaactgtaagtgtcaaagtcaatgataatgtatgaaaaaatttccggacatgcaaaggcttgagacaaggggatccaatgtccccaattctttttaacatagtggctgacatgttagccattcttattgaaagagccaaagccgatggccaaattagaggggtaattccatacttagtggatgatggtttgtccattctccaatatgccgacgatacaataatatttcttgaacatgattttgaacaagcaaaaaacatgaaggccattgtttgtgtgtttgaacatctctcggggctgaaaataaacttttataaaagtgaatttttctgctttgggggagccaaggaaatggaggaccaatatagacaactgtttggttgtaattctggttcctttccattcaaatacttaggaatccccatacactatcgaaaactcagaaattctgattggaaatgtgtggaggataggtttcaaagaaaacttagcacatggaaaggcaaaaacagctcctatggtgggagattggttcttcttaacttggttctttcgagtcttcccatgttcatgttatccttttttgaaatacctcgaggtgtacttcaaagactgaattactatcgatcgagctttttctggagcagtgatagccagaaaaagaaatataggttaagaaaatgggattatatatgccggccaaaagatcaagatggactgagtgtcctaaatcttgatatcatgaatagatgtttgttgagcaaatggctattcaagcttcttaatggtgatggtctatggcaaaaccttttgcgcaacaagtacttaaagggtaaacccctctcccacatgtcatccacagagagagagccatctctctggactgcactcttatagtcgacagctctatgtggcttgtcaaccaccggaccgtagctcctcacaccaagaaacccagtcttcccccagaagactgtcttcctcgactatacattctcctaccccaaacactctaacccagacagcattcgttaaacggtagcttccgcgcccttcctgcctgctgaaattgatgtgaatgatcgtgtcttcgacatcaatttcagtctgattagatatgtcattgaaacaaatccgttttgtctctgttttcttttcggatgagc

SEQ ID NO: 17948 - DNA, 680 bp, Oryza sativa
attttgggaagacatggttgggcttgcaacctctcaaatatcaatatccttctctgtacaatgtggtccgaaaaagacattctactttggcagaggttatgagcacaacaccgttgaatgtttcattccgacgatcaattgtaggaccaaagttagttgagtggaatgatttgatctctcgactagctaacataaccctgtcaaatgaaaaggattgctttatttggtcgctacataaaaatggccatttttcggtcaaatccatgtataatgcgatcatcaattccaatgtaagaatccacaagaggatcttatgggaggtaaaggtaccactaaaaatcaaagtatttatgtggtttcttcacaaaaaaaaaagtaatcttgacgaaagataatctcataaagagaaattggagaggaaacaagcaatgttgtttttgtaatatacaagagaccatccaacatcttttctttgactgtcatgttgcacgttttgcttggcaatgtgtcttctttgccttcaacatcccccctccccacaatgcaaaagatatttttggtgactggctaaggggagtgcctagacgcacaaaaaaaataattttgtttggagctagtgatttatgttggtcaatttggcgttgtcgtaatgatatagtttttaaccataaaaatgccta

SEQ ID NO: 17949 - DNA, 30931 bp, Oryza sativa
  unsure (1)..(30931): unsure at all n locations
tacagtagcttcatcacaggcatgcaagcttatgcgcatacgacactgcaccatccttcttctcccttacaatcaccctaccagcaacagtaagatcacggtcgaaccatgtgtaccacaagccacctccataagtttggaccccaacctcaagataacctccctttgttacctgcgtggcaagaagcaggatttaatcgccaattcatcgaattgtaccacgccaattaacataaacagaaatcaactacgaagagttcaaactctaaaccttggagacaggcttgagcttcagggatggactgtcagtatgcgcaccgattatgtgaaacccattgccggcagcatacctacaacacatcaacataatccaataataaataatgcactaatcaggacattcatgatccacaaaaccgtatagaattactacagataagtttcttcacaaaaaaaaaatagaaaaagtatgacaaattaaataatcctatagcctcgagcaatccaaggagtgtgaggacaaggtaaaagtggatctagcagaggctcacttggcgccgatggcgaaggcgacgatggtggagtggttgcgcgtgaagaagtacttgcggccgggctggagccccgcccactcctcccgctccgacagctgcgagaaccccgccgccttcagccgccgcttcgcctcatctgagacaacacattcacagtccagtttgcgtcgatcgacaccaaaggaggaagaaggaagggaaataggaatcgggggggaaggggggcgtaccgacggcgtggaaggcggtgggggaggcgttgaggaagtcgacgaggtcggagacgacgggggcgacggcgacggcggcggaggccatgggcggcggcggcagtagtggatcgatgagtcaggtgtagccgccgactttggtatgcagggatcggtgtagggctgtcaaaaaaaaaggtcgaggctcagcgagcagctcgaggtttcgagagccgaacccgagcctgagcaaaagctcgcgagctttaccgagccgagctcgagctttatcaagcctggccgagcttgaccgtgcatagtttatattgcatgtttaccttattaatataataaactaatagataaatatatatattagtatctatttacacaataaattagcatatgttagtacaatatatttattttaattattttctactcttttattagtgtgattaactaaaaaataattatacttatcaagagattattattaaaatatatattatactacttatggccgagctcggtagccgagctcgagcttgaaccgagcttgcctaaaagctcgaaagtgcagtaggctcggctcgagctcggctcgagcctgtgtcgagctcgagcttgggcagacgagcttgctcgagctcggctcattgacagccctagatcggtgaatagttgtgtctatgtattgtacccgtatatactatgttgtgtccggatgccccttttcccatcatctctccctatgtcttttttttaaaaaaaagtttctatacgaaaattgcttaaaaaaataaaattagtccatttcaaaaaaaatagcaaatacttaattaatcacgtgctaatggaccaatccgttttcgtgtttgtgttgggaactgcctcccgtgaagatagcgttcttttcccctctttcccaactcacttgcctcatttttcacgcgcacacttttaaaactactaaacaatatattttttaaaaaaaaattctatatgaaagttactttataaaatcatattaatctatttttaaagttttttattaggctaatacttaattaatttcactataatcgcgtgctttgttttccgtgtcgagaggtgcccaaccttacctcccgaacatagcctaacttgtttatacggggataatgttcctataatttttggaatcagaaaagaaaatcaaatggagtcgaatattatcgaatactgatacataatgaatatgagttagaatacgggcacgaatatttatcggaacataaagaaagacctttttaccattcttacaaagtcaacaaagaaatataggcagttttatccaaaagaaaataaattcgtggtatatataatatgttattctaaattaggctctttggttttctagattttaataaaaaatataattgtaaatatgaagttgtattcaatattcatattagaatctcaattttaaatgtaatttgtttcatttcaaagttattagtaatgaacaaatgtaattgacatggacacttcttactctttttaaaataataaggtattccattaaaaacaaattatttgatatattactataataaataatgtttttattatagataatagtaccgaatatagtgtatgatttgtaactagcaaatatgacatactggatagctgcataccttgtttctaaaataaaattatttaacaaatatgttgggatagagatgtgaacctaaagatggagataaatggttttataaagctatccgaataactatttaaaaattatccatatattttctaaccatttttcgttttcgccatataccaaccttactgtatctttttctgaaaaaaaaaatctaaattcgtttctattgtcaaaactatcaaaaaataatatccggccgacattatttatttccgaaaaagcatcccagtattataactatctgaaccattttcatccattcgtatattaatggttttaacagatggcaccatttacgtattgatacaggttgaaccatttgttttatagaaaagtaaaatgacctcgatatcgcttagagaggaggtgaatagatgatttaaaatgaaatacgaaagctaaagcgaaacatggttggattatgatactaggtcagattgtcggaagtaagaacggaccatctgacctgtagagcagcaatacaaacaggcaacaacattaaagttgatccaatccacaagtaaggaggcgaggtcaaacatcactacattagtgtggtagaaagcaattcaacaagaaaggtaaagggaaagaggatatcaccaaggtttatgtaacagtatatttttcggagttcaaattcttgaggggattctaatctctgttaaggagctcacaaatagtcaagtcttttaatctgggttgatgttaccaactgaaagtaaagatcctccggcattagtctcggtttgtgtttccaatcggtactaaagatgcacttttagtaccggttggtaataccaaccgagacaaaatgttttcagggacttggacttttagaaccagtactaaaacatttttagtaccggttctaaatctagctgagatatttgtgatttttgataccacgatgaaagatcagttgttaagtattggtagcacatgcatgtaatggctgttcatgcaaactgtaaagtcacactatcactgaacaaaaaaaaagtcaaatagccggagagtattgttgagaagaggccatatttcgaatgatggaatatcgaagtgtttggtcggtccggatgctgatgtaattagggatgaaaacggtacgaaaattttctggattccggatctattttcgaaaacagaatctgtcggtcagaattttttcgaaaacgaaaacgaattcggaaatattttcttggaaacggaatcgaatatgataggggcagtttccgtcggaactcggaatcggtcggagacttttcgggaaatttctcggaatttccggaattacaaaggcccataacatagtctataattcctccctagcccaacccaatttagcatcctaattcctatgtcactcaattcagcccaacccaatacacccaattcaaacttgagaattgaacttgacatgattgtgttttgtgatgtaatgttgaaatttgagacttgagaattggatttgacatattttaaagcttagtttgaggggttttttattccgatatattttcgttaccgtatcagcaccggtcagttttcgctccgttttcggttttgacaatatttaattccgttttcgtatctgggtttccgattctgattccgaaaaaatatgaaaacgaaaacaaaaaatatagtttccgccgtttttgtaccgttttcatccctacatgtaatgagttggagcttgatatcttttttttactgatgagtcaaactgattcaaccagtgaagaacatgagcacgggttgttttattgtttggaacatgtattacgagcttaaatgctcatactatgtaaccttgtggttgcatatatcctgcgggatgtagaggccttttttttttctcaaatccattatctaaaaaaataatgactgatccttaaaacatagaagaaccattttagggtgtagcatagagccacggcaaatcataacagttgattatgtgtgcttcatttctaataaaaaaacatatgatctcccttcaccaaatacatgatggttaaaaatgcaaagtatcataagtatctttcctaaattaattatttactaatgaagaatttatgatttaggcaacaaactgaagaggcccacaatttgccaaaacaaggcgcaatgactatgtgtaatttgggcctacatgtcaatgggaggcttagggcaggtgcaatagggaaaatgtacctactattagccgctggcatcagctctttttcattgctggaagaaagagggagtggagagagagagcagccgtcgactaaattgacaacgcctgtgcacaggcgcctagacacggcatgcatacgatggatgctgtgattggtgaaaagaataggtgagagataattaaggttggcccacatggaaagagcatctgtgactggttgatagcctaggagagagaaccaaggtttggcccacattgagagaaaaattaatgactcggttaaatattatattatctttaatgatatagaaatgacatgtaagctcatctaatagatggctgcttactctcttattaaacttgcccttatgttcgattctcacatatccaataattttgtatagtttttacactaataaaaaatatgaaaagtcggatttggtatgaacaacggattaattgtatgtttgccatatacaaaagatagacgcagataattcaaaattccaagttgtgctgcgcaactaaactaatcgatcaaaattccaacgaccgccagaccaaatcccaaccctttaatttgcatgggctcctgcctttgccatataggaattcccattgacgacaaccgtgtccggatgtgaactcgaattacgtatatacgtacctgcatgcatgcaacattccagttcacaccatctacaacagataccgggatcaaagattattaatctttagtcccggttcaaaagattagagctactttttgatctttagtttcggttgggaacaccaaccaggactaaaaatgagttccggttcgaaaaaaaatagcaggcggtgtcaaacccctctattatttttattatttttagtcccggttatttcgagtctcgattggtgttaccaaccgggaaataagatcggcatatgcggcagagatgacgaggcgtgcgcgagacccagaggcaatatcagttaataagttctatctcctcctccctcaccttaatttatctctttctcctcttcacccctatctcttcctcttcctcctctcctcattctcttcctcttcctcatcttctcctcccctctcctccccattcttaggcggccgggcagcggcggaggcagcctcgtgcgcggatccgggatctagcgcggccggccgggcggcggcctagcgcggagggccgcgcccggtggaagccggcgcggaggttggtgcggcggtaggcagtggaggccggggctgctgcgtgattttttttttcttttttccttaatgtgtgattcgatctgtgttgaatgattcgatctgtgttgaatcgatctgtgatgaatgtgtgattcgatctgtgttgttgttgtgaatgattttgagaatgatctgtgttgtgaatgttgtgaatgattggggattaactattactgtgaatgatttgggatgaactatataactgtgaatgatttgagataatgggcgtgagatatacaaaatagaaaaaaaaaagaaaaactccgattgaaaaaccgggactacaatgagttaccaatcgggagtaaaaagcatttctctaccagtgatacttttatgtatatatatagttttatatatttcaaaaaaaatttaaataagtcgaatggtcaaacatgcttaaaaaaagtccacgacgtcccatatttactatttagggacagagggactacgctatatagaaatactcgcaacattttgaaaaaaaaatcaaacaataataagaccactggtggagaaagcgtttgtagtcccggttcataaccccctttagtcccggtttgaaaaccgggactaccaatccgggactaaagatagatcgctatcttttgtcccgggtgaaataccgggactaaagatcgagctgaccttttttttttcatggccctgttgctgcatggtttatatatatatatatatatatatatatataaaccatgcatatatatgtataaatacacatatatatatatatatacatatatatatatatatacatatatatatatatatacatatatatatacatatatacatatatacatatatacatatatatatatatatatgaccaaaatatatatttacattaaagaaaatgtgtacatgcatatagaaaaatagacatgtattaattacaatctattatgatgtcttagctagctacgatttcgacgtagtagtagtcgttatctcagaagctaaggacctttgaattgtatttccgtcgtagtagaattcacccttgggatcaaggatttattcgttgatgaatcccattagttgttcttgaaccgccgcgataaattccttgtgtgtgatcaggttatccctcatgcgaataaactatatgaatgtatgaaattaattagtaattaaacaacaaatcgatacgtacgcaatgaaattttgaatttatttgtacgtacatcgagctctcttgtggtgatgatttggtctgcaaggcaatggcaatactcgcacacgtagtagccgcacaagttagttccctgcttttgctttgcgcactataaataaatgataaactgcgagagatctaattaatatacacttgtatgtatttgaattggagattgaatataaatatagagcatgtgtactcacaagaaaattgaacttccgcctaagtctttctcgtcatttgccgtggaccaaatgacggaaccgataccaatcgggactaaagatcccgggagggcctgacagaccctgacagcatttgaaccaagactaaagatgattgggactaaagatcatctttagccccggtttttattgcaaccaggactattgtgaaattcggccgactgacgaaagatggtttctccgcccctggacgaaaagaaaaacaacgatcagaccgggaagggcgtgcatgcaattgttggaacgtggataggcacggtatctatttattggtctttatccatgcatcttggaaggggcagaccggcagctcgaacgtcctgtttaacgcgctagggcgatcgagacgcgcaaaattttctgtgcatgcagcacgcgcgcgtacgtgtacgaacgcgcggtgcccgaaaatcgcattgagtatagcagcagcatcgttcagattgatcgatttccatctcaaaagaaacaggagcctttgctatttcctcggccccgaccaacaaacaaacaaacagcggatgagcggagagtagtcaagccgcgtcgtcgcgcgtggtcgtcgatcgcatcgcgctctctcgcggttgtcgtccaaacgcgttgaaattaaccaccgatcgatcgagatggccgtgcgtgtaaagccctacgagtgatcgccccggccggcgctctctcttccctcgtcatggggagggaggcgtcctcgccaccgcccccgccgccgccgccggcggtggtgcatggagccggctcgtcgttgtccggacagaagaggaaggccgccatggacgatggcagcggcgaggacgacaacgtgccaccatggctgaaactgtctctcggtccggtggcctacggggtcgccacgggcgtcgtcgacgacgactcctcttcttgcgctccggcagtgacgacgtcgatcgaggtgcggccgccggtggccactggtgtggtctccggatcggcggcccaaccatcgattgaacatgttcctgccgatgatgcggtggtcacgccgtcttttgtggcctcggcagccggtgtgctgttcaccggctgcgcgagtggtttgatccccaatggtgcagtctcggtatttccatgctttaattttcttggaccttcaatgtcatcatcaatcctatcgcacctccatcaacaattctcctcgactcgacgtcaaagcaacgcgtccatggcaagatctagccgcacctgtggcggggacgacgacatggcacttagcaacatcgctgcgccgaacgtcacaaacggtggcggcaacaacaacaacgacggtaatgctcttcctgatccaccgtatccttgggctaccaatgaaccggccaaacaccactccctcgccgagctcgctcgccgcgacatcaccaccatccaaggcgacgctcggtgcaggcgctgtgatgcacgcaaggtgatcgtctacaacattgccactaagtttcaagaggtgtccgactacttacgccaaaaccaccaacatatgcatgaccgtgcgcaggcgcggtggatgaaccctgtcgtgccgaactgtgacgactgcggccatgagaaatgcttgcgtccggtgatcgctgccgagaaggagcgcatcaactggttgttcctactgcttggggagacactgggtttgtgcacacttgatcagctcaagtatttctgcgcgcacaccaaccggcatcgcaccggtgccaaggatagggtgctcttctccacctacgaagagctatgcaaccaacttgttcctgggctaatcacaagacgtgaccagttgaggatgcgttagttattaattttttcggttgttaatttagacttttcaagatgcaaccatgcgtgcctacgtggttgttacattaggttcatctagagtctctgtcttggagtctcgtctctataagtctgtgagtgtttgagatagttcgcgatatattatttctctcttttatttgtaagttgtgcaactggatttgaatgtgggtgtgtattgtttgttttaatatactatttatgtcctttcagctttgaatgataggcgcaatttggtgtggtttgggatttgtccttaaatttggagaaatgttgattacggccaaaaatacctataggtctttacactttgttgagaaggtgctttatgttacttggaatatctgggagaaaagaaatggtttaattttttataatatcgctccttctcttttctcttggagagttctctttaagaatggtatctcccttttactccataggcttaatttgtttgatcattggattaatctgttgtaattttctaccttttattttttcaatatattaaactgtaggggcttccttccctcaagaaaaaaaatggcttcttaattcaattggagatttcaatgtgggtccagttttatttgtgtagatagtactagtagtatattgcgaaatttcactgctgcaaacttgtaattactgtatttacactaggttggatttgagatgatagatgctatgtagaagctgagagtacgtaatctatgtcgttagcagcaagtaattcaaaccaatggtttggtaaatgtaatctagctatatattttttttaaaaaaaactgagccagcaagagttggtgttatattgagcagagtaaaaacatttgtgcattgaattttacagccttagagtagagatatgtactgctgtagcactggttacaaactcacaatatgttcatttaactaatgttgcggtgtttataaatgcatttctttagtttgctcaactaatttatgtaagattactatttttttattttgtcaattatacttttccttcgcgttgatctaattcacttagttgctattggacccattttttccccacgatgtagtttcatgccaaactgtataaacaacacattgttgaccttgtctgtggatagattggtgtgttatcacttatcacccaatgtataagcaacccattgttgatgcatctatagtactgtttatatggaattattagttacccaccaatctaattattttttatgaacgcaaaaccttaatagatttatagtttctaaaaatacactgccttttacttatcttacatacatacctaatcggtgaaatgcttgccaagccacatagttctacgaatgcaaatcactaatccgttttagtttactgcacttgctatttatgttagatagcttggattcaggcactaatacatttcattccctttgtccaagtaaatacacttaatacatgatatgatatatcctaatactataaatttggacacatagacacatgcaagtgtttttcggtagtttcagcgtgggcggcgtgaacgatattatggtttgccacaaactagatcatttagtttgcattggtgtttgatttgcaattgtagaatattgtagaatacacagcttgtcaaactaaggtctcaatatgtcctgcacaatttttttttcataaaatcgggttatttagctatgccctgtaatgatgccactgaataatggtcgttacaattttttgtgtacacattgttatttggttatcggattgttgtggctttctattccatcggctttctttgtgtgtttacatgtgtgtgttaccccaacacagcttaatcaggagaaaatgggtacagatattagtaaaaattgttaaaccaactgaatttttgtttttaaaaatacaattccttaaagaagtgttttgtgcagtaactagaggaaataaaaatctcaactataaaaattaactcaaaaggcaacaatgtttgggaacagtcaaatactcaagaagtaactaaatttgttaataagggcctcagttggtgaacaaaagagggcatagtatggtaaatgttggacaatattccatttatattgtggtttgtagcagtggacagtctttaatattgttcagtttgaacttgatcaaaattcctgctaagtcttgttgaaatgttttaatatcttgctgcataatgtaaagggagaacattttaaatgattttcataatgggaagcattggtgcaaaatatgaatagagttggttttagttgcatgaatttgaattggtgggagataagatccgctccaatgctccatgaactcaaggatatataggccacatgaggcgttagaaaaattgaggcgttaggttaacacattacaataattaaataatatgaatagcatgtggaagagtttaggagtaacccacgtagtctccttgctttggcaattgctggacttcgctgtattcccatgaggtaatattgaaattaggccagtcatgttgtaattatgggtgctgatttttttgtcccctgtaatcctctctggatagctaccagctgggaagtgattgtaatgtcaggtttgttaaaacacgacgaactcgatttgaattgtacaagtggatcgaagtgtatcgctcaccacacgccttagatcgggtcgatcttcactgattgggatatatggctagcgaatcgagtatttgcacttcacgttgcttggcgttaagaacggcaaggtaccagtgtgtttcttttatattaattgggagataaatctgtagatgtgcgataggaagattgggtaatagcttgcaataaccattgcatagaatagctaaataaacgttctcatgtcatatgttaggtacttgcatgccatatttttaatccattgtttatcataggggttgttagatttagcatgcgccctctttcagtagatgtcacaccctgattttagttccagggattaataaaattatttaataaattattcctagaatttatattaaatattcccacatttacaagtgatattaaatgtgggaaataaaacttcctaaataaaaaatggcttgatttatttattattacattctccatgattaattatactctgaaaattctcggatttttcagagctcaattgttaatttgtaagatacaaaagaacatacgagtaattatttaaatacaaattaatcattaaatgatctggttataatttgttttaaatactttgagtgatcaagtattatgaggatttttattggaattattggagcatttgaagcgttttaatggaaaagatcatatgcaatgattaatttaaatggaaaagtaattaaaaaccctctcctaaatctaggccaattctggagaagtctcaacattttagattttcaaaactacttatacttttggagtaggaataacccttatgacatatctccttgaccgggagcatggtgtattcgaatacgtctgcaatgtctgcccagctttacccacacgatgagaacaattcgcgaggttgtaaacaccatagccgttcgagagtcccatttaccactagttactgcacagtggggtcttggttcatcatagtggtcaaactcttgccaggcctaggcaaggtatctatatcgtcacactttcatgaagcccactgttgtgattcatgccacccaaacaccttacgcatgattcaccacaaaacctgctcctaataagccacccaacaatctttcatatagtaggacaatgtactaggctaagtccaattacttggtcgtgtggatgggcgtaactatgtcatttctatggtataaggggataattataatccggttaaaccaccaaaatatctcaacatcccaaaacttccataccaacttcataaatcacacttcaaaaagcccattttaaccggattcctaagtttgtaaagatatttggaatagtgaaccacataaaatgatgactaaagcatcattctataatctcatgcaaaaatgcttgaaagtatttaatatctaaagagtaatatttcatgcataaaatgacagttatattaagttttctatatgatcaaaattttagttatgtcttgccttgcgccttaagatttcccgcggctttagcgtaatcatctgagtccacgtcagctccttggatgtcgatagaatttgctgtacggtctaacgtacgaatacgaaaaagatagcaaatagagcctataagcaaattgctacaaagaaacgataaaccaagaaataaagaaaattggagcaaggcgaaggaaaaaggagttgggtcaaaagaaattttagtttggaaaacaaaagagaggggttttggtttctaaaggttgggtttcaaataaagttgaggaaaaagagagattgggtaggtagggtttatttggtggttttggtttatagtcgatgctagaatagagtagcacaatggctagatatttggagttggttagccgatgctaaggataagcaacattacggctaaatatttggcttatttagtcgatgatacagcgcaatgactagagagttgggaaaaattcgtgtgggtttgcaagatggaaagtgctactctaaagctgtgagtgacagcaaagcggctaggattgcacatagtccaaggactagtgtgctgtggaggtcgggagagtagtgaggcttcaatcactgtacgcgtcgaggcatgcggtgtgaagggcaacactttgaccttggaactaggttatgccgtgttttacgatcaacgattcgacgtcggggtttgtagactacacgaatgtctcatggaagcgtaaagtttgcacgacaactgtttagtggctattggattagcaaaagaaataattgaaggttttagaaataaaaggaaataaatagatcaaaggaaattgaattcaaaatgggtttttaaagaaataaaatttaaaatggtatttgaaatgaataaataaaaggtgtttaaataaattaaaggaaaaatttagttttttaaaaaagggtttttaaataacacagaaatttaaatttaaaggtatttgaataaaatagaataattaaaaaaggttaattaaaataaattttaaattcgaaatgtaaataaataaatgaataaaaagggatttaaatgagaaaatttaaataaaatttaaaaatagaaaatttggtatcaaaataaagagtttgaaattagatgaatttagataaagaatttactagaattggatctatgatttgagaaatatgggtgtctatagagattgaaattgaaacaaaaaggaaagggattagtatgcagtggggcccacttgtcatagccttccttcttcctccttttctcctcctcgtcttcttttcctctgtctcacaggaagccgagagaagagagagagaagcgcgagcaaggtgacggcgctccggtggccgagaggtggcgacgccagcggcgggtggtgttcccgcttgttgctcacccgaagaggaggtcggccagcgagggaagcgagggaggaggccggaatggcgaggataaagattggtccggccaggagagagaaagctccggtggtggctcgatttagggtggaaggaaaggggaaataggaaaaattggttcacctcggcgaggcaagcccggatggcgcaaggatttggccagcggagctccggtgagggagatcggccggtggcgaggtggtggccggcatggcaggaaagagagaaagagagtttagagagctcggctgtggagggggaaagggcgaccgcggaggtcggttcggagaggagaagggatacttggttatggtggcggcagcgtggggaagtggacgacggcgccggcttcgttcttccattggccgaaaagggcggcgcgcacacgcggcggccgtggcagcgttgggcggtggaggtggaggagtacggcacgacgctccagctaggcaaaacagctgcagcggcggcaggaccgtggcgacggcgcgatgccgtgggcggcggcgtgcccatggcgccagtggcggcgcccacaggggaggaagagagaggcggctggttgggccggctcggctgggcttcggctcagttgggccggcagcccaagaaggagtgagtggaagggagagaggaggaaaaggaatgggccgaaaagaagggaatttcggcccgaattgattaggaaggtttaatatttttgtgtggagagttttgaacggaattcaaaggagatgaaagaatgaaagttttgggatttttgaacttgaacatggaatttgaataaaatttaaaggagatgaaaatcaaaggatggatggatggatgtggacctttttggactttggacaaagaaatcaaatagaaatcaagggaaatggaacctaagaaaattttgtatggagggtttttttataaaaaaattaaatgaaaggtttttaaaacaaaaggagtttgaaaatattttaaataaaatcaaggatatttattttgagataaaatttggtggaaaaatttgaaatgggtaaaagtgctccaattttatagaattcaataagaatcaaacataagacttggcacggaagtttttctttaatatttaaaaattaaaaattagaataatcaaaaagggaaggaaaggcaataatttaatttctaactttggataaatttgaaatggtagcaaaaatagatggaggcaaataactaggattttgacctccaagatatggggtatggattcttggtttagtatttgtggctaagggaagttagactttctaaggaaaaaattggaaatagtgttcttagcacaagagcaatcattcaaatattcgtgataatatcgttcttgtgctaagggtgtgatcaagccataggaatcaaattggcggcttgattcataattaaatagaagaatttgaatagttgatcttctagaggagtttgtggtaggtattgtatgaaggataaaatggggatttctaatgataggtctagataggagtttgatccaaaataaattccaataaaaaggaagttatactggtttagccccaaaaataaaaatggttaatgggatataacagagagttgggtcaatcagggaaatattggcccaagctaaatagtagactttgaaatcttgagtggataatttagatgaatgagatttcaaagaggaaatatttattggagtatagaactggattcggaagtatatgtggatgggaatttctacgggaacggaattggtggtagcttgataaactctagaggataggtatattgactcaaagggggattgaaaaggatatttttgtgactctagagatatttaggtggagattcaaaggaaaggtatcaacatttcatgtactctagggaggttagaaaatggcatttcatgtgttctggagatagctgagcgggaatcgaaaggatatttgtgggtgttggagatgttcgggaatgggttcaaaggaaatgtatttagagtcaaagttagagattaaataaaataaatagagagcttttgtaaaatttaaaagatagcgattaactttgcaaataaagtttaagtccaaaataaaagaaaagattaaaagtaagatcactctaatgcaagaatcgagaagagcataacttaaaatatttcgcaaaatattttcctgaaattttgagtccgttacagccttatagtcagcttgctccaatatgggagttggaaaaaaaaagtactctttttccttcaagtaccatacaatgtactagagtgtttccttttcttccctgatttcccaaacttcacctgaaataaacatgtggcagcaatagtaaggtggtaaatccaaattcatatggttagtcatagttctaaaaaaaggttatgccttatagtattatcatgtcacatgcatagtttgattttttttaatttagaagcatcacacaaaaagattcaataataagatggaagcaataacctgttcgaatttctcatactgagaaataatatcatcttctgacaatggttttggagcacttcgcttttccttttggccatcaaaagaagcatcattgttcctccagacatgtcgcctcggcaagaagcggcgatgtcccatataacaatatttgtgcccattaacaagtctgtggtagcaggtttcagtgtggcatgaaggacatgcatatttaccttttgtgctaatgcctgacaagttttcaaatgctggaaaatcattaattgtccaaagcaaagcagcacgtaaattaaaagtctgctttgtggaagcatatggctacaagtatacatcaatgtcattaccaggtgcttttgggccaagaattatcatagacatcaccatatatggatctttcatgcacatccaaggtggcaagttatatataacaagaactacagtccagatgctatatgaagaactcatatttccaaatgggttaaatccatcactagcaagaccaagtcggatgttccgtgcgtccaatgcaaatgaagaaaatttcccatcgaagtccttccattcttttgaattagcaggatgtctcttatatccatcatctactaacttctccttgtgccatcgcatatgtgttgcaagttttgtagacaagtacatccgttttaacctcggtaccaatgggaagtatcgcaataccttctatgggactttcttcactcttctcctccttgatttagagacattattatgcccttcatttttccatcttgaaatgccacaaacaggacaagaatcagccttatcataagcccctctatataggatgcaatcattcaaacaagcatcgatctttgtgtaatccaatccaagatctgtcatagtcttctttgcatcactatatgacttaggcacattactgctactaggaaatgccttgcataacatggaaaatagagcctccattgcatttgcactagatcatagaggtatttgatatttaacatttgtacaataaatgctagtgtcgaaaaggtaccacaccctggatataactcttgctctgcatcttctagaagtctgtagaatttgttagtttcttcgttagttactgtagagttatccatgtcatcattcaaaccaggtgttgagccacccagtgatcccatattcacaaccataggttctccaaaatcattcatcatctgatccataccatagttatcataattttcatccatatcaatattgccactgtcttctgaatctgggacgttttatccatgatagacccataatttgtagtctttctgcactccatggataaagagatgttcctttatattattctgatcaaagaagtgattgtttttgcactttctgtatgggcatcggaggaatttgtctgcattgtaatctttgaaagcaaactgaataaattggtcaactccttgctgatattcaggaagactcctattagataagtccatccagcttttgtccatggccgtagagtctgacattatcctacaaagaaaatattattttctaatcacttattatcattaagttgttaaatagtaagtaacatgctcaatttaaaaccaaacattcagtggtactctatttgatttcagtttcaggatgctagcgatgtttcacaagctgtatctataaacattatttcaattttggtgccgtgatagttttggtgtcgagcaatatttaagtgtgaatgtatttttagtaaaacaaaggctaaatgtacgtctatgaacatacagaaattgttgaacagttcaaacagtggcagatttataagttttattgttcttgtttaggtataacaatgtataataagtgtgcacagatacatgcaaactccgtataacatttaccatggagactaaaatttaggtcaagttttgatttaggagaggaaaacaatctcccaagattacatagatggtcctgtattcttaacagtttagactatgaatcctgaattatcctaaaaggaaaatataatggttcaggttataatcacaatggttgtaagcatttgatttagcttgcatcaaacatggtaattaaatacttatatagtactgttgcatgcgttggtctggtggctaagcacagtaattaagcttaatctaacagtattgccggcactaaacttccaatgacagtatgattgacataaggatcacgtagattaccaaattctatctaatttaatctaatcggctctgtgtcattaacggcaaggtttatgctctaattccagtaataacatagaagttagacactacatacatacatacatacctggaattctggaaatatgaataagtttccttaagtctctccgtaagcgatgctagagagaacaacagtgtggggggaattcctgcagggcaggcgtcagagccagaagagggccgggaggagaccactggaatggaacaggtgcctccttgtgtgctagggctgccgatcagccgcgcatgtgtgagaagatcgatagggaggaatagaagaagtgtttgagatgaagttaggttaaaaaggaagataaaggaaagacaccgtccatatgttttaaaaaaatctgcaacaactttattgctctaataagatgcgcaacaatttattgctcaaataagaacggcaacaactattgctcaagacaaaatccgatacgaatcttcaatcttgaggaatccagaaagaaaatcgatggtaaatcgagtcagaaagatcaaatcgtacacaaactcacgaaaccaatgacgaatataatcggattcaggcattggcagcacttgtgtcttggccgtcgggggtggaggccgacggcggcggtgaaggccggcatgccacacaggaggtctggagggcttttcggctgggaggccgaccactgccctgagtcagccatttcgttggcaactggtgaggacagaaaatgggcctgttcggttcttacatctgcagccatagccaaaaatagctgtacgaaaaagccaaatgatttcactgagtggctgcctaataggtggacgtaccctataataattcaccaactaactgatctttaaggcctgtttggtacagctccaactcctaaatataactccaggagttgagtctaaagtgacgcagctccacaactctagtacattttgtgagagagcttcacccaacttcactcccagttttagtggagctgaaactgtttggctgagctccagctccaggccaaacaagcccttacatcctcattccattgaatcaacgccaccaaacgaggggaggataggcgtggagacggacggggatcggagtcggagatgaggccgagccgacgcagcagcacgcggtggcgctcctcgacggaggtcggctcagagatccagacctcgtaggcggagaacgtcgcggacgtacgacgacacagctgctgcggccgccgccgccggtgctgctggtcagtggtcacgtcgtcatcggaggcggacgtgaacgagcacgacgatccagcgactcgtacaactcctcatcctcctcgccattccagcgacgcatgccaccgacctgtgccaccgaagcgcccgcctcgccgatctcatccacggtcgatcggtacagagtaaatcattttctttattgtaggagattacagatcagtttccatatgttgcctataagcatggaagctctctcatttcacccaagttgttcgtctacaagtatgtcccctgctttggttcttcaattatattgtcacttcattagatgtagtactttggatgacaatgagattggcttaaaataattctgcctttcagtaggcagcacagaacagatttcccctccaatgtattaggggagagattagattttctaagcagaaacgttctgagattcgaccagaaaactgaattgatattttagtaatgtactgtagtttgcttattactttccaagattgctctgtgatatgtaaggacagccttacttactagagattgtgatatttcatatggtggcatgagtgctgatagataattgatatgtgcatacacaagcttttacacattaatttccatgtcattgctaaatatagattgatgtgtgcattccagataggttgatgggaacatattaaggaggtgcttacgattcattgactgcaagttatttatctatctattatatactaaaagtctattaaactttctacaaaagctcttatgctaccacatggcgctctaaatacgatctcaagctgacatgtggcgttaataaaatccatcccttaattttcatttaactcggtgggccctatattctaagccgttgatttggttgagattaaaacaaaccagcgagctgtgcatgaaccaagcgcctctggaaccgctatgacccggattcccgtgcgggcagggtgatcgatcaacatgttgatctctgatcgatcgatcgatcaacctgtacagtggacacccttctcctgctcatcctagcctccttgcaagacatgtggaagccctgatgattaaatcactattcgcttttggtattcacactcctatgcatatgtacatgtggtttttgcatgcatactatacgctgattagtttgcttgccgaatagtaataaatccaacccatctctaacctctgcttcactccccttttctcccttctttgtatgtctagcagtttgagataaaattttatgataataaatttcaaacagccataacttctaaattatatgtttgatttttatctattcatcatctatctattataaactaaaagtacattaaacttcctataaacactcttaagccgtcacgtggactcctaccaacgctcctaaaccgccacatggtgctctaataatttaaagaaaattctaagaaaaatatctaaccgtcaattttcaattttcatttaaagcggtggacctaatactattgaccattggatcaaaactaaatcccccatcacccttctatcccggacccatatgcatgtacgtggacaattacatctggtagctacaacgtttatttatttgattgcttgatttattattgacattaggcaggataattatatatggcctcggtgtgctcgattgatgcatgcatccggttcctgattttttttctaaatacatgatatatatgtacaccataatttatcatcataataattattagatctatttctcatggagactgatttaggtgtgaacgtgcaagcgctagggatttacaataggagtgatcttggtgctgtaaataaacaattattttagacggtctacacgtttaatttaagatacacttgagcagctttagtatttttttcatcaaatcaacaatccaagaccatgttggctatttgctttactattatatcatattatatcttataggtcctcctcatacatatattatacaaccgtgtatttatgatacatcgcatgccaaaaataattattacacaattatatttaaccatccaatcgtattcataataggctatgtggagcctcgcacacactctaaatgaaatgctcacagatggattgtctctcaaactatgcaatcatattacaaacccatgaatgtagtgtagcctcatgttgtacccaatacatctgtcaataaataatgggcgacctaactaacatcagtaatccaattaaaaaaaagcaccttgcttactttatatttaatttggtaggcatgttttctaaacaaaataagtctaccttctatttagatgatgaagaagattataaataattgcttatagaaattatttgaatatgatatggtataaaggtaactaataagttaaaattatataagaaatactaacaaaaaatgtgaatatatcgtacttttaaagtgtggtagattttctccggtgatattctatccttatatgcttctcaaacctaacctacgatgcatgcccgcgcattcgtgttgagttgtataaaacaaaacagaaaatagaaaaataaatgccaatatgaactacattaattgaaataattggtgaaaatcttataacttattttgcttcattcttttttcttagatattaatgatttttcttgcatcgcatcaattttttaattaagtgcttagattattttttttctctatcgtacgccacagtattatgaatttctctacatattattgcaaatataagcaacatactaaggttaccgtacataatcggtttagaagttatatttcttactattaaatttaatttttaagggtcaagttgattaggttttttctttttaagaaatacaatagatcacagatatcatagggaaacaagacctaggatacatgtatatcatctctgtcctattcatatgtaagtaataattaaactgcatcaatataaaccaaataaaagaatcgctagctagatggtacaaataaaacacctttgatagcaattaaagtatttttaagatttgatagaaaaaagttatcccctaaagaaacacctaccttttaaattacatttaatttgtagatatgttttctaaatatactaaatttgtcttattttagatgatgaagaagattatagaaaattgcttaaaggaagattaaatattatatggcataaagctaacaaataggttaaaaatttatctaagcaatacatcctatgatacatgcccgcgcgaatgcgcgggctaccttcctagtttatgtaatttgaggataataaaaggaattgtctaaacatctagacatggtagcatctaatttgcttcaggaattaattgtctaatttgctcgatgctttgttctcttttctgccagcaaatatacaaaccaaaatgttaattcatttctcaaagctttatttggagcaaggttagagtgcacattctgtatattttggtcaatcaacatattatgactgccttttttttatcatcatttatctgaaaggctgaaacatattatgttcaaaacacctggtatttttttacattttttagtacaacaagaaaatcaagttcctcagctttttgtgaaacactttgtcctgaatgatggaggtagcatcagttatggaattggtctttagaaaatgatggtgtaaggtgatctgatttgttcattgagtaatcgtgcacatgtaatgtggcatgccttcctttataattatgaagccattcttaacaacggccacaagtttcgaaagctgatagaaccaaacaggaatataaaagtgaatttgggcaaaagtatggactgattcttcatatacttggaatggttggggtgcaattcttcatatactatgtgtgtattgtgacatattatttactgttaagacggtgataaggatttgagaggtgctagagggagaataccttcaatactcagtttatttcctgacctgttatgattaacctggatttcaagcattatacaataggagaatatttgaatattttgtggtgtcagtggtagaagatatacgttgaggacttcattaagattaatctagacgatatatttggactacaccgtatgtttgtgttctcactggaaaatacaagctctagtgcagttgtcaggtatggtgacctttgatttggatttatttatgatatttcctcaacaatctattaggttttgtgctctcactaatttcttatctatctcaaaaatttaacagatggttccttaatttgtagtgagtttggttcccgtcgctggtcctatggtccaattgtattttcagacagtccagcttgcatgtggatttgagcggagtgagttgattaatgttagcgtatacagaccaaatatgtctaacatcccctctccgtttgccttctgatatattcttttaccctgtgggaaagatttatgtaggctatgattgaatgccacaatattgcaatgtcaggcatataacacaggggagtgcagaaattctgttgagagaactcaatctggtaatctgctccaagcctccaatctttttgctattgtttgctttggctatgtactggattgaatttgaagatgtttatttgagcgtatatattattttcattcagcgttactggattaaaattcaagtatatcaaattacaagattgcatataagtgagaaggattggggtgatcattgtctgtaattcaagtgcataagacttgctgatctggtcaccattggaactggtctaatttagaattattggtttaaattgaactcctctgtcggtttcctacagggaagtgctgaatgctaatgccatctaaaatcagttccctgcagggaagtgctgaacgctaatgccatctagactctcagtatcctgtgggacatagtgattccttatttattttcttataacattgattgttcatgagccaatatctttagttgttagctctgaaagacagtatggtatgtttattttgctgtcaaaaaatagacaattaattgtgaagtgtaaagttaagtttggactctttatgtaattatttgtgtagcacatgcacataatgctaaggattaatttgattctaatttatctattaggagatttcttggacctaagtaaaataggttccattgaatacatgtttgtgcttttacatctatgcacgtgtaatacactgaaatactttaattcagttttgttgagggtgatgcattggttcagaaattcaatttatgttgtttcaaaatttttgaatgcagataatgtatctctgatggtacaaataaattgtagtcatatgagttgtaagtgatatcacaaaaatcattcagttttgatggcaaaatttactgtattgactgtttccctttatttctacacagattccaagcaactgactttgattaaagatgcatcaactgagcattgttagcaatacaaaattacctgattggcaattatgaatgcatcctgagcatcaccttcagtatatggaggttcatttgttagtcattcaagcggctcttgcttataacagttgtttatcttcaagttccaatttttttatccctaatgtctcattgttttttagaattattggtaaatcttgtacataaaagttatagtctttggaaaaaatttgtagtaagcaaggctgtttctgatttcctaacagctgttagtgtgcaggaattagagataagctatatatgaagctgcagttgtagaggtacactgaccaaacaaattgttattgaagagaaaaaaaatatctaaggttcccctgaatatttcaaacgaattgtgtgttcttcgcctccataataaactcatgtgagataagagttaaggattttgacctactttttaagcaggggcacttcttggatgtcctaatattatgtttgtttagtgcctttaaggagaacagaagcaatgctaggctcagtgtgctgcgtgtacgttgtagcagatggagattgttcatactacggaaatgataaagcattttaaagatgttttatgtattaatgaaataataaatctaatatttatatattttcctaaattttcggtgccattatttagctttttcgaggaataaactaaacggcatatttgcaaatgaaaaataatttgtgaataaaacttttatatacgtgttcataacgatctaaaagcaaaagctaaaaaataaactacgatgaaaaaaaatcttaaaatcaactccaaatttaagattgaaatttcaaattttgacttatgaacataggtataagcgaaaagatcatgttcttatattctttcaatatataatttataatttataggcaatggtaagtcatgtatgtttcttcatatcactcatctgtcatgtatacttgtacgcacatgtttgatttacgttttaaatatcaccgttgcattagcacaggcatgctactagtaattacaaattgttcaataagcatttgcatttaatacataagaaatacacgcttcgatcattgtatgacctagatattccgacatttgtattacatttataaagtccatgggtccaaaagatcatttttatatcacaaaaatttaatttatgctagtcatatcaccgaatgaacacaacacgcgcacacccattgcctatgagcactcaaatagcacctggtcataactctagtttaagcatcgtcatgactacagcttgctcgctcgtcatctgcatcgcttttctcgcgcactaaacgagttagctaacaaatgagccaagccgagcaacgattttagcagaaaaatagtttttcttcattgattttaaagaaatatacgtgtttacaatgaataggcagaatgatatcgttgtcgcataggagtgatgcgaattcgcggcaagttcacgtggtgagtgcacgacttggcaaacttacgacgagtttnnnnnnnnnnnnnnnnnnnnnnnattgattaattaattaattgaccattatttttaatttagcgtcattagctgtcgattaaaagtgattaaattaatttatgccgcgaagattaatttatgctcgtgtcgtcaatgaggctgagttttttccccaactttcccaactcactttcctcgttttccgcgtgtacgcttttcaaactactaaacagtatatttttttgcaaaaattatctatacgaaagttgctttaaaaattcatattaatccattttttaaaaattagtaaatacttaaataatcataagaaaatatgccgctccattttgcgtgcacgggacctcacctcccgaaccagccttcttctgctaaaaagtaatgtaactcacatcaccttagcaggaactctcttctttgaaggttgtccgtcaacttcacctggatcatctcgtctaatcttgtatcgtagtgcattacagaccgggcatgcttctaggttctcgtactcctcaccacgatagaggatacaatcgttcggacatgcgtgtatcttctgaacctccagtcctagagggcagactatcttcttagcttcgtggcagactatcttcttagcttcgtgtgttgttttggcaacttattttcctccaggagaatattctttactagtttcaataactcgccaaatgccttgtcactgaaacctgaaaccatttcttgtcttccattgcaagaattcaagagtggtacccaaatttttgtgcccctgttcgcaacctgggtacaacggcgtcttgtggtccgctagcatacgttccaatttcttgacctccttttcactttcgcagttttccttgacgtcccgcaacatctgaccaagatcatttgcagcgtcgttatcttcaacagccccgtccacctcgtccgttgtgtttccttcaaatccaccataatgagcccagtccagaatgttctcgtcctctacttcatcttcttctgcttgaacccctagctctccgtgtgaggtccaaacattatagctcggcatgaagcccgtctcaaacaagggaaaatgaatagttcttgatgtagaatactccttctggtttttgcatttagtgcatggacaacgggtaaaacccttatgcttgttagtttcggccaccctcagaaaataatgcacatcgtcgataaactctttcgaccgtcgatccgcgtacatctattgccgatccatctacatgacaagcacaaaaatcgataaaaataatccacgaaagtaaaaccaattaaacaataatttatataattattcatgtaataattataaaataacatcacatattactcatgtttttttatatttaaagttgtaaacaaatattaaattggttgtacttattttaatttcaaattaatttagttttctattattttagactaattttctatctttttactttctcatctcttttatcataagtttttataaatttctaaacaaacctattttctatattttttccctacacaaactttctctctcatcatcttccattcaagtttctagaggcaaaaaaaagtatagaaaactaatctctaaatgtaaatgccaagcaaaaaaaaatagaggaggatagattactaaccttttatacacctcaaagttgtatattatcaccaaaccaaattcacaaaaaaatgggcagcacctcccctctcctcttaaaaaaaatgaagccctgctctggatgaaggaggaagaagaagatataggcatgctaactatagatccaggaactaaagattggaactttagtcccgggactaaagatccctgggggcctgacaacctctgataatcggcgaaccgggactaaaggtcacaagattcctttaaacttattaaccaggacgaaaaatggtttttagtcccgggggttttttttttgaaccgaggctattgcggaatttggccgaccgggcaaagatcacttctctagtagcgaaggatccaccggcgccagtgacgggaggggtggatccggcgccctcttccccttccccgcaggccgcgcggatcccgtcgcctctccgtcaccccacgcgcgcggatcgatctagcgcccgctccccctcccgcgtgtatcccggccgccgcttgtctgcccctcacgcactcggatccggcacccgctccccctcccactgacaatgtgggcccacaagtcagcctggtagttcggtgggaacggataccacggttgttttctttttaatatggcatagatatcgcgtgctttagttatggaaccgccggctatatgtttccctttttgtcggttctgttccctttcggccaaaggaacctcctcaatcctttctaattgctattcatcccccaaaaatattcccacccgtgcattgcatgatcgatctcgattaccaaagggatgataatgcatatagcactgcattcgttcgtaaatataagcattttatttagtgcatcttaatcgattcaatcctacaaaaaatatatatacatataaaccatttatattattaaaatagatatagaatatactatttatatttaattacatataaacttcaataggtggtaggtaggggtgaaaacggtaggaatcagtaacatctcttcggaagcgacgcttgatcggtcgataatcgactatatttatcatttaaactactcagcgccgacattaatacgatgcataaagaaattagaaaaaaacaaaattcataaatacccaaaaacggtacggtaaaaaacggtgccctatatacgaaaacggcgctcggtcgatcggaatttccgtaaccgttttcacccctagttgtaaggatagggttagagtcggctttgtgacccgacaaccctttaaatagagaaaaatatgtcacaatgtaatcataacgactataatattccaataatctaagcttttatcagtatacaatacctccttaattattactaccactcatatggagatggtcggaccaacgtataagccagttaatttagagtgtggcatcaaacgttgaaataaacattaattagtacatacatgtttgatcacagctaaacttttattcaaattagcttgtgaccattgatacagggatgccagcacaaaagtaaactggcataaaacagtttctagagttggcactgacgtaattcaacgaatgag

SEQ ID NO: 17950 - DNA, 18995 bp, Oryza sativa
  unsure (1)..(18995): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnaaatggatttatttgtatttttagaaaacttctataataaaaaatattttgtaaaatatgcaccgtttaacaattcggtaacatggtcatgataaataatgaagtagccactccgataagcactttagaacttaaccataaatttattacttatgcagtaaaactaaatatgtagtgtataatatactttgtgaatctagaatagtataatatatcaatcgtatgtccccgataaattctatgtaataagttctatatacaaaccagtgtcaacaatcgtcaagttatattgtttatgatacatccatgcacaatgcacttaataattagttgacatccaataagcacgtacgtaatcaagcaccgcagatatatgatgatacttagtgggaacccattaataaaaaaaatgatagattagtagaggatgacacaaaatcacaacaaacaatagttgactacaaatagactatgagtttaagcaatagcgttcctatacttctacaaacacttgtgagatgtcatgtgatgctctaataaataggaggaaatttaagaaaaaatataaggagaaaacaaaacatctacccatcgatttgcacttaaaccgatgaatccattattttcaaccattaaattagatttattcaggtaagcccttgcttctataaactagctaatccctctctatacacgtacatatacaagagatgacaaaaataaaaaaagaagtgcgtgtatatatgcacgtacatatacgagatgtcaaaaataaaaaagaagtgtgtgtatatggtccaccacgtctggtatttttcaatttctttctttgtagcccttaggttctccttaaattatacatatatgtagcgaccactctttgcgaggttgtcgaagaagccacgttgccatggcgccacttcatgtcacccttgccaattttcttgaaaataatttttttgactaacgatataaaacgcaatcataggcggtcgtttaaacgtgtgcacacccaccctatgaatacacatacgcacaccctacctgctatgagagagaaatatttgtcaaaaaaacatgaaaaagaacgaacatacgagagactaccattcggaaaaaaaaacttacatacatacgtacaataaaaaatgtcatatggaatcatattttatcccttttaattatgtcgttctcatataaattgtgttaacaattagtacaaataattttgataatatagagtatttctttgtacattacccatgaacatgcgtaagtgaattagatgtataataaatgaaaaaaaacatcaaaactcatattatgtttgcaaaggatgatgataggtaagtttacatataaccaaaacaaagtgattttttgtttgaatatgatagacactatcatttaccttatcaaattcacagtataaatatttccttcttttatggaaaggttacgaggtaatatactgttcttataattaatatgatgatatatgactttttttcagatttttttatataaacataaaataaattgcccgcgtatctacgtgggctaccttcctagtttacttaattgtcagattgttgcaatattaactacttccataacgattgtgcataaatccctcatgttatggatatattgggcccgtatgtcataaatgtcgttttggacttgggtgagacggtgatacaaaatcagcactccacgtcatcagtagtactgaagcggtcccacgacactccatatcatcatacatattgaagcttgaaatttttttataaactattttggtcgaccatcaacttagcctggcaaaaatttttaaactccaggcatttctatgatttgccctgaacaacacagcgcatgtagcctaggacctaggtttgcttgacacctaacacttggaatctagtggacagcgttagccactgttagataatgaaaggacaacgatggccaccaaggtaagggtggatggttggccatgtctagagactacatgggtggtgcatgttggcacttagggggcaacagttgagatgaatggaaggtggtaggacttggtgatggatggaaggtattggggacttgggaggtggatcgagggaaggtgttagtgctgcaaccatgttggacatcgttgggagaattggagacagtgaggggagcaatggaaacctaattttggaaccgataaatacgtcgactatgttcaatttaggtaaatgtacgattttcctaaaagaaaacaagtaaatggacaaagtaggcatgtgtatagtgatcaccaatatatatgttcataccagtttaaaattgggccaatagtcgtacccacaggcataaaattaaaaacatgttggacctaaatatagtcgtaccttgtgaataagtgataataatctggtaccattgccatccctaattaatatgttgcagtacacttagaagagaaagcaaaagctagcaaataatataagagaggacaaggaataatcctcttatcacctcatgagcccacacccttgtgctaagatggcgatactacatgaataaggcctgtaaatagcatatagcgacagttagtggtggggtccaccgcatgctttgcacttagagattccttttgttgagtttgattcttggtggatgcatggttgagtggagctatcaaattaaaaatactaggcaaagttaattctcatgagtttattgcaccgctacagaatgacacatttgtatcacctatctggtagggtatataaacctagcactgataagagattccccgcccacccaccaagtccgtgctctccaagagcaagaacccagcactaatgacaccaccactgcgtcggtttactaaaacaaccagcattgatagcatcagtattggtttgttaaaaaaatatctctgatgtcctagtaatcagtattggttttttcttttttgaaatagctggtatagaaaaccgctgagctctggccgctgcgtaatccatccacgcaaagccgataaattctctctcaatctcttcgaatcatctcgacctccccatccacctcgcatctctcaccggccaagcgtgctccacatgatatcgtcgctctgcgctcatctctagccatccatgagtttttgcatctcttcgacgcggcggccccaacaccactccctctcccgtacctcccctcttcagcacaagcatcaatcccctctccccctcacctctcttgccagcatcagcgccactgtcaccacacatcctccttgccacctcccatcccctctaccagcatggtggttgtttgaagctctgggcctgatagatccggtcacccagagttgccacaagctcagcacgacttgatccgattggttcaatgggtttgacagcagcaactccctccctcttccatagcaccgcggcggctccctccatcttccttattacaacgggcatctgtcgggtaccgttccttctgccttaggctgctagatccaaccgtatggagattggggcctccaggattcggaagccttgaggtcccatgcctccgacttcaccaccgtcctcaacatccctagtggcctgagtttcacggtgagcagagacggtggcagtaggctcgtcctccgaccaactccgaccagcaacggcgcaacagtgtgatatgatgttattcgtttatcttcttggatttgtgattgattctgggacttgaatgattctcagacgtgaatgattcatgtttggttcagatccactaggattagtgattctgtgattttgagaatgatttcatacgattttgggatgctgtgattttgtgattcacaagctcgtagagccatctcggtttgaaccgtctcagtgctctgttatttttgaatttgttcaaaaggcgtgagtgccagttcacaaatttggcaatgagcacccctcattagtgctacaatattgtagctccaatcctaaaactgacaccgatggtaatttggatctgatactgactagatttaccaccttttaatccttttgaaaacttattgtacaaatagatccgtaaaaaaagttattctagaaataggcttttcacggcgccaacaacattagcattatggttcgacatgacgatgccaatgacgttggtatcattcccctatctctcgagtggaagctaagtcactaatgtgacaggggacggcgcaggggaccattttgtaaaaaaaaaataaaaggaccaatttgtagtagaaaaggatatatttgtaataaaaaatatctacaaataggtcctcagcaccaatgacaatggtactgaggacattattttatcacaacttgatcatttttattacaccttggagccaataatattggtgtcgtccccttcacattagtgacttagtttccaccggagggttagtgaatggcaccaatatcattggcgccgttacgttggatcacggcgtcaatggcgttggagcagcgaaaaagatcatttctaaaatatgtttttttgtcaatttgtagaataagttttctaaaaggatcaaaatgtgaaaaatctggctgatactgatggtcggatctttagtagtgttggctctgttttgtattgcaatccaatatgcttctcgaatttgaaatttaattttcaagaataatttttatttgcttgtttttaggtaatcatgaaaagctatggaaatttttatttgcttgtttttaggtaatcatgaaaagctatggaacggaggtgatgaaaaaaaaaaaccctaaaattaatccggaagtcaaattcaaaataactaagggaaagcagtcgtacatgcatctctgaacatcaaaccaagaggtgagcagaggcgttcccatataattagaaaagaaaattagctatattgaaccactttatattgaaaagatcagttgaattactgccatactcaatcccaacaatcactgtatattgtgtgctaaccattctgtgttagttaattatagcttaatatgtattgagcattcaattatcaatcctttaattccatgctgctgtttttcaagtgtaatatattagggcaagggcaataaaagagcccttgcttactctaattattatccaactcatctcgagctagctttgtagttaatgtatactctataacttctctaaatttataggactagtatatgccacatctaattttaggttgctatattgtgaaatagagggtctctttcctacagaaacatttgtcagggaaacgtgaagaaactcttggaaacaacacagcatctattcagcatctattcaaggactgcacattcacaaagggatgtttgggatatatagggtcccttccagattgaattgcaatcacgctttcatgctaaacattgccgacgttgccttacttgattggtgggaaagaagaacgagttactgccactactacaaaaaggcttttcccaggcggccaaatcatattttcgcaagcggacaagccatccgcttgcacctcaacgccttcgaaaatagttgattttcgtaggcgcgcaacaggtccgcctgcgaaaatagcttcgagcgctaaaaaaacatgggcagccaccgtcggacggcggtagcttcccgttcccaatccaaaacattcccaatccatcccgttcccatccattccccattcaatccccatccaattcgtccacttcatccccatccaatccattcaattcatccagttcatccaaaatcaccgaatcaattctagcaaagaaagcaaataaaaacattcgaaaaaatcacggccgctgcctagccgttgtccgccgcccagccgtcgtccgtcgctgctgccgcacgggcgcgggcgcggacgttgtccgttgccgccgccgcacggccacggcccgcccccctccggccagatctaggagggaggggccgggagccaccggccaccgctctccccccgccccctctggccagatctgggagggaggggccaggagccgcgctgcctcgactctcctcgccgctgccgccctacgccgcgggagggaggggcgcgcccgccgccgccaccgccgggagcacacgccgccaccgccccgcgcccggctgccgaccaccggtctcccctcttcgggcagatctggaggggagaaagggaaggaggggagccgccggcggccgccccttctgccgtggggagagtaaggggagaggagaggtgaaggggaggggaggggatgggagaggagaggagagtgaggggagaggaaaggacttagaaaaattttagcccatatgccacatatatataccacgctaattttcgcaggcgcacctcatatggtccgcctgcgaaaatgattttcgcaggcgccacttaagtggtccctattttcgtaggcggacatcaaatttaaccccgatttatatttttgtaggcggttatttagctctaagcgatatgttcgtctgcgaaaataagacccctacgttgggaaaaatgttttttctagtagtgtacgacaagagcaaaacaaaaggaatacactccattcatatgcttctccgctgggagatttggtgtgaacggaacaaagttttcacaaacaacaaactcacaatgtcgcatctagtgatgaaaattgtggataaaatcgagtggggcaaaaggccgaggcgctgttttgtgaggcaatccattagttactacaacaatcgagcttgtttggctgagggccagccgacaaggcccaacttgtgagaaaggaagcaaacgcacgccgtcatcgatgtaggctactggtgggccggctgcaggaaataagcagggccgtaatattggatagaggaaatagtaatcctatttaaaaaaaacaagactttgtctataagtcccatgtgccaacaaagaaaaagatactaatggatataattttaccatgtgcatcctcagtaaaaaaaatgttttgtaaatagacctttgatacctatctacgtaacgtttcccgcggaaagaaatatttacacgttcatttggaaaaaagaatatttacaagtacctcattgacttatatttacgagatctgatagccgagagaattaggagaaaaatataaaattgtgcatataattttataattcacacttgttaatcatgactatcttacaaataaatttcattaagcttcaggtcattcaaagtatatgatgaggatgttaggtcccgatcttccaataggtactgataaacagtcgatttgggcgaagtcgcgatacaactcaatccggcttctgaactaacacactacttaggcccgcaatcacagcactacgtctcctctggttatcaaccgtgttgaaacccgattgacctaaccaagaaggctaatccctgcatgcgaatcgaagagcacaagcaacaacaaaatgcatatgaatgattaagcacacgaatttggggttccacaaaccgatctagcggcgaaactgttattgacagaataatctaagcaaaacccgactctaaacgatgacgaccactgattaagtatgattagggacgttctagggttgccctaggatgcacacccccttgggctaagccacgacacaattataaggcccaaaacctaaatcagattcggactggatgagatacgcggcctgctttgtagattcccagcagctcggtaggaattttgacgtgggaccaaaaccatctgtaagtagacttcataagcattccaacaagtactcatgggccccgaaattccttctagatcagtggctaggtccgtttgaagttgatgctgttaggaggcccgaatccgaatccaaaatgtatagaacttgatctcttgtcttctatggaccaaaaatgacgtggtgaggtagaagtagacttgtagaaggttttgatttggtccccaatcaacttctttaatcatccatacattccttatgcccagtcttttttctttcgcccaagcaaatacctctacaaagaaaaacacaggaacttattgtgtagcaacgtttgttcaaatatataacaattaaatctaatatagaacatatgcacctttggttgattaatacataaggtagtcatagttatatccgagctagttgtgccctcatcatcctccccttcttgattggaaaccgtcatcggtttcactttgtcatggagcgtagtgaacttatctttatttatcacaacatctagtgaggaacatttcttgatggctatatggttggatcctgaaatctttatagtcgaagaaccacgtcactccccttcttgcaaaccaacatgtaactcatttaaacaattagaggaacaagatagagaattacttatacgcatgcggtcctctagacaatacatttcatcatgaaaaggaggtatagataaattcgaacaaatatatactcgatgcacattatatactcgtttactatcataattgccaataatatgaaaaatcacatcagaagggcatggcaattcaaatcatcaaatttgaatataaccccaagtatttaaagaagatagcaatttaaattcttcattctcgctagcaatgtgaataacatgtttaaactcaacacatggtggctctactatagaactaacatgtccattcactagttgtggcatggatataagtgaagcatcgcacaactcttctttatcacgagaaacatcaagcaaattgttttgtgacaaaagtatttcagcaattgattccactatgggttgctccaatgtagcataagggtgtgttcgcaggtggaggatgggaacccatccctcctgcacgcaaacggagcagccttttaacacgtgattaattaagtattagttaattttttttgaaaaaatggatcaatatgaatttttaaagcaactttcgtatataaaattttttgtaaaagatgcaccgtttagtagtttgaaaagcgtgtatgcggaaaacgagagaggtgggttgggaagagggagtgccaaactcagcctaagtagtggacatagttggcacatcataaatatgcataccttgagtagttgtagcaccattatcattaccttttttctcatcttcagaaattatagacgcttggtcaattgaacattcttcaagcatgcatggagctatagataggtgttgacgattgttaagtgccaaaataatgccgtcaatacctgcataaaaccataaatgtgaaacatccaacatagtggtagggtttatttctaacaatttccacgagtattggtgtatatttgtatgcaggtgatcaaccactaaagttgggagagaatgagcataaagaaaggaaatatattttgctctgacaaactcacatggttttgagctacaatatataaaatgtgcaatcatttggagccaaaacatggagtatcatgaagtggggcccacatgtcagcatcctaaagaaggatgtgtgccaggggagccaaccatggttcggccgaacccccagctggcccaatccagcccgacttcggtatgacggttgtgctcctcattctatgacagttacgagcgttaataccagtagaaaccatcatcaagaggacacatggcaagaggagaaggaagatgctctttggattctatggagaatattcctagcatctccactctcccaaggcaactatccacctataaatacccctctcctctccctcattcacacacaccaaagcatgagctgaattacaagaggctctagtgtactttattgtatattagaatagggagagaggaaggtagaaggaatcggaggaatctcggagttgtcggtaatctcctcctacttttgtatcttgttatttactctgctttaatagaaatatcattctgagtaattaagatttgcttagtgagaattaattcttggttagttcctaattagcatacgggatcattgttcactatagtccatttatttatagtgattgctttagtgtttgatcggcactagagtagttattaattgcgtagacgtggtgtctaggaaattaatctccagtggttgctgcgtatcccacagtacgtttgaggtgggtgtagaggtggtgacggccctcaagagcacttaagtcctccctgtccgggtacgtagtagagtgacatctgggaacagcaggttgccagtgcctgaagtattacgttaggattaaacttaagctttccctagacactgtttcttattaggaaatcctctctgccctctgcccacattagctttgttattctcagatgtcacacacgttcccttagaatcgatacccttggaatactcctaggggaagtgctacatcggtatatccgtgcgcttgtggatcttatatgtgatcgtaagaaataccaacaataggtctttttcctcttcatctttcttctcttcctcattaccttggttgttctcagatgcctgcaaaatattagtatccaaagcaataggcacaacaatacattcgttttgtaataactcagacttagttgaaggcatcgcaatattagtatcattcttggtatctctgaaaatctcatcaattctattcctcatcctttcaagactatctttgtaaatttcatcgattccattcttcatcctttcaagattatcttcgaaaatttcagcaacacttattggtaccaatttcattttttgaccattatgtctaaatgtgtatgtattagcaatatcattatgcaaagcattattatcatatatccatggttgaccaaacaacaaagaacatgcttgcattgggacaatatcaaaatttgtagtatcatggtaatttccaatcgaaaagtttactctcacaattctattttccttgaacttaccacaagagttgaaccatttgatgtaatatggatgaggatgtggttgtgtaggcaactcaagtttctcaaccaaatctaaactcacaaagttattgcaactctcagtatcgattataacacgacatgctctatcctttacctcaaactttgtttcaaatagttcgtggtacgacctttgctctgctttatccatttgagaacttagcacttgttgcaccaaagtactttcatcacgtgcatctgtggaaggtgatgtagcagctatggtttgtctcccatccaattttatctaatttccataagagatgtaacctgccattgacagtagaaaagagagaacaacagaacaatattgttcctattaactacataacatggattgtagtggaggctagcaattggaagctgttggtggttcttaaatgccgattctataccgccaacatctgcataaagtccagataataaaacatctaacatagtgataggtattaaatctcacatattccacaagtattggtgtatatttatatgtaggtgtcaaaccccgaattgggagggaaatcagactaaagtgaggagaaacatgtatccatacaaggatgggttgtgaacttcatcaaaataccagagaatcagcccaaaactccaggaaatggatagaggagaaccaagagagaagatgagccgtatgccaggccaagagggcccagcctaggttctgcataccggacagaatacaagacacccattggaatgtctccctatcagatagtctacgggaagtcatgctgactccctgtagagcttgagcacagagcatactgggccatcaggaattggaacatggactttgaaagagcaggagaatagaggaaaatgtaaattgctgaacttgaagaatggagagagaaggcgtatcacaacgctaagatatacaaagagaggatgaagcgctggcatgttaaaaggataaaaatcaagaaattcaagcgaggagacaaagtgctgatgttcaactctagggttaagctttttgaccatgggaaattgcgcagtaaatgggaaggaccgttcgatgtcattgacacctcttcgcacggggcaatcacactccacgacgattcagataacatatttaaggtaaatggtcaacgtttaaaaattttccttgagccggatgaaactttagatgaagaagtggatattattgaattaatcgattatgaatcataatgatctcatctaaagcatgcttaatttcctgtaaaattgtcatttctgtgcttagaataagttagcttgagcatgtagaaaatttggaagccacacaggcccaccagggttctaatatatgaggaagattaaaatagataggatttgaattggtggaatttagatggtcagacattcgggatagaattaaattagatcaaaggaattattcgagggatgatatgcactttgcgacaaaattaaacaagaaagaaacactggaaacaaacatggaaaataatattttttaaataaatgtctaactcgacggttatatttttagagaatcaaagcaaactaaatcggttttaaaaagttgtcaaattctagggatgttacatgacgtgcgaggcgagatgacgaagaggaagctagagtcaatgccaatttcggagatgcgcagaaatcgatgaggcgatgggtgacgcaaacccaataattaattgaaaaaaaaagatactagcagcaatcagtaccactacaggagcaccatgtgtcaacatcctctatgccctccatggccggccatgaccaagtcaatgggccataaattctgcagccatttatggtctctctcctccctctcttggtacgagggcacaagttcacaagaacgagggagacaaagaaaaagcagaaagaacagtccgatgaagagatccagaccggtggcctattgtcatccagattggtagtagaggggcgtcatttatactaaataaaataaatcgttagtcctacctaaaatcgtattgtcgttaatcactaaaataattgggggcctagatgcgcttttagttcctcccggattagcaatggcggcctcaactgtggacatcaaagagaggtggagctagcctgcaggggaggttgcgacagaaggagcctagcgccagctggcaagggcggggctgaagcacgacgaggaaggatacggtggtctcgagaagtgatgacctttgggtggcccaccagatcggtggagagaaccctcaacggtggtggccatggaggggatggccgaaggtgggcggtctaggctatgcgtgcatcgcgtgatggagtctagggtgccgacaatgggaccaatggggacagttgtcacgatggaggttgaagagaatggtggtgtgcacatgctactgactcgacgcaaagacgaatagagcaatgaagaactagcccagctgaggagatcaatttactcgaaggtgtgaacgacgatgacaaggaaaacgaaaaaactaatggccaccgcagaagatcgctagtcgtagggacagcatgggcagaagcgtgcgagcggcgactagatctcttgctttgataccatgttggacagtagagggagagggatattatgaatattggacgcattatattgagtcttagggggccggtatatataggagatacacagatagagataaggaaaaattacatataagaaaaaaaagtccacacaaatcaatcctatcctaatacatatctagccgtctaactaccatatactataacagtttggtggcggagaaggatggcatgaacgaggatttgattgctggtggtagtgacaacgctgccatgcgacctgcctcgggaaaggatagagctattctagtggcttttatagctgcggcaggcgcttgataacgatattggtatttcttaacgacattactagaaatataattcccaccaatggcgccagaaatactcctggtatattatggttacagatttcatctgcaagcgcgcggatataccattgtagcatttcacccaagagtattccaagggtatcgtatttatttaatcccgtggaaaaatcatagtagagagaactatactaataatttatatgttacttgtaataattatagtctaagcaagggttgaggtaaatcaaagggtagagtgacacacaagcaggaagctactcattctcatactaaaatatctaagctaagtggaaagaaaatagaaagagaatctattcctatacttctagtatacatagtatacatacattctagttatatgattaactagctaataccctttttccgatgccctcttagtactacgagaagttactcctgactgtcgagttccttacgacatctcgtcttaccatacaaccggggctaaatacggaggagtaccctccccagggaattaacttaggactatatacacgcgcggaggaatacccatactgagctgtcaccatcagcggaccacctctcatccgcagcatataaccccaaataataatatcccgtaatctagacaccacgcctaaactaccagatactactctaatatcatcgtcatgacatagagtaattgcataagcaaacattatacccgtacctatgtatctccaagataagctagcagtataatcagtataacatggacataatgtaaagttggcactcatatactcggaaagtattccaacaccataaatgtataaagaagagtattctattaaaagtgcaaagcttacaaaagaggaaaggaaagctactagagccatacccgaactcttctgaaggcttccggactccgatttctattctattcctaattacctagctagatactactaaactaaacttgagagaaatgagagagctattacttgaggtgtgtgagtgaagtgagaagtgaagtccttatatagaggtagttatgacgattgtggaaggggaattgtctgaagtgccctccaaccgtcattggaatgcaatcctggacgtccacatcgaaccctgcatccaacggtgctaggatgggttcggccgaaccatgggctaggtcttcccggcccatcttcggctggcggcctgctctattgctttactttgtagacttgtgaattttggcccaattcatcgtgtcaattttgagtttgtggcccattgatacataagtctggttctcgacatcgtccgattgatttatcgtttgagttgatgtcgattatcctccactttattgtcattctctgcaaaaggttagtatacctaatactagtggaatattattattctaacagatatatgcattgcaagcattactagttctcctctattttggtaatactgacggtcgaaactgattgataacgaccgtcaacaaaaccccccaaccttgaaactttgctcgtcccgagtgaaggacgaaaggaaacaaagacttgttgttgatcaggagttgctactatgctgcatatctcaaagatataggtgcaaggtatatgtactctctctcagattaaataatctttggcacggtggcttacccttacccctgattcccacgagacactgcttctccttgtcttaggcagttgaaagatagaatagtaattagagcaccaatcacccaatctttattcaactcttattccagaagttttcaaatgattttgcaaaagaaagccaagttcctcaaatgatttactcagtctctccaagtgtatcaaaatgaatttctcaccagttgttgccttgttgattcctactctaaggttttgatatgtggagctcggtaaggatcaaacatggcatacttgcattcacatttattactgagtcaaaaacttagactaaagcagataactaaacatactcaagatcaagatcatgcaatgtgtgtgatatatggtggaaatgatatatgaagaataaagaaaattcttctcctttgtgcttactttcttctcccaaaaatccttcttttattgattaggagagggcatgattacattttttttcaacatcatgctcatgcttgatggagcataacttttatttttcataaccatgcctttccctcctctttttttttctttttttttcaaaaggatatttttttctctaggagaagaaagcacatgaaagcatggagaatttattttggtggtaaaatgggaatgtaatggaatatttcttagctcctagtgtaggagtttagcatgtgtataaatgtggatgtatgatcttgatcatagagcatgaaaagtatccacacaagtcacaagagtttgacaaagttcaatggaatgacaagcaaccaaaatatatatggtttaatcatgatggcacatttttggctttggtaggaatttataacaaatgaggaactttcaattttatcattttgaaaaaaaaaacaaaacatccggaattcaagtcaaactagtatcaggatcatagcaactcatatttactatctcatatctcgtaataacttagacttagatcagcaagtgcagctcatttacgtcaggttcccggataattgttggccacttatatttgacctttgagagagcacttaccaagaacccatatatcagagatataaaacagagcaactattcatcatttcaacaatgagaactagcttgtcttacctagcatgactcacacctatcctatctttttggtattttctattttgcaaatttttatgttgttttcaaggtttacaagatgcaattggaaagcaaatatgcaagtgaaaagggaaagtgtgatacaagttacctcggttgggggagagatatctccccccaagcttggctttcgctcagggtccttgataaggattgaacccctgaaagcgagagtacgcgtgaaggtcatcgtgctgttgctgcatcatgttgttgatgttggcgaactgagcatcagcagatcgttaccattcttgcgtttgtgctattagttccatgaggttttactggatctcctctgtctgcatatcaagggtgtccattctcctagtgatttcacccaagtcccaatgagaggaacttgagtgccattcacttggagatgaaggcacaccacttgagctggaggcttggttgtccccccattggatgtcatgaggcgcaagccaccggtcctcactggcacttgcccaggttgagactccgatgttgtgacgtggagcttgggtccatccggatgcatccccaattgctgcccaacctgcctcatacatctgtacgggtgttgaggatgatgaactttctcgttcattccttgtcatgttgtgcgtctccctgtatgctccacctacacgagattcttctatggtctgcaggggaatggttagttcatggcagttgtacaaatgataccccgcatttggcaacgggatttcatttgtacaaccggggaaaaagtaaatcaaagatccatctactccatgtttcagaatatgcccttgcactagataattctcgtcaatacacggacagcggctgagataaaagcaatttggtcactaccgacccctagcccttttgctatccgagtaatcagagaagtgcactcaacaggagcagagaactttatactttctaaccattaccttatcatacatttcacaggagcaattttcatctttctaaccatggcaaacatgataatcaattcatctcccctaatgggcctttgatcacctctaggaaacaaagtcatagcaatccatttgtgcatgagcctaagtgtaggattatggatttcattcattcttggtttcttgcaaattggagcaccagaaatgtcttccgaaaacctatttttctcgaacccagaaattcctttctggagatcgattttacaggtatcgtgaaaaccaagaagtgtacttaagcctttccatctaagtgtgtactccttatggaaaaagcgaaaggaaattccatcttctatttctttcaaagtgcacagaaattgcaaagtaagcagacgaaaaccaggctcatctaccacaacaaatctctgccaaccaacagctttccaaatagtacgaaattcaacatccatacctatcatttttagcagcttcggtgagtattctcgcgtgtgagcatactcccggtcgctcggcatgtagtaggcctgtctctcccaatcaatgacaaggtcgaggtcggtgtcgttcaggagtcgtcgtggagcttcggcgtcttccatcgagacatcggctgatgaacgagtgctagactcgtcataatgacttgatgaaaagccggaccccttgaacagacgagacagtcgcctcctgattctgcacaatggagcaagaacggactaactcggcggggttaggaatgacaaaaatttcacccgccggttagtttcaccaaagcaacttgtatatatgtaactaaatatttgaatttgagggaaactatcaaagcttgaatgaacttgagagcaaactttggaggggaaatgaaaatgtgatgaaatggggtggaattccctctctcggccgactagcttttataggttactcacaacgatcagaaatgacatgtgggacccactagccgttaccctgccaaaagtggcaaggaaccgttgcctggccagttcggccgaacccacagtgggcccaaccagcaccactttcggccattgggttccaacggtcagtgtggtcgtggaacagcgaagtttcgttgaaaacttcattttggtttgctctgaaaaattcatttgaagaaatttcctcaaaattaaaaatcctgaatgcaattttgaaattcaaacatgtgatgatgcaaaaattcaaattgttgaaagcaaatatacggatacataccaatgtacctgttggtgaaggtcgcgtcatttaaagtctgacgtgcaagactgtacctccttctagt

SEQ ID NO: 17951 - DNA, 759 bp, Oryza sativa
ggctatggccatctcgccattggaggcgaagggagaatgggactaaggtactacagttccctaccccgaccctgagcacaggatatggatccggtcatctggccaccggaggcgaagggagaaggaggcaaggccggagcttgtggcaaggaggtggcagccactcgtgtatttgcaggcaaagggggagatgagaaggaggttgatgcttggggttgcaggttgcggcggcgccgatgcttgggaggtggagagggagacgaggtgacggccaacactcactgatgtaggtggtgccgttcaacattcgggcatttggctgtcgttggatcccctcccccctcccctagggtcgggtcacttctagagaattgatcttttgttgtggtacaaaaaacattaagaactgatactaaagatgtatttagtactgattctaaaagtccaagtcctaaaaacatctttagttccggttggagttaccaaaaatacatcttgagtaccggttggtaacaccaaccgagactaatgatagaggatctttagtcccgcttgataacactaacccagactaaaaatccatttttagtaccggttggtaacaccaacccgagtaaagatgcttccagggttagttcaaaaggaaagcacatctatccaagttagatgtgtggagttggtgggatggttagacgtgtgagggctgaggtgacaggtcttgagttcaaatccctatccccccgtccccaaaactttttt

SEQ ID NO: 17952 - DNA, 39465 bp, Oryza sativa
  unsure (1)..(39465): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagggccaattccctacatgcccatgtaatttcacccaatcacttctacgcccctgaaatttgtttgatctcttatatacccctgagtttttattttgatcccttacatacccattccattagttgaccattagtttgatagttagttattgtagaaattactttattgtccttggtatatttttaaaagctagaaatgttttgtgtaaattatttgaattgtgaaaaccaataagaaataaattactaaatatttgttatgaatttttaaaaataaaacattatttcattaaaataaaaaagatttattgtaaaaaaagttctgcataaaatttgaaaattacttttcaacaaatatttagtgaaaaaagattcgttgtgaaaaaataaagggatgtaactagtttatcacaaattagaaaacaaatttaaaatttttaaataagttttagatcaaatttgatgaatttcatatatcttcccaaaaatttaaacctaaataacatttagtttttgctcttaattttccggtgaaactaatgtatggatttaataataatttttaaaaaataaaaaaatagtaagttttattttttaagttgggaattaaatgattatattgcctgtattttgtataagttaattttttcatatgaaaatttattgggtaggtaccacatatgtataggatgggtaatatagtcattttaaaatatttaacggtcaactaatggtcaactaacggagatgggtatagaggagatcaaaatgaaaactcaggggtatataagggatgatgtcaaattcaggggtattgaagggattgagtaaattttcaggggtatataaggaattttctcaagcttgtaacaacccttcctctaaaaccaccactataacaaaaaccttatatagaggctcttttgtagagacaattttcaaaatgcctctaagttttgaagctctatagtttagagacactttcaaaatcgcctaaaatatttttactctagacacactttagagacatttttatcatactttgttaaatttatcttgtagagacatcttttcggcacttaaaaacttgcctcaaatgtaaaggcatttaaaatgatgtaaagacatttttccaaatattaatatacatcaagtaattagatataagtaacacaaattacatatttacatgcaattatatgaggttgagatggttagtgcattgaagataaagatggtcaactcaagatgtcatgagttcaaggattgctaagggataaataaagatggtcaactcaagaggtcatgagttcaaggattggtaaggaataatttattttttgtttttttttcatagtgatttgctatagttgccgcaacatattaatgcctctacaaagtgcccctatttgcatagagacatattataaaatgcctcttagtttgtagagacaatgcaccaaaaggcacttacgagacactcttcaaaatgtctctataacactgtaaaggcattttaaaaatatctctatagtattaggagaatgtctctccaaagtatatttgatgtagtgtgcgtaaccagtctatccgactgatggacccacttacatatatcaccccacttacactttcgtttctcgcttcgtgtaaaagggttaactcaggaatgatatgattggagggacaagcacttataagttggtcccactcttactaaactagcattgtgttattaaacatgtgcacacagctctcatgggtcatacatgctaaattctaattaggccaggatgtcacccctcctcaaaggacctgacgtctccgtcgatccaacttacgcacatagccacacatgcatataggcaaatgtctaggaacacactccttcttagtacacatccgtgtgtttagtgccatcgccatatgccatgccatgtgcctcacacaaagttcacatgtgccatgctccctccctccaaaaccatgtagccaacccatcctacggacaggcccacttacacatatcatcccactaatactttcatcctcgcttcgtataaaaggttttgcccgtgagtgataaggttggagggacaaacacttataagttggttccactattactaaactagctctcaatgtgttactaaacatgcacacacaactctcatgggtcacacaggccaaattctaattggaccaggatattacaaagcttaaactatggaggcagcgcttttagggatatatactttgcagaagaatggaaagttgatattagtgcaaatcgtgttgtgatattcttaactaagtcaaaacaatgttaatatattcttagctgtaggtcaaaacaatcttaaccatagaagtagagaattacatgagtcaagtggctatgggcatttcgaagaattagtgcaaaccttagctgccgccctaaaagaatattctgtgactccagcggtatgtggtgttataataacatttgagaacttcagaattggatcctctggatcatatggttctgtccaagcaacatcaatgcctaacccacctaaatggcccgatttcaggtgatcaaacacagcatcgtagtccagtatgtgtcctcttgcaatattgaccagatatgatccctacaataatataacattatctttttgatcgaatatattataacattattatccaacatcgtcgtagtatactgttgcagattatcttgtaagaacaatatatatatgatagagcaaatttacgctagaataaattatagaacaataacactacttttgtaggatcaattactcattatggagaacgagataaaacctaaaagtattgttacatgcacaaaaatgacatgaacaaaatgcatacacctttttcattgtggagaggaacttatggtccacaatcccaacctataaatttcattatttagtaatgaaattgaagtagaggctttctaacagaaataaagaaatacaccaatagaagaactaactgtttcgtttgacaatagcaagcatgttataactatgtcagcttctccagtaaattcatacatatcttctggtccacctttcttatcgaccaattcatctatatctgcgcaggcaatacgttggaagaggaggaaaataagaaaaaaaactgggaaaagtaactcaaatactgcagctcaccacatggcaatgtttcagctgaccaatttcgtttggtggcaagaatttttactccaaacggtcttatcctcttggcaatttctactccaatagctccaaatcccaagataaggacctttatagtacaataaatacaaattacaatacaaatgaaatgctctccatgtaaagtgaaagaaacaagtaactcatacacaaaaggcatactctttttccaaatattgtatctccaactggactgcccaggtccttacgtttcacagcagtatccatcatcttctgctttgtataacacatccaaaatatgtgcagctcattaaaaatgacagccatagattatatatatacaactaaaacaagcaagttagctgccaaatggttaaagataggaaggtgacctatatcataaagaacaaaataaatgtcctgcatacatacgaactgataaacaagaaagcaaggtttaaaagagtcatcgttggtgtacgatggatgccactggatcgtccatcgttcataaagaaatcaagatatatagataaccatgcttcctagtttgagatgtctaaatattgtgtttgtacaaactagtacacatgctttagaaaaaagataaaacataaagatcacttccaaatggtcaaaagttgatctatttattaaaacatacttgcttccgtaggatacccagagtaagatagatagccatttctgcacaagacaccgcatttcctgttgtactgccatttatccgtgcaactttaattttgtgttctgtagcagcatttacatcgacacctgcaaaccattgtatgctcagtataagagtagctagttatgccactacattttcaaaatggcaagataaacctagactcataatcaccttctattccaacaccatattgcataatgaccttcatctgacttgccttggcaatgatatctgagtctataagtcgatttttcactatacataagtggtaattttgaataacatcaggtacctcctctagacctacttcatcaacctgaaaagtgcattccaatgtgatgagatataaacccatagatgcacattgtcacatgcatgtgacttcgattgagttcatatgcctaagaaaatatgtacaaactaattgtcatcaaacaacttagcatatcagtatctaaattttgttcacaataattcaaatggaagttgtaacacgaacctgctaattgagtgaacaacatatataccagaattttgagtaatatattgagctcgtacaaatttattggataagtaaaaaacatgtctttgtagatacactgcacaatagacaaaagttttggtactaagaatgtcaaaaactggagattttgaatgttgtaatggtaaggaaaaaagttggaattttagagccccaataattatttcatcagtttgcttccgcagttgaatgtaatcatccgcatgtaaattataaaagtggagctgaacagtactaaaaaaatgttttcttccagccgattgaaacagaatttcgtatgcggttggccgtctcgtctgcacccaggccaggtgtctacaaaaatcaccatttttccatgcagatagcgcaaccgcatgtgaaaacgggatttttgcatgcagtcacatatgctgaccgcacgtgaaaatagtttcagcgaaaaaatggcccgaaacgcgagcatcttgattctcccgaagccctagccattaccgctgtcgtcgctagagcagccgccaccgccgccgtcgttgccgtcactgtcaccaccgttgtgtcaacgttgcaaccgccaccgtcaccatcatcgcctcaccaccgccgatccgttgctcctgagggcgggggtagcggatccaccagccggccaaccgcccccgccgactgagcctgccattaccgttctcgcggaagggggcggcagatccgcccaccggccacctgcccccaccacctgatcctgttgccacggctcctgagggcaaaggtggcggatccacgttttcgctgtcgctcccaatggtggaggcagcggatccgtctaccggtttgaccaacgtaggagatctttgatgattggtggagtcgggctaatagtttagtgcaatgggtcatcaggaaaggcttaaatagtctgatcattcttgagataaggggctaccgctgattttgatcctagctaaggctgaatttgaaagtgattttggagtgggattttccgtggctctcgaaacgagataagctgtaagcaagtgattaatggagtactaattattataaatttagcaaatatgttaatttgatttttgaaaaaaaaaacttctatgtaaaaagattttgtaaaatccgcaccatttatcagtttgagaagcatgctaaggaaaatggaaatggagtaagttgctacacccctaactcgctaccagtggggctaagaaggcttaagagttaggatgttgtgaggatcttgatggagtgacttgtttgctatcttttgttctgttttgtatgctttgttcaattgttgtttcttcgtaattgcatctcggacgtctctcttcttctattaattaggtgaaaacccgcgcgttgccgtgggagttttagtgtgacagcaataagtagaaataatgtataagatagttagaagatataagcttacataagttgatatggtttatggtaatttaaatagtatatagaatgatgatccaaatgtaaaagtaaggtgatgtgtttttataagagaagaagatgaggaagataatttggaccatagatgaattatctaagggcaaaaaacaattgaggtggtatggcttaacgagagaagaaagcgagaaagataatttggacctagattaatcatctatgagctaaaaacaattgatgtgatataacattaattaagtgaggatgaactatatcggtatatagcatattataaaaaatggtggaaatatatatttaaatattatttgaattacgtaggatgatgattgaccatgcttgcattttaaaactctaaaatctatctatctatctattatatactaaaagtccattaaacttcctacaaacgctcttaagccgccacgtggcactcctacaaacactctaaagccaccacgtggcactatctaatctcaccgtcgattttcacttaaattggtagacccgttatttttcaccattagattagatctattattaaaaagtaataacttcctcatatattatataacatagaaacggtactgttcagccatagagtttatatacgatacagaacgttacgtacgtattgaaaataaaacaataaaactttcccaatgttacggtatttatttaaaatatgattttctacagtataaagataaaatatatttacttcacaaatataaatatatttagtcaaattaagatctattataaatatccaatcaatgttctttaaaacatcttataaatctatctattatctatcaactatatatatactaaaagtacgttaaacatacgacgaatgctcttacactgctacgtgtctttctaataaattagagaaattctagaaatttatttatatactaaaaatgcattaaacatcctgcaaaaactattacgccgtcacgccgtgctataataaagtagagaaatcctagaaattcagagaaaaaagaaaagcatatgatcctttaatttttacttaaattggaggacccgttattttaaatattagtttagatatattaaaaatcacatgctgctaatctctatctggaaaaaaaaacataatgtgcgtacgtcgtacgatcgtctccatcctaaaaaaataaaacttaaatacctacaccatataccataaataaaacagataaaaccaaataaataaaagaaaacatgcaaacgtacatagaatcggaaagaaatactaatcgtgaaaattcacactgatgtgttgtcaacatcctttaaactattattttattaaaaataacactacacagatatgcacattaaacttaatctctaatagataaaatgtcaaagcaactgtctgacaaaacctaacattgtgttttaagtacatctgttttgggttatttaattttggagatcagattctcaaaatatttggatttgttcaaaacttttttattcttatttgatgagtgagaagcacaaataatagatagatgagaaaaattaaattaaattttagacagtggttttgcgataataaaactacaatttagctttggtttttaagtggatcattttatgtttattttgggtgacattgagattttaagaatctgaaatttttcaaatttttttgattgctatttgaggagagagaagcatacatcatagatagatgtaaataaacaaataaacaaataagaattaggcagttattttgctacaatacaatccttaattcatcatgagaattatgattatccatgtatgttttttctttgccaagtagtattggcaaacatgaacaatccgtaaaacacgtataaaactataaattctatatactgagtataattgatgtacgaatgttatacacctctgaacccaattttgtcaattcattaccttaaatcgactcaaaacttaaaaataatactgttttcgccacctcttcctttctgtatatatctgtccttcaatgttgggtgtattacttgctatgccatcataaatattgtagagacatgtaaatggttgagttaagtggtgtcctaaaaggccaccataaacaatgtaactaaaataacatacttaccaatgcaatcatttgtgtgtgccaatggtgaattgagtgttaaaattgtactttaagatggtctttaggggcacggttacatcgatgcgagacccgtgttgcaaggcattatgtaagaaagcctaggttggctgctacggtcgacttcatctgttagaaaatcattcatgaatatttttaacggtgttatcgtattatctagtagatatgatatttttagacaatttatacatagatgtgaaaataagttatgcatatcgggttatgcagtgtagatgatattttttgtgtataaataatgtatcatttattttagtggtacaaatacagtttcttttattaaaagtgcacctaactttcaaaaacaatgataataagtagtggtgataaaagacgagtttatatatgaccaggacaaagggatttttacttaaatctaatagacattctatcacatttagtaatctataccttctattttacggcaaatatatttgtttttttatttagggtaatctacattcccttacagggtatatgtattaatgtatatactaagatatgatttattttagcattctttttcttgaacaacaaataagatgcccgtgcatatgtgcgggttttctttccgatttatattctgaaaatatcctccattttatattttgtccttacattgtttgaaacatagcctatgatacatgcatgcgcgcgcgaatgcgcgggctaccttcctagttatatactaaaagtccattaaacttcttacaaacgctcccgaaccgccaagtggcaccctataaatactctcaagtcgccaagtggaaccataataaataaaagaaatctaaccatctatttttacttaaattggtggacccattgttttgaatggttagatctattttgtaaagaaaatagaacatccggaaccaacatacggaaccaatgtacgtatgtactgtaagtacttcccttttgtccttccatattttcatttatgtgttattttctatttaatgagaaaataaaatcaaaatttcttttacaggtaaaaaaatcacaaatagaccaattattattaaattagagaaattactagaaaatcttaaaaaatacaaagcaacagaccatcgatttctacttaaattgatggatttaggttgttagatatttttaataaaaaaaatcccaaacctctttccctccctccccacccccatgcagcgttaaaatccactatataacataattaaattaaagaaaatcttagaaatttcaaaaaaaaagacaattatatctaaatattcattaaacatcctacaaatactcttaagccaccaagtggtaccttacaaacactcctaagttgccaagtggcattctaatccaaccatcgatttttattaaaatcggtggatccattatttttatattaggaggttagatatttttttataaaaaaagcacacattcggaatctcccgtcacgtatgtaccaacgaggtatattcatgagaaattaaaatcaaaattatttttacattaaaaaaaccacaaagagacctccacctattaggtctagcagctctcgctatgcatcttaaaatatcctacaaatacttctaaactgcaacatggtgctattaaattaaagaaaatactagaaaatcttaaaaacaacaaaacattcggctatcaatttgttagttttttaataagaaaaaacccaaactctctccctccctccccatcctcgtgcggtgttaaaatccactaattatttgataaatacctctatgacattcttaaattagagaaaaatcttagaaatgttggaaaaaaaaacacccaatcattagatatgacataaatcgatgaattaattgacacattattttaggtcattatatctttttttaaaagaacaccctaaaccttcttccctccctcctttgcggcatacggtgttaaaagtccattacacattttataaatgttgttaagatgttacgtcgttctcttaaatcaaataaaatcctaataaaattctgacaagaaaacaaaacatcttaccatcggtttcaacataaacatctgacccattattttaggttgttagattaatcattttgaaaaacatcccaatcctctctccctctccctacccatgtacatcgcgtgccattcttttttctctgtttttttatctcattgacaattaaaattaaaattatctatataggtaaaaaaaacatatatgtacctccatctattacttatatcccgttagacatttaacgactttctaccaacttaattaatttctcttgatatgcctatacaaattgaccttggtacttttaaaatgatgtttttaggacataagtaaatattttttaaaaagatgatcatagcgtccgaattacacatatgatctagcaagtcactaatcatagtaggtattcatctagcaatatagacaatagggtgaaaataaaggtgtggttggtaaaacatcataccgataagcatgtgagttgtacctaaggatcttaatagtggaacaaccttgcaatgcctttagcaataaatcaagtcagttccagataggaattaatgaccatgtcctttattttttattaaacttgctacaatacattgtaaagtcttgacgtagaacaatgtagaagcatgtatttgttataagacaatacactttagtgatgattcgtcgctaaatacattatgaccattagttcaatatttcaggaaagaaaatttagaacgtatgcctttacctcatgctaggttacatgttcttatatttccgtcccgaattgcaaagattaaatcatttcaaagatgattcagagaatgaaactatccaaaagaaaaaaaataaaaatggacatgaaattgaaaattgaacacatgttgctggatttaaaaccaatacttgatagaaaaattcaaacattttacaaggactgttataatgaaaaaatatatataattttaaaatacaacaaaaaatgatattattggatttcttttgaggttgtaagatatccttctggcaagttaaagtatcctaaattttctcataggaactacctccattgtttcaacacaatattttctcatataattcaaaactgtatgatctcaagtaattttactttagaatttatatgttgcaagggcaattataaaaatataatcagctttcaacacacaaaaaataagtttaattttagtttagaacaaaatacaagatattttaataaaaatccacccgcacttaaatattcataataaaatttcactcacattatacaataaggtactcgtgcaagtgcgcgggctacctttctagtttaataaataatagaattacagataatataatatgttggcatgatgtttaagatttaataattgttagtggatgatgacgtgcaatctttacatgttgagctttaggatttagtgggttgtaattttgtagtaagataggatgtaataatatataactcttatgcatgtgtgtgccggaaaaaaaatataaggaagaagaaacctatatcataatagcctttcattatgagttgaaaagttctaaaccagttaaaagccttttagtccacactaatctaactttgatgtttcagctaattcacttctcatcaaacataagctatgtaaaaagtgcaactagcctgaataaatggatagctctccaaataatccttggtgtagatagtagcagcaggccaatagggtccacagaataaaacccgtgtaatatcaccagagccattctgaattgagtcggccatgtttgaaaaacctgcgatcgaaagagaagacaatattttaaaatttacaatatgcaaaaatgaacggatagaaacaaacaaagccaaaaataagatggaagcggcagtggtgaaaaacaccaaaaccaagataataattgaaccaagttactgacagtacccaatgtctgattgatctcctgagaagcaaaaaatctaaaaattccacatgatttttgatgggagccaagattcccatatctttagtcaattcgatcacttatttacaacttcttttgatctgattcaaacctggccgtttgttcattgcgatgcaatacttcaaactactctgcgctgactaatcattgatgacctcaatcaaatacaaatcacttcggagatcaagaaactgtcaagagtaactgaaatctccagactacacaactacacacgctgtttgccagttcagatgaatttcccaactcgggaaagctccatagtaagataaaagagaacttttacggtacaatatactaccagtatatactggcagtatataaaagggaatattaggaatttgatagaaaataatacaacactttagtaatttttggttcaaattgaatttaattgagagtacctggtcctggatcttatcgtgcactaggggaggagcatcctgagcgccatttgatgacaaagcacgtgacgatagcacgatttgatgatagaataacgaagaaaagacaaaattacactttcaaactttatactgcaatctaattaaataaaaaattaaatcaatctacaacgttagatcatatatacttgtagtatatactagcagtatattgtaccgtaaaaatccttaatataaaaggataattactcattttaacctgttgcaaaaccttactatcattttaatcttaattttcttagtttatttattttgaccttatttttcaaaatcgaagggacaccttattttctccataccgttagggcttcatttcatctatgtcaaaatgataagaatgccaccacgcaccacgcacggacctgtgccgagacggggacgagtggcggcgcgtggatggccgcaggatgcatcgtacggccacttgcggacgtcatcgtcgtcgtgcggctcacatcgcaggaggcagccccactcatcgtcatctgctcccggcgcggtcgaagtgacaggtggacgcgacggcgacgttgtaggcgcaggtgacctgcctcgttggtgtcaagcgtgctctcctaggacacccggtcccggatctccttggacagtgaccagctgctcacattccagtggaatcccacatgttttttggccgccggcttcagagttttcttttatctgatctctatctctctagttcagaattcttttggtgaagagagcagttcaagctagtggatttaggatttagttcatgttctgagattttctagttgaacttagcaattgtactgatatctgaaaagagatgattcttgtacattctattggaaagctctctgaattttggttgaatataccagtccagattttcgttccactatacctctttgctctcccggccctctttctaatgagaagggcataaattgtatttttctataagttagctctattatactgcttttatgtaatagagtcagatcaaattcaattttgaaaaaaaaaaagatcaaataagcaaactttaaaaaaacaaggaaggtagtccgcgcattcgcgcgggcatgtgtcgtacgctgagtttaagataagtataagagcgaaatattaaatagagaacatctgccacgatttgtgagtttgagataagtataaaagcgaaatattaaatggagaacatctgccatgatttatccatcaattattttcatcagcattaattgcttaataagtttctaacctattagttttatagtatatcatatttaagtaatatctacaagtaattatttatagtcttctttatcattcgaaaataaggtagtcttatttttctttagaaaacatgtcaatgaaagtaaaataaggtatttttaattgcatatttattataatagttcattaaaggatgaattgaatgtgatatgaagctccactaaatgtatgggtttatataggctaatatgagtgatgtagtttgagtgatccatgtatgaacatttcatgtagggtgggtgataggctacatgcaacctaacatgaatacgataatgacgaaatataattgcgcagtaatattttggaaatgtcatgtaccatgaatacatgcttatcttttatataagatataagatagatctaacggttataactaatagttcaccggtttaaaagacatagaagtatcccaataatatagcttaaaaattatggttattttaatatccagcgctattgtgaagtgagcgcaactcaattggttaggtttcttgtggtgtaacttgcccacctggttcaagtcctagacttgacacgggtgctcgcatttacggctaattattctttcagtggtaggtgacgtaccaatcgacagcgagacgcctgtggtgacatcggcaatctcaaaatgtgtcgactcagtcttttggaggaactcaaaggtgcaggaggtgcgcgtgctgtgtttctaaacaaaaaatccaatattgttgattgtttttgttttagtttaatagctaagaaatagcgaggagacaacaaaacttatttgcttttttcttaaaaatatatgatccaaagtaatgatttttttaataatgtagttaacttgattctttaatttttaattttatagtaaataatctaatatatctcctacttaggctacattcaatctcattggttgagcttatgcatggcataaaaaacgatgtaggtcatcaacacaagattaattaagtattaaatattacaaacataaaaatagatttttttttaaaaaaaaatgtatagaaagtatttgcaaaacatgtacagtttaatagtttagagaacatcctcaagataaatgagggagagccaatctaataagtactttagaactcaacattaaatttattacttatgtacttaaaaaatatatgtacaaatcaaaagcgtagattgagtcattaacggttaaaatcctgactgtgttttacgagaaaaattacgatatatttttaaacaatacattttttatttgtgtttctgacaatatgtcccgagtaatattttaattactcattatttcatcttaaactatcaatgtaggcccattgatgcaactaaaagttatctatacccaataattgtagtgtgaaatgatatgtttatttgatattttatattatattatagatctaattttaggtgtgcgttttatgaagtaatatatttttcttaaactaccaccttcactaaatatttggcgttgatcatcataaataaaataaaaaaatcaagagaaagtataatataaaatctagtttaaatcgttgttttctttcggtagtttcactatatatttaacattggccgtcataaaataatacaaagaaagtgaaaatccagtttaaaaagcaatttttttccagtagtacttagtatatatgcagtatgtttttctttttttttttgctgtatatcatttattcctttctcgtttgtggttgttaactcgtccgtacgtaagccttgttggcttattattccggccaatattgtttaggtaagtattacacctaaattaggagggatagattatagatggccaaaaggcccgcccggctcggcccaccagccatcgggccggcacggcccgatcggcacttcatgccgggccgtgccggccatgggctgcacctcccgcccaggcacggcccatcagctgtcgagccatgccgtgccggcccgaaggcacaggtggcccatcgggcctttttcaaaataagtctattttttatccctcctctttgggctgttacatatgtatagctagaataagtctattttccatccctcctctttgggctgacataagtatagctaaaataagtctattttacatccctattctttcgtccatggcatataatatgtctattttgactcccctattttttttatcgggcctggctgctggcccaacgtgccggtggagggtcccaggcacgacctccgttgggctgtgccgtacttgggctgggccaaaataccgtgccatgggccgggccatcgggcctcgagccttttggcctctataggatagattactatttataatggatctaatctaatggtgtaaactaatgggtccaccaacttaaatgaaaattgagggctagatttttttttcagaatttctaggattttctctattttattagaacgccatgtggcagcttgagagcgtttttagagcgccatgtggcggcatgagagcgtttgtagaaagtttaatggacttttagtatataatagaagatagataatagatagtcacggtagttaggctttaaaatatgatcaaaagcgcaattacaacacttatagaactatcgaccgacgtgacgacagtaggagtaggaggagacgggcatacctcgtggaaggccggagccacggggaacaaggcgaggaaggagcggcgcaagagtggtggcgagtctggttctggctatttatggggagggagggtagtggacctggagtagtcttggacaacgtgcttgtattatgctgagaggtatcagttcaaaagataagcttgtgttggtatcgattgaaaaacttatgcttgcatttgtgccgattggcatcgattcaaaggttgatcaagttgtgcttgtaatttcgtggaacacgagatccacttcttagcacactgattttgctggattcgatatacacaccggatttggtagtgaacataatagcaaaatggatgcacacacccttcgcttctctctttaatttgtatcatgaacaccgaagaataaatggatgcacacacccttcacccgccttgtcattcatcctgtgtatattggtacaggtttagtccgattgcttgggacgaaccaaccatggccgcacgagagatacacaattcgtgagtcacggctagaaaaaccatcttttcacatgatggcatattttttttagatggataggcctctcggatctaattggcccgcctacgaaaataacaatggggcaagattattgtctacctgcgaaaaattttcacagcaaaatacctttatgttttgaaggcagacctaaagagatttacctgcaaaaatacctttattttttaatgcggacctcttaagatatctgtctgagatggaacctttagatcctccgcctgaaaggaaaaaaaaaaaaaaaccatccgacctcgtattatccgccaccaaccccttatctctatctactcccttcccctcccttcactcctccctcccagctgcactctcttcccctcccttcactccttcactccttcctcctagatccactccctcactacggcacgtagggcggaggcggcggccacagccaacggtgctgagcgcggaggcggcggcggtaaccagcggcgcggagggcggtggccacggccgacggtgagcgtgcaactagccactggctctcccctcccctccctccctcgcagatcaggatgctaggaaggcggtggcagaggccaccggcagcgcggaggcacgtggcgagtgggaggagagctggcgacgctcccctccctcccttccagatccactactataaaaaccctcaaagggaacgatctataggtgccggttcacttaaaaccggcacctatagagcttttcccaccaccctgtgatggaaaaataaaaaaccgacgcctttaaacactatatctgtcggttctagcgaaaaaaccggcatttatattataggtgtcagtttttaaaacaaccggcacctatataaaacactataggtgccggttctagtgaaaaaagccgacacttatactataggtgtcggttttttaaaacaactggcacctataatatattatacgtatcggttcttttttaaaaaaccgacacctataactttgagccgagcctacgagccaagcccatcaacgagcgcagcgcaccgcgtcgttctctactcgtggccacaacgactgtgccttatccacctctctctctcgcgtctctgtccctctctctcgtgcgtctctctgcctccctcctctctctcgcggtggccgcccggcggagccagcgagcactcgtaggaggcgggctcccacgaccggcggctgcctggagaggcggcggtggtggaggcagctgtgccctcccctccgctagatccggcgggaggcgaggcggtgggctctgcagccggcggcgggggcgagaactcgtaggcggcgacgggctcccctccgccctccgcctccctcctctctctctcgcggtggctgcactcgtaggcagcggccgacgggctcccgtggtcgcagctgcctggcggaggcggcgagcagtcgtaggcagcgtgttcccatgaccggcggttgcctggagagacggcggtggcggaggtggccgcaccctcccatccgccagatccagcgggaggggaggcggcgggcttccacgtccggcagctgcctaacgaaggtaggtgcggcgcacctgggcgacgccctctccatgcggcaatgacggcgagcgtggtgagggacgccggtggtgctggcgaggtggcggccggcggcataggttcttgagtttgtctttttgatttcttgttgagttctagttctaaacttgttgagtttttgttccaaacttgtggttaatggtttgtactgttcgctagttcttgatgaatacggtttgttgttgaagttgatctcgcatctgagagccggcgaagaaggggagtagatctgggcgagagagaggaatgacggtggattcgattttttctggggagtagttcggctcgatttgagccggctctcctttgtttttttggctcgagtaaagctaaaggtgccggttctattttctacatcggtgtcggtttcttgtattggtgccgaccaataggtgccggttcgaaaaccggcacttatagccgattcccaaccggcacctatgacggtttttgtactagtgagcgctcccctctcaacctcctcccagaaccggccggacgtattaaggtatttagtagactaatttttgatattaatctattaatatacaatttaccgtacccattattcagatcactacaatattatcagatcaataatctactatgtttacctagagcatattttttatacatctattgtgtgagtgttccctgtatttggccgacaacggttaaatactgggggctcgctctattttcttttgtatcatgctggtttactgtaacatacctgaattctaggattaaggaatttccatcaaaactagttgaaagggaagttcttcaattttgtaaaccaagaatttctattttaaacctaggtggagttgatccaactcttgcaagaataaaatttgagaacaaattaaaaactttttcatctttaacctaggacttggatgcaacccaagtgaaagcatgcatacttgcataaatcatattttgacttgagtccttcttatgcatttggattttcgatttgcatttcataataggtctcatgaatattaactaagatctagataaacaactaaaccattagggcctagtgttaactaatggaaaataatacatagaaaccatacaccttaaaaaaaatatcaacatggctaatgtcaagcctcacaaaactaattttgacatccatctgaagacatgtcatgaacatgaaagtgaacaaataaattatatcatatagggtatattctatcttaatcatctctataagcattctcttaatttaatactaaagtaaactcatgcataaataggaaaggagcttatgacatgtgtaaggtaaactgtaattctaacatatcaacatcacctcaggttaatgagagtccaaatataacttttataaacatttacatgcatttaggaaagagaaacacatataagacataagtcctgcgaattatctaaaataattcatgcaagataaaatcatgggaaaattcatgtaggctctactcaacacatacaactcactgtaattttggtataatttaataactaaatttggtacctcaaataaatcagccaaactaataaaaactagattaactgtagttcttaatcggctaaaaccatactttgtctaaaagtgcatttaactgcataaaagtgtataagtaaaataatttattcaaatactaggtcatttatcatgaataaaaataatttttccagaatttatcttctctgtttaggtctcctaaaaattcgaactagtttccaaagaacccatattcctctaatttctgtgagtaatctatccataatttttgagtgcaaccaaagaaaatggaaactaggtacatacacctacctccagtaaaatcaacactagctaatctgatcaacacattaagtattgaagctacaaaattagaggagaaaataattccggaaattcgtccaaaaaccaagctcacccatgtttctgcctacacatctctcttccacctagtttacttcgacctgggcccccttgtcagtccctctggcttgcccttcctctgtgcaacttccctagctgaccgagaaacactgagagggagagatcgagcgccgaccggctctggacgccgcgcgacgcgtggccacgacgtgtcgacaccctaaaaatgacgagctccatttctgcctctcccagacgcgtcgccactcttcacccaccattccagtgccgatccatccgagggagagcatcctcgctgctcttctccactggttctccatcgccggccgcgaagaagacgatggccgcaatcgttgatgagccgcggtcgtttcctcttctcttgcgttccatactctcctcaccatgccgaatatttctccttttgatttcatcctctctggtgcagccaatcgacggaaacgctgccgtgcacaccggagctctggagcgcgctctgtgcaccgccgcagtgacatcatcgccgttcccgcttatctggaccaagtcgggccaagctgtcacgccagcgtcttcgcctcgacctcctctccatttcccctcaagaatctcgaaggatggtgctacgagtgtggagatcgtccaccgtcttctccacctccggtcaccgtcgccgttgccgaatccaccccctccggtgagtaccaacccaattccatgcatcagtagcatccctggggcctctctaacctcatggacacacatgcatgatagttcttggagctgattgagccatcgccgttcacccggaggttcttgccgccgccgagccgttacacgagccaccgtcataaacctagctaccccagccatgtctaccatctcggtgagcacccttcagcctatagaacatacatgcatgcacccaattaaccaatacatgattgtagaagcacatgcatcaccacccgaaaacatcctcctttcggactcgccgccggcgttactccgatgtccactgaccgagaaaagtagaggaatggaatcgcaataacatgatcttcattttgtattttggttgcacccccaaacgagccatcgtttgtcgccggtgagctcgagatcgagctcagccatggctgttctgcctctgtgcgtgagaaaagaagtcagggaccttgtttcgagaatttaaacaactataaggtttaatgtgcaacttttcaactcactgacatatgaggctaggtctgcgggttgattcttagaaacctcagggatcattttgtatattgatctttcactgacagtggaccccttggaaacaaaaatctgaaattataaaagaaaagtacctaaaacttgtaaaatccatataaaattaaatatagctcattttaagatgatacaaatttctgtgaactcaccaaattgtgaactttagtgttatggaataaaaacttgcactcacagtacaaatttagcctctaaaatttatccaagttaaatcacacataaagcatgcacaaacttataaaatgcatacaaaattcatttgaactcattttggagcaaactcagtttctacagatcaaccaacttatgttctcctataaagcaaaatgaaatagtatacatactatacatcgaatgcctctaaaactattacctttaaaatgactagttttacataagctgaactttagaagtttatataaaattcatcttagatcctttttgagtaaacccaaattcagtagaatcatagggttgtgcacttcaatgttataaaataaaaagacatacttacagtataacgaaaacccctaagtatttaagtaaggaataagcaacatggagcataccttaaattgtaacatttgtagaaaattcatctatagtcaaaatgaagtgaaccaaattttctatagaactagcaagtaatatacttcaacctagtagagtgaattatagcaccctctttagagaccatagctctgaaccttaatttggtagaataggtactaaacacatagtagtggttaaaacaatacatatgaaaaagtatatatatatgcatggtagctccaaataaatccaaataaaacttgttgaaccagtgaaggcatagatccatccccttccaccaaaacttagtatccttaactcatataatactctctagattgatatgttaagtttctaacatagaacatcccctagcttataaaatgtgaagtaaagtaatctgaacactaaaattttataaactaagattatattagttaactaaaatactcattttatacaacactagcaagttagagcaagttctggacctaaatctccaaagccatgtacacatagggaatatatgcctagaacacgttaaaacttgtaaaatacataaataattcatattaactctaaaaattatgaaaccaaatgtgttagtcttagaaaacaaatatcttcaccccagcaaacataaacttaataagaatcaccttacaacagcatttcacaatagtacctaagtaaatcctacactataccgacgaaacttctaaaattcataactcccaaataaaatgagataaaatagaaattctttcacctaaattcattttataccagtacctattctctctgcacaaatcatgcattttagaacattttggatttttcgcatatttcggtgtttaattgcataacgtgtactttgtatagatgattgcttaatcggtgaagaagtgatttaggtgctgacattttcctgattcaaggcaagtcccacctccctctctttgatcactttgaacctatgttttggaggttattgaaaatgtttgcaaatcttgcatgtcgattgtacactaatacattaaaatcttgttaaacttgttagacaaactcctattatttgcattatcaccttaaccccatatatatccatctccctcattcctaaccttaggaatcatatcctagtactacttggaatatgagttacattgtcactagttcactatattgcttagccatgcttagaatagttttacttatcacttgggctcatattaacatgaaaaatgattttattaagttctggacagatatgaataaatgaagtatttgataaataaaatggtggaaaacatggattttagggttgggcctcaagtggtgcacatatggtgattagttgtgtaccgatagggggagagtgcgcccaaaccgacctaaggacttcactcaatgtcagttcatttcgtatacagtacaaccacatgtgctagtatgggatagcccaagcttagtaaattatttatggtttagccttacattctggtaggccggtgtgtatgagttcggataactcagaggaacttcctatttaccccgacgtggtagtttaggtgactaagtctgtccaatacaacggtattgtgccacgtgggtgggttcccgttgtgtccgccaccacggcgttaagttcaaggcgtgggcccgccacttaacggttctaggtcatatttccagtatgactaggatggaggaacacgtatcgtgctggtgtaaggctaaatcatgaattttggaaaagctttgttgcgggtaataaattgggtacttatgtatcgcgtgccatgctcttgcatgattattatttcgcatcatgtgggtaaagtgtacaaactctgcagagttaaaactaatcgattagccgtgctcgcggtcatgagcggcgtgtggatatgtattgagtatagacttgtgttaattcttctaaatgctgaaatttaacttcaaattgtgatgagatttgagaatgatctccttgctgccatggaaggcaatgaggtgcatatttatacatgattaatgcctaccttgatgcccaatatgtcaaatactagcttgctgaaatttatttgaaagtaaacctgatttagaaatgttttatgcaaataaaacttgctttatgctaaaaagaaccatattatgccttccttgattatatgccttgcaagtagggtcttaggcttgtcttggtgcttgccagaacattatttctaataatgtactgactcttgctgtggaattaaccttttgcttgcaggttttagacttagcctttgagtgatgcgggtgatcgactgcttcttctaggacttgaacttaatggggtaaacccctagtcggtgtgcttgtggattgggtagacaagcttccgctgttctatataattttttttggccagtcggccaatgtatctaaagtagatttagtttataatcgctttcatcttatttgtgtttgctatgtataatcatgcttgagatgaaagtgtgaatctagtgcacatcctgggaactagattcacatgagtatgagttaagaatatttgagatgttgtagatctttagccatttttgtcaagtctcctgaatgtgtaacacatctggtcaccgccttcgagtggtttgacgggtacatctcaggctgaagttgactggcaggctaaaggcccggcaatgtctccaatattcctctctcgaggcgtcggatatttcattatacttgtttgatgacttgaattatacatttcatctctcaattataatggaaggtccggagatcctacgacatttacggtttacataatgcctgatacttaatctgctcattatatcctaataatactagaagattaatgcagttttttagtacatgctcgatattttctgctatatatcttgtcttcttgaaaatatttttcaggaacaattgagcactcgagtaggatgtggttgagtacaccccattatcgagaacattctcaaaaaaagctgagttgtcgcacccaacctaccaacgaaaaccgacgacctatctcatgtatagcgacagctacagctggactatttgggaataggttgttaacggataatcctctgcaaacgttgttggcttgatcacccgacatgattgcgaacaaacatccggatatgctataagttgggtatgtgagtcatgctggccacatgagatgcacatgtaataaccaaatctagcgcccctataggtgattgagagatgcctactcctggttatcgaccagactgctgtagcgacatctcgacgcctatcaatttatattcacttgtggactgttggactcaatctatcgtgtcaaagactccatgtctctacggtcttacactgggatcgaccaagtgtgtatggcaaatattgataaggggagtcgtggataacaagagatgctttcgcgaatacggtttgttttcgtatgcctatcaattgcatataggtgatcgagatacgcatacacctggtcctcgaccagtagatcgtagcgatctctcaccacctaaaaattcatcttcaggtaatcgagatgtgcctactcctggtcctcgaccagtcggttacagcaatctctcgacatcgaacacaacaatcaatgtgatcgtgacaatgacaaccaaaaccgataggatcgccgtagtcaccaggacgacaacgtctaggattaacagaatcagagcgacaatggacaaggttaacaacatcacgacatcacacaaagacaaaactcgagatccccagacttttagagggcccgaggatgaggtagtaggtctaggagccgaacctccgactacgataattcctcattgtcttcgttgtcatcaggaggcaattctcgtaggtcacgagaatgttgtccatttgtttctctggattcccttcaagtggtcgaggtacgactgactgatcttcaaccagcaacatagcgatcctcgcaccacgacttctaatggttgaggtatgactacgactagtctttgaccagcaacgtagcggtccttgtaccacgacttctaaaggtcgaggtacgactacgactagtcttcgaccagcaacgtagcggtcctcgcacctctatttcaaaacggtcgagaggtgctcacttctggttatttgccagtaggatgtagcgatctctcgcaccttaaactgaagtggtcgagttacgactataattggtctttgatcagcaatgtagcgaatctcccactacctctgcgatttgttaagtataactatacacttggtcttcacccagtgtggaagtcgtctcatcactatatgtcaacttctataagtgtttatgtgtacaatatttgtctagtgatcctcttttcttatatcgccttcatcttgaagtcggtcctactattcctttacgctgttccgacaagcctccaagaaacccatgggaattttggctgaggacgcccagagcagataaggtattatcagattctaagagccgaacgaccatgtaagacatggtcatgtaagagtgctcaatggatgcgtattaactaagccgtgtagtcggaaattgacttttccaacttcacggctaggggctaggacttgtcagcttcagcatggtttgttataagattcaagctgtcttggtggaaaatagtttttccataaaaacagctgggggctaggaagggtaccaaacttcgtttgctgagggcaactctagggagagtactcttttattgtcatacacagttcaaattattttcaattttccataaatattatatcatgttacccttgagcgttcacttgggggctatttctatttagtattcagttatgagtattgatttaaggaaagtcaggcatcacaacagtcaagttgggaggctttgtcacagactttgctccttctcgattactcgagaacggttgatggagctcaacaaggaatatggaatgaagcgatggtgtacccgtcgagatggaattacttgacttcaattcaaattctcaattacagcaagacgggagacttagtcgcatgctccataccttctcggtcgacatcgggacctagacaaacccaatatagtgcctgcgaaggccgataaggggaatctagcgctatctctgatctcaccgagaacagtcaagtgagcacgacaacagtttttcaaaagtcttcggtcgagaacatggactcgttattttgcattgaagttgggggctactgccatggttatggataccacatacctaatagtagttgactaaactcggcagggcccaccatataccatgtattatacggaaacaaacctcgtgtatagaaggaattccggataaggaaggatgagtagagttctatatggaaatgacaaggactacccggattgtacccttattggtctccttagttctacttggacaagggggcatctatgggtataaatacaagcccccctaggaggagaggggacaagccacaggatcaacatagaccaatacaagccaagacatgccgctggatatcaacatcagagattagcctagacatacccatccggttcctacggaggctggcaagagggatctagcactatctctgatcccaccgactgcgtattcgaagaggaagactaccctatcgttgactacgagctggttatccatgccgccaagtcgacgacagctagatgggttatcctaattattgtacttgtgtgattcagatgaataaaggagcaacatcggcttcggccaataggatgtaggactattacctatcagatgatgggctcgaacctgtataaaaatccttgcctccgtctcttttacttcaatcttgcatataccctggtaccaacgatccccatactatgcaaataccctagtcgcgatctcaaacgtcgacatttatgatgtcaattattactactcaaattttgatgatatagatagaatactctattttgaaaatgagtgaggttaatcattatgatacttaaaaaaattatagttataaaaattatagttatagagacatatcaccatgataatattcagaacaccatattattgtttatattttgaaagatatctatagtttaaagcctagtttgttttcaacacctattgttcataaccacatgagatacttttagtaatttgaagaatatatttgttttttcaagcttatttacaataactaatccgttggagttcacttgtagtataagaaaatataatatgagtagtttattgtgccagttacttcattgttcatgtgtgtcaaaaatatttggaagaattatagcaagatcattggctggaaatgttattgatgactttttttttcatatctgtataccatgtatgctgcccacttctcaaataccaatcaaatagttctgaaaatattaaaaaactttatgaatcttaatctcaaataaattacaattaaatcttagatatacttgaaaaacacagctaaattgtgttgttttcattttttacatatgtagatttaaatatcatgtgaattttttgaaaaattatcacataactgactattatatgtcggccccatgtgttctgatgtattaaggacctcaatattacaattttatagtttgatttgatttaaagaatacaacgggataataaattggatatataatttttttttaaaaaaaataaaaggtggtataaagaacgttgataggatattttatatttttattatcgatcttaatttaactacatatttatagttgtgaagtaatatattttattttcatattgtaaaaaataaattgaccgtcgattttttccgttggccagcagaaggtaagctttgttttcaatcgtactacctacgtgttttcagtcgtacgtacgtacgttcctacggatcagaacagcagtcgtgtttgtatcatatatacaggaggaggaagttattattttttttaataataaatctaagctaatagtgtaaaataataaatcaacagtgagattagaacgggtccaccaatttaaatgaaaatcaacggtaagattaaaaagtaccatatgacggcttaagagcgtttatagaagtgtcatgtgacgactttagagcgtttgtggacttttaatatgtaatagaagatagatgatattatgttattatgttaatgtggaaactaatacacgatgaccatgtgcaactgtactcagctatatatgaaactacccattcatgttcaattttaagcagcaaacagggttcaatgcaattgtgaattttgtgcatatatatggccagtacatgcagcataacttcacaaactcctgtctcttatacctgcatgcttcttatcatacagacgccatcaccacacatatatagatcccattccagcttctcgcatatgtatctccccaatcagcttgcaatttgacttgtttctagctatatatcattattcgaaccgttctaacaagtgcatggtttacctgtacttgagcagtttacacctgttggaatgagtggcaatgggaaactaatgcgtgaccttggtatgggctggttgtcgtccatgttgaattgttgattgacgtgctatgagtctatgacaggccgtgaagggttggagtcatggacggcgcagctaccgctcacgtacgcctccgccacagagccatatgtcagatgtattagtgggtgactggggttagccggttaggtctttcacagtgcacgtatatggcgtttagcctcaactatccacgtaggaggttcttctccatgcgcacaaataccgcgtctcgcgatacacctcgtgtccatatgaagaaaacgaaggcggccttcgggccttatcatagtttacaaaggatgcagagactagctaggtgagagaggaaatgactgaaaagcgaaaagtattagtttgatattattctgtagttgctagggattcatacacggtgggatgagtttcttctaatacttttattcaatgtggaattaactttttttcacatgaccattcaatctgtgtagcttgcattgtgaaaggctttatgtgacacttaccaatcctctgctcaagctgcgtgcaccggttggtctagttcctttgcctccaccacagccgcttattctctgctgctgctaccgcggccccttctctccccttaaacaccaccctcagatccggcgtctccaccaccgccccttcccgctgccgccgttccagttcgatttgctgctaccattgtagttcgattagctgctgctattgcagtatccgctggagaggagagggacaagatgaggagagacggaaagatgtgggaggaggagaaaatgcaggacagtagtatccatcgagtaaaatattttgaagatggtggagagtcacatacgggtatttttttcaggtgttcaatagtaggggccaaatggatagaagggatttttcaggcatctccctaagagaccttctgcaagcacaagattcaattttggatactcgtggcacatttttcaaactgctaaacggtgtatttcgtgcgaaaaatttctatatgaaagttgctctaaaatatcagactaatccatttttcaagtttgtaataattaaaactcaattaatcacacgttattaccacctcattttgtgtgaaacatttaatctttatctttatcttcatctttaggagattcaaacaccacctaagatgaccacctgaaaaaaaaataatttacacaagcaggtcttaactggaggagtccaatatatttttataggcaagggttttttaagcccgtttcaaaaaataaaacgggatgtttgtggatatggtttttctagtagttggtgttgataaggcagatgtgctaaaaatgttgcagacctaaaatgtacaatttagcctatactaaaccgtcctggataccaaactacctaccacttactgaaaggcgcaaactctaagcgctacgataggtccatagttacagttgatttatccatatgcacttgagatgattaaatatttgaacccatatatgcgtttgtataaatataggtgtagcacattctggcgcttttacttaatgctcactcccttcacctgcctcatgtgctcatgatatcctcaactttatcttttgggttgctccagttaatttgtttgctaggtaagaaaaaacaaagacaaattgtaattgcttgatcgaccgatttgatccactcaagtccagattgccaggttgatttggcactagtttcagtctgtgggcagagacaaactcgatatccacgtcactgaagctcgttcgagaaatatgcatgactggcatgaacatttgatcggaatgagcggtgtcagtaaaacaagttagctgaaggtccgcagtcgaagttaaataatgatggttgttagctagagtgctggtataacatgattggagcaacgccgttttagattgtggcagcaccaaattgattttaggttatgattggagctttgctggtcgggaacgagaaggactagcttgtaaacaggttgcacgtgcgagcaaggattcgcttggatgtttaggttttctaccttcaccttcctaataatatcgtaatgtctatacagggaggacgattgggacttaaaattaattaaatgagtttgtaatccatttgatacaatacattctacaatttggtaaaaaagttagtgtagatatattaagcttacatatggagagagagagaaaatttgaccaaaatatattccgatacggttaattgctggaatatataacaccttttcttttattctgaagaagtccattttactcgctactcgctagcaaaatagttcaagggaataaaatggactttgttcttttatttttatttttgttgcaaggagatcgaagtgatagtattgttttgaattctttgtggaccagtacaaatacattagccaacgtgtttgtcagaacagtccatttataaccttgctttttcttctggtttagtatgcttcaagtgagtcatgtcagcggtcatcagtttaccagcttgcttgcaaattgaaataaggcattatttatacatgccatcgatcatttaattcataaccacacactgtcaaaaacatttacacatatatacttctagttatcattcgatcgattttaacaagtgcaagatcgatgtacatgcacttgagcattttacactctttttggaatgagtggcatgaggaatctaatgtgtgatcttggtatgggctggttgtcaactcggttgatggacatgcggtgagatggccaatgcagctctcatgccttctccacaacgccatatgtaaaaattgttggttggtgatggggaacataatgatgtgcttgtgacactatcagtcctcggagaaaactggcttcaactagcgtgattaatgtgattttaaggcaggtttgttcaagcttgcattttttaaccatagctgagtttaaccatctttgatgcgctagtttagggtgtgcaccttgatcgtataatgcatgctgaatcctggcactcaagaggttacagttttcactaggtggttggggagaatggaattattctagttagcaaatacctatcacacgaacgacatctatattttctataagggggacgctctggtgctttctacttgtagtattatactacgagtagattgcattattgtttaagttaatttttggtcaaaatacatttttactattgttggaaggtgcgaatctcttttcatgatctgtaccaaaatactagcttgtatctgccgatcgatcgatataatcaatgagtaaccccacttttgtttctaatttatgatttaggtcaatcacaaacatgctcataaactcaaagctaggttagcttggaatttattggtagagcagggagcgcggatgcatggtcccgaagaaaaatggatgggggctatagggtattacatttggcttgtccagtgttcgactgcttgttcaatggacccaaaataacacactagaaagttagcatacagattatccaatcaacatgggtgcccttagctatatatagatgagtttaattggtatcacactttcgtcagttcgtcagaaatgcaactgctatacactcttgctataggtgcagagagtaccagacaatagtgcaacacactagaatatatatatattgacgcaccatttggcgctcccagtagctagcccatggctgtgcctgataaaaattactcgtgcatgtgcctgagaaagagagtcgatggcagtgcgggatgggaaggggcggatggccgatatataggtgtgcagcacaccaaattagcacggaaatggaacgacggtgctctgctggatacgtggcacgttattactatatgtaaacttcctttcaggttatttagcccatgtttagttcgagaaaagaaaatttttagatgtcacatcggatatgtgaccgaatgtcggaaaggggttttcagacacgaatgaaaaaactaatttcataactggaaaccgcaagacgaatcttttgagtctaattaatccgtcattagcacatgtgggtgactgtagcacttatggctaattgactaattaggctcaaaagattcgtctcgcgatatccccctaactgtgcaattagtttttttaatctatatttattgctccatgcatgtgtccaaagatttgatggaatgtttttaggaaaaaaaaatttgagtaactaaaccaggccttagccacgtggcccaattatgtggcagggatcggaccttgagtccttatctatgctttctcaactcatctctatcgttttttacacgtacgcttttcaaaatactaaatagtacgttttttttgcaaaaacaaaattttatataaaagttactttaaaaaatcatattaatccaaattttctaatttattttagctaatatttaattaatcacgcgctaaacactactttgtttcacgagctagggaagggagcgagggttcccgaacacatacccacagctagctccttgggcatttttttttttgagataatcccttatatgccactgaaaattggtttgatcccttatatgccactgaaaattggctcttcccttatatgccattggtccaaatttgcgcaccctctcatgccactaccgtcaattgaccgtgtgttgactgttaactctcaagtaaaaaagacatatttgctctctctgagttgttaggcatgccctataatcagaagggtaaatatgtctttttttcttgagaattaacggtcaactgacgggagtgacatgagagggtgtgaaaatttagatcaatggcatataagggagtagccaattttcaatgacatataaggaatcagaccaattttcagtggcatataaggattctctcttttttttttcactgggctactggcccccaccgttaggtacccttgttatgtcacattttctaccgtacttgtgactatatataaacatgcaaacgcataggccttctgcatatcgtcgatccacatactgctcaattgtgtgaacaatatgtaaaatcatggtgaagaataatagtttgtgatgaacagttgattatgataatgattataagggatttagttcccacgcaaaaaaaacttttcactctgttatattaaatatttggacacatgtatggagtattaaatatagaaacaaactaattacacagattgcgtgtaaattgctagacgaatcttttaagcctaatcgtgtcatgagttgacaatgtggtgcgacagtaaacatttgttaatgacgaattaattaggcttaataaattcatctcgcagtttatagactaatctataatttattttgttattagactatgtttaatacttcaaatatgtatccgtatatccgatatgatacgtcaaaactttttatctctgaaactgaacagggcctaagatattgttgtgaagtgatgtttaattaaaacattttaattaaatgggtgaaagagccatgaatagatggtctgaatggagtggagttgcgatcccggtcaaatcgatcgggagccgtatgattggactagtgttccatgattggtcagacctgttggtacctcctacgaagccatcgcggaataagcgaaacggtatatttataaataaaaaataatttataaataaaacttttatatatttgttcttagcgatctagaactgaaggctgaaaaacaaattttgatgaaaaacttcaaaggcagctccaaatttaaggttaaaaatttaaattttagctgacaattataagtataaacgaaaagataaggcccggtcggaccagatgtggtgtggtttaaccgggtgttgttaggttcttgatgatcgtctatagggatggttggaccagtgttggctcggtctggctagtggcaatgggtcccattagaaagtccatcatgcagttagactggcataatcctcgatggagtctgtaattttgagtctcacatttattccctgatgatgtttatggcttgtaattgtttcgtatgctttttttttttgcacaatgtgaaatgaatagattatgaatttgcgggtgaaacttgggctacttaatcaatactccatctattttatattataagttgtttgactttttttttctagttgaactttttaaataacttatagaaaaatatagcagtattttcaacacaaaataaacatattattaaaatatattcaatgttggatttaacaaaactaatttaatattttatatgttgctaatttttttataaatttcgtcaaacataacaaagtttgactgaaaaaaaagtcaaatgatttataatataaaacaggggagtagaacagagttgctcctttaattgatacaccgctgagagttcgcacgtacggcaactccatccaaaaatagaacctactgtgtatacgtgctagtccagaatcaacctatcacacacagtacgaagataatataacagccaacatcaaaaaaaaaaaactaacatttattaataaaaataattgtgataacccttatggctcacttacatttatttatcttgagggcaacacaagaataaaatagcacaacggaaaagaaaataaatgcacggaagctccattcaacatgtcacagataatcaactgtggcacatggcctagtcctcgatttcagtagcaaactccttagataatagcggaaaccttccttctggagttggggcaattgtgtggtgattacatgaaatactcagcaagtacatggaaatatgcatatgcacatctgaaaaagaaaggaaaaagtacgaattaccctcccctcggaactatcgtggtcaaccgaattacccccctcatcccagaaaccagacatcgttcaccctcaactttcaataatgcacaaattaccccccctcgacccaatctagagcggttttgtcctacatggcgtacgcgtggcaatccaatcaggattttatttattaaaaaatgtaggacccacctatcatacatttcttcccctcttcctctctctcttgctcttcctctctctctcggcatgcgcatggcggtgcggggatggtggcgaacggtgcagtcggtgtgcatgacagtgcagccaacggtgggcgggggcggtcggcgcggtcaggcgggcggtagcggagatgcgggcaaggtggagaggcaggcggcggaggagagggacgcggaggtggtggcgcacgcgggacgcagaggtggtggcggcgaactccgggagggagcagcggcgacgtggaacgcaggcagcggtgaactcctccgggagggagcagtggtggcacgggacgcagaggcggttgcatctcgcctctcctccggccgactctccgccgcgacccacctctccgcctcgccgccatccgcgccgaccgccccgcccaccatcggccgcaccgccttgcgcgccgaccacgccgtccgccgccgtcatgctgagagagagagaaagagcgagagagagaagagaggggaagaggggaagaggagtatgacaggtgggtcccacattttttgaataaataaaatgttgactggattgccacgtgtacaccacgtaggacaaaaaccgctctgcaggggtagtttgtctggtattaaaagttgagggtgaacgatgtcggttttctggtttagggggtaatcggtcgaccgcgatagttcggggggtaattcgtactttttctaaaaagaaaagccatgcctactttccataacacaagcagttacgattgtagaacaacatttttttttgcggggttaaaacaacattttataataacggttgtttccatcaaagttattaaaaatgttaccggcctacgaaaatcaattttaacatacggtcctttacagaacaacattcaaattattttacatgtggacattcttttagcccgcctgcaataaaacagagggtatgtccgaaaaattgtttttttaagtggtgtggttcaaaagaaaacaaaatatgtatatatatttccataatttcttctccgggcgtgttgtgtgttctgagtacatcacggtagataagcagagtaaaagagatttcagagaagaattaggtctggtttagttccccaaaattttttttcgaaaacatgacatcgaatcttttaagtctaatcttctattatatactaaaagtccattaaacttcctacaaacgctcttaagccgccacgtggcactcctacaaacactcttaagccaccacgtggcactatctaatctcaccgtcgatttttacttaaattggtagacccgttatttttcaccattatattagatctattattaaaaaataataacttcctcatatattatataacatagaaacggtactgttcagccatagagtttatatacgatacagaacgttacgtacgtattgaaaataaaacaataaaactttcccaatgttacggtatttatttaaaatatgattttctacagtataaagataaaatatatttacttcacaaatataaatatatttagtcaaattaagatctattataaatatccaatcaatgttctttaaaacatcttataaatctatctattatctatcaactatatatatactaaaagtacgttaaacatacgacgaatgctcctacactgctacgtgtctctctaataaattagagaaattctagaaatttatttatatactaaaagtgcattaaacatcctgcaaaaactattacgccgtcacgccgtgctataataaattagagaaatcttagaaattcagagaaaaaaaaaagcatatgatcctttaatttttacttaaattggaggacccgttattttaaatattagtttagatatatttaaaatcccatgctgctaatctctatctggaaaaaaaaacataatgtgcgtacgtcgtacgatcgtctccatcctaaaaaaataaaacttaaatacctacaccatatacgataaataaaacagataaaaccaaataaataaaagaaaacatgcaaacgtacaaagaatcggaaagaaatactaatcgtgaaaattcacactgatgtgttgtcaacatcctttaaactattattttattaaaaataacactacacagatatgcacattaaacttaatctctaatagataaaatgtcaaagcaactgtctgacaaaacctaacattgtgttttaagtacatctgttttgggttatttaattttggagatcagattctcaaaatatttggatttgttcaaa

SEQ ID NO: 17953 - DNA, 52874 bp, Oryza sativa
aaacacatataaaactataaattctatatactgagtataattgatgtacgaatgttatacacctctgaacccaattttgtcaattcattactttaaatcgactcaaaacttaaaaataatattgttttcgccacctcttcctttctgtatatatctgtccttcaatgttgggtgtattacttgctatgccatcataaatattgtagagacatgtaaatggttgagttaaggtggtgtctaaaaggccaccataaccaatgtaactaaaatgacatacttactaatgcaatcatttgtgtgtgccaatggtgaattgagtgttaaaattgtaatttaagatggtatttaggggcacggttacatcgatgcgagacccgtgtttcaaggcattatgtaagaaagcctaggttggctgctacggtcgacttcatctgttagaaaatcattcatgaatatttttaacagtgttatcgtattatctagtagatatgatatttttagacaatttatacatagaagtgaaaataagttatgcataccgggttatgcagtgtagatgatattttttgtgtataaataatgtatcatttattttagtggtacaaatacagtttcttttattaaaagtgtacctaactttcaaaaacaatgataataagtagtggtgataaaagacgagtttatatatgaccaggacaaagggatttttacttaaatctaatagacattctatcacatttagtaatctataccgtctattttacggcaaatatatttgtttttttatttagggtaatctacattcccttacagggtatatgtattaatgtatatactaagatatgatttattttagcattctttttcttgaacaacaaataagatgcccgtgcatatgtgcgggtttcctttccgatttatattatgaaaatatcctccattttatattttgtccttacattgtttgaaacatagcctatgatacatgcatgcgcgcgcgaatgcgcgggctaccttcctagttagttcataattagtgatacagtaacccatatgtgctaataacggattaattaggctcaaaagattcatctcgcggtttctaggctaagctagttataaaattagtttatttactcatatccgaaaatctcttccaatatccggtcaaacatcagatgtgacacctaattaataattttcttttggctagctaaacgggcccttgcatacttggacatcgtatctgttcttttgaatatcacacagccttcctcacagaccagacgacagagcgtatggctagagggcacgaaccgagagttactaccattaccatgaagcatctacctttcctcgtacacctgttcttcctcctctgccttggcctgagcctcaccacgaggtgcgccggcgatgtccagttcatctactctggcttcaccggcgccaacctcaccctcgacggcgtggcagcggtgacggcaggaggcatgctcgagctgaccaacggcacgctgcagcgcaaaggccacgccttctacccggcgccggtgcccctccgtggagccgccggccccaacgcgacgacgacgacggcggaggagtccttctctccacttccttcgtgttcggcgtcatgtccgaccatgtcggcctgagcgcccatggcatggcgttcgtcgtggccgccagccgggacttctccagcgcgctgcccagcgggtacctgggcctcctcaacgtcaccagcgacggcgacacgggcaatcgcctgctcgccgtcgagctcgacaccatgcagaacgacgagttccgcgacattaacgacagccatgttggaatcgacatcaacagcctccagtctctgcgctcctactctgccggatactacaacgacgacgacaacaacaatggcttccgcaacttgaccttgatcagtggaaaggccatgcaggtgtgggtggactacgacagagagacaacgcggatcgacgtgaccatggcccccctcgccgtcgccaaacccaagaggccattggtctcagcgaggtacaacctctcaaagctgctcaaggatgtcgcgtacatcggtttctctgccgcgacaggaggcacgctgagatcacggcactatgtgctcggctggagcttcgggttgggccgtcccgctcccgccattgacatcaccaagcttccgaagctgccgcgaactgtcagcaaggaccggtctaggattttgcagatcaccctaccgttatcaactgctgctttcctactccctgtgggtgcagccgttttcatgctcgtccggaggcatcggaggtactccgagttgctggaagattgggagattgagtttggcccgcacagggtcttgtacaaggatttgtttcatgccacggaaggattcaaaaacagctgcatactaggcataggggggttcggaagggtatacagaggggtacttcccacgtctaaatcggaaattgctgtgaagagggtgtcacacggatcaaggcagggtatgaagcaatttatcaccgagatagtcagccttggttgcctccaacaccgcaacctagcttgtgcaactacttggctattgtcgacgcagtggtgaacttctcctggtgtacgattacatgtccaatggaagcctcgacaggtatttgcatgatgaagaggggcaatgcagtttggattgggttaaaaggatccacatcatcaaaggtgttgcatcaggcttactttaccttcatgaggagtgggaaaaagtggtcatccaccgagatattaaggcgagcaatgtccttcttgacagtgaaatgaatggacgttttggagactttggcctcgcaagactatacgaccacggatctgatccaaaaactacccacgtggtcggtacaataggttatatagctccagagctcggccggtctggtaaggcaacacctcttactgatatatttgcctttggtatattcattctagaagtcatttgtggccaaagacccatcaagcaaagcagagaaggtcatcaaatcctacttgttgactgggttattcaccattggaaaaatggaacgctcatcgaaacggtggacaaaagactcgagggaaaccatgacactgatgaagcaatcctagtgctgaagctaggactgttgtgtgcacatccatttagcaatgcaaggccaagcatgcgtcaaatcgtacaatacctcgacggtgacatggcattacctgagcagatgccaacagaccaaatctccaatcagacggagggcttagaccagtatattcaaacagggcctcaatcaacaattccagtcaatgcaagctatggcacaatgtctaacctttcaggtggaagataatttaacaagtgggcattaacacctttaagtgttgcaagacgatgcatatgttattgcaagcagatgatcttgtgataggggaggtgatttgtggttagctgcttcaactaattaaatcgttaagctttaaaatggtgaattgtattcaataaaaatcaggtgatagaaaaagacagtcatgtgtactcctatttctgtgctagctagtgctaccatattttcattagttcaagattttacatgttgtggacttggcaatcccatccctcaagaatggcatttaatttgcatcgcactaatgatgtacgtatgtacatatatcatcctagtttgcaagaaaggtacgttttggtcttgaatgaatcatggtcatcattttgtaaatgttgaaagagatgggtcgagactttttctgcaagtttcttgtactaattagcatcacttttgacggacatgtatcatatcaagcgccccggtcatcacggcatgagatttacgagtacatacctgctctgtgacgcatgatcgctacagtagccgtactatacctcggtgcgtgggatcagcttgttgatctgttgatctggtaacccgttcctacatgcatttgctaagtctccgagcatatagaaataggctatttccaaaggtgtatgtgcaaaacaatttaaagaacctcctgtgtaaatagctaggatttctacgggcggagtttttcaccggttgctctttaagtaatggtaaaaattacttttacacatgccatctactacatcattacccgtctgattcaagtcatatatgataggcgggtgacaatatttcagcaaatagcgaataatgtttcaattcactgtaatatttgatccataatagcaaaagattatgagtatacactaggtgaaacatttttttggaaaaaaaatgaaatggattcgcttaatagagggtttctataatatttaggtgatttgttgcgaaagaatatttcaattcactgcaacatttcatctattcataatgaagcatcataagtacactaggtgaaacattgttggtggaacaaaaaattgaaacggattctcttaatagggtttttccgtaatatgtggggatttgttgcaacagggtgagagtgactagtggggacgcatgggagacaggcggagatgccggggggggggggggggttgggggtgcccgatttttctaacgagcgttgggcgcctgatccaggcgttttcccaatggcggccaagcaacgcactcgtagctgtatggatagctagatttttcacattttggtccttttaaaaaacttatttcgtaaatagacctctagaaaaacttattctagaaatggtcctttttggggcgccaaagtggctagcgccgtcctcctgccaccgtggcggggcaaaatatgtgacttgtaaaattttctaaagctctaccgaaatggacaaaatatgtcatctatctattacatactaaaagtccattaaacttcctacaaacgctcttaagccgccacgtggcactcctacaaacgctcttaagccaccacgtggcactatctaatcttaccgtcgattttcacttaaattggtagacccgttattttataccattaaattagatctattattaaaaaataataacttcctcatatattatataacatagaaacggtactgttcagccatagagtttatatacgatacagaacattaggtacgtattgaaaataaaataataaaactttcccaatgttacggtatttatttaaaatatgattttctacagtataaagataaaatatatttacttcacaaatataaatatatttagtcaaattaagatctattataaatatccaatcaatgttctttaaaacatcttataaatctatctactatctatcaactatatatatactaaagtatgttaaacatacgacgaatgcttttacgccgctacgtgtctctctaataaattagagaaatcctagaaatttatttatatactaaaaatgcattaaacatcctgcaaaaactattacgccgtcacgccgtgctataataaattagagaaatcctagaaattcagagaaaaaagaaaagcatatgatcctttaatttttacttaaattggaggacccgttattttaaatattagtttagatctattaaaaatcccatgctgctaatctctatctggaaaaaaaaaacataatgtgcgtacgtcgtacgatcgtctccatcctaaaaaaataaaacttaaatacctacaccatatacgataaataaaacagataaagccaaataaataaaagaaaacatgcacacgtacctagaatcggaaagaaatactaatcgtgaaaaatcacactgatgtgttgtcaacatcctttaaactattattttattaaaaataacactacacagatatgcacattaaacttaatctctgatagataaaatgtcaaatcaaacgttttgttgttttaagtacatctgttttgggttatttaattttggagatcagattctcaaaatatttggatttgttcaaaacttttttattcttatttgatgagtgagaagcacaaataatagatagatgagaaaaattaaattaaattttagacagtggttttgcgataataaaactacagaatttagctttggtttttaagtggatcattttatgtttattttgggtgacattgagattttaagtatctgaaaatttttttattgctatttgaggagagagaagcatacatcatagatatatgtaaataaacaaataaacaaataagaattaggcagttattttgctacaatacaatccttaattcatcatgagaattatgattatccatgtatgttttttctttgccaagtagtattggcaaacaatcatgtaaaacacgtataaaactataaattctatatactgagtataattgatggacgaatgttatacacctctgaacccaattttgtcaattctttacctcaaatcgactcaaaacataaaaataatactgttttcgccacctcttcctttctgtatatatctgtccttcaatgttgggtgtattacttgctatgccatcataaatattgtagagacatgtaaatggttgagttaaggtggtgtcctaaaaggccaccataaccaatgtaactaaaatgacatacttaccaatacaatcatttgtgagtgtgccaatagtgaattgagtgttaaaattgtactttaagatggtctttaggggcacggttacatcgatgcgagacccgtgtttcaaggcattatgtaagaaagccttggttggctgctacggtcgacttcatctgttagaaaatcattcatgaatatttttaacggtgttatcgtattatctggtagatatgatatttttagacaatttatacatagatgtgaaaataagttatgcacactgggttatgcagtgtacatgatatttttagtgtataaataatgtatgatttattttagtggtacaaatacagtttcttttattaaaagtgcacctaactttcaaaaacaatgataataaatagtggtgacaaaagacgagtttatatatgaccaggacaaagggatttttacttaaatctaatagatattctatcacatttagtaatctataccatctattttacggcaaatatatttgtttttttatttagggtaatctacattcccttacaagatatatgtattaatgtatatactaagatatgatttattttagcattctttttcttgaacaacaaataagatgcccatgtatatgtgggggtttcctttccgatttatattctgaaaatatccttcattttatattttgtccttacattgtttgaaacatagcctatgatacatgcatgcgtgcgcgaatgcgcgggctaccttcctggtttattaaaataggcgtaactttctcatacggactcggaatcaggcaaataatatattcacggatatctacagaaaaagttacatccgattctcggcatcgccccaccacgtcggcagggggacggcgccagagaggctggcgccgtcccattggacaacggcgccaacctctttgacgcccaaaaagaaccatttctaggataagttttttcaggggtctatttacgaaataagtttaaaagaaccaaaatgcgaaaaatccaggtgcggatagtgttacccgagttccattttcttgcccgatgaccaatgccaacggcagtaataattaacattgacattaattggcctggtctggtgtacaccttttctgcagcatcaaaatatcttctgcaattattgtacggtttctactattacatgatggggatgttatgcttgacaaaggaaaacaagaggaacctccttacactagtaaaacaaaaaacattttttcaaatggttaaaaaaaatttcgtgtgtgattaagtcgcccgtctagtgtgaaaatcactatttttctacacggttagcaaacacgcacgcaaaattacatatcccactatagtactccctccgtcacataatataacgaaattttgaatggatgcgacacatcatatctagattcgtagtactattatgtgtcacatccacccaaaatatcttatattatgggacggagggagtatcatactcaaactacatagcgctcgcgatctgacgacccacctatatatactttcttttttcaaactgcaaaagctagctttaaacatccgttatactccctcggtcccaaaataagcgcagccatgagtttccatgtccaactttaatcgtccatcttatttaatttttttttagaaaaagctaaaaaacttaagtcacatataaagtattattcatgttttaaatctaatagcaataaaaataataattataaataaaattcaaataacacggacgatcaaagttggatacagaaactcatggctaatctcattttgggagggaggaagtatgtcttaatacaaatgtgacccgccaagcgaaaatctgtcaaacaaagagcacaatgatggaaatatattatattaaaccctgagggtttctttcttcaataattcaaggcgtggttaggctgaacttcacgagtctacgagctttcacatacctatcaagctatctcctattacaaaaaccatttgatttaatacaggaccccagaaaatatcttgttggcacatgttacctgaaatattaactcatgttttgtattttgaaacatataatgctttggagtcgtttaattatttgaaatatatgattatttttcagatagattatttgaaaaagttttctgcttcccatgagtgatttattggaaacttctaattccacaaaaatatttaaatctctaaaacgtctgaagtcatgtcttgagtatcaaatttgttggagcggtgcatccatatacaaaatttatattgatttactgatcatgtcaattgtttctaataaacaacgatacagtaagcttattctgaatttcacaagctagatgcacatttgcaatgtgaacataattataagtaaattatgctacactaaaacacaataatgtatttctcggaagttgttcttatagtagaactataaatgatatttttagaataaggatgtgttccttccggttcaataattctgtgacattttgaactcttataactttaactatcaataactctaaaattattttgcttaaaacgtactagaacaacatattagatttgtcttactaaatattatattaaaagtaaaaaaatatttatttattatatatattataatagaaaacatagtgaatgatacatttaggaaaccatgttattgttcaaaacatcaagatctatggaacaggacgcagtacaatcatgttttttgcactgcatatattctggagtggtccagtctattcatataatcatggaaactaagtgtaaactcaccccttatttattttgcatttgacagacatatatgcacttgcagtaataactagctaattaacaccatttcttatactacctccatcccaaaatgtttgacgccgttgacttttttaaatatgtttgaccgttcgtcttattcaaaaaaaatttaagtaattgttaattctttttctatcatttgatttattgttaaatatacttttatgtatacatatagttttacacatatcacaaaagtttttgaataaaacgaacggtcaaacatgttacaaaaggtcaacggtgtcaaatatttagggaaggagggagtagttaccttccacctaagaggaaggatacggtgccaatggttgctgcagacgatggatatgacattggatatgagtcgaacccttcattctgcattagagccattgtgctaaagctcatatttgttgatgttaagtctgggagtggagtgtcaccatcaaggtattgcatgacttgtctcatgcccggtctcaagttggcagatgggtgtgaacacagcagtcctagctttagcacccggcatgcctcatctgtattacagtcaccttgcaacctcaggtccactgtctcattaagagagccttttttgaaatggtcaagaacccagtcaactaacatttcttggttgtatcgtccactatcgtcgttgaccggtctttgcccacaagttatttcaagaagaaacgcaccaaatgtgaaaacatctgttagtttggatgccttaccggtccatattagttctggggccaagtatcccattgtacccaccacatgtgtggtttggggatcggtgccatggtcatacaaccttgagagtccaaaatcacctaagcacccattcatttgatggtcaagaagcacattgcttgcttttatgtcacggtggatgacaactttctcccacttctcatggatatagagcaagccagacgcaacacccctaatgatatgaaacctttggctccaatcccgtaaaggcttatcctcctaacaatacagatatttatcaagactaccatttggcatatattcatacactagaaggagttcaccttttcttctacaatagccatgtaattgcacgaggttgcggttccgtaagcggccaatggtgacaaattcagagatgaactccttcataccctgccttgactcgtgagaaaccttcttcacggctacctccaatctagacttccgaaaaactcctttatacacctggccgtaaagtcctgtacccaggagatgtttgctcttaaatccattagtagcatgatatagatccttatatgagaatcgatgggggccaaattcaagctcccaatcttcaagcaactgagcatacctcagatgccttaacacgagtagggtggcaatggtaccaagactgagcatgactgttgctgtagctattggtaggacgattactaagaccttggatggaggcttgggtccgaaacacggcagcttaggaagattggcaatgttaatcggcggagcagggccattcatggcaaagctctagccgagcaggtagtgccgataattgatctcgctagtcacagatgagaaaccgatgtatgcccactccgtgagtacagttgagaggtcatacttagcggaaacaagcggcttccttggtttagccactttgattggtgccaaagccacatcaatctgtcctgtgttgccatcatagtccacccacacctgcatcgcttctcggctaaagagggttaggttcttgaagacgccattgttgccgtcatcgtagtagctagttggggaggattgcaaagagtgaagattgttgacgttgatgccaacgtggttggcgttgacgtcttgaaaatcggtgttctggacggtgtcgagctcaaccgcgaagaggtggttggtcgtgttgccgttgttctggacgttgaggagggccaggtacccaaccggcagtgcggtggtgaagttcttggtcggggacacgatgaaggccataccgtgggcacagaaatcggtgtagtcggagatgatggcgaacacgaaggcggccgagaaggaccgagctgtgccatcaggcgatgtgcggaactgcagaggcgcggggaagaacgcatggccttttaggttggtcttgcggctggtcagcacaaggatcccatctggcatgacggtggcgttgccgtcgagcgtgaggttggtgccggtgaagccatgataggcgaactggaagtctccgctgccggaacacaaggcaagtgctaggtgaagaaggctgatgaggcgcaagaggaagaacgcaggcttcatggtcgtatgtggtgggggattgtgcgagagggcatatcgttggccacactctctaataaagcacctttcactagtcaatccttaattaagaggtgggatatgatagtcttggcagccaaacgtacgtgtcgagatgtctatgtggatatatagctgtagtgatagtgtattacagtatcacaagaaggagaatgccaattctaatctcttgtcatggcatatagtatttttctgttacataaaaaaatggttttcatttaacgcccttaaaatatttgttggctgtgaagtgtgcatagcttaattgattaggcttgctctggtggaacctacccactcaggtttaagttctagatttgatttggttctcgcatttaggtctaatattcttttagtgatgtacctttcaatagtgttcatgtgggtgtcgtgtgcgtttataaatatagtgagtgtttccatttgtactatatttttttaaaaaaataatcgttggctccctgcaccagtttagtccatgaattactgagatgagtcactttacccctaataatatttcttttttttccctctctttgaactttaaaatacaattaggaagatagtccgcgcattcgcacggacatgtatcataggctgtgtttaaaaactataaatacataatataaattggagaatatttccggcatataaaggaaacccgcacatatgtacgggcatcttatttattgttcaaggaaaagaatgttaaagaaatcatacatcactatatatacattgtaaggaaatgtagattattctaggataaaaatagacacatatttgccgtaaaattgacagtagattctaatataccactaaatctaataagaatgtccctcagatttaaataaaaatcccttcgttctaggcatatataaattcgcattttgtcaccactacttattatcattgttctgaaaattaggtgtacttttaataaatgaaactgtattagtaccacaaaataaatgatacattattaatacactaaaagaattcatctacatcgcataacccggtgctcgtcacttaatttcatatctgtatataaatagtctaaaaataccatatgtaccggataatacaataacactgttaaaaataaacatgaatggctctctaacggatgaagtcaactttagctgccaaccaaggctttcttatgtaatgccttgaaacataggtcccgcattgatgtagctatgcccctaaagaccatcttagagtgtaattttaacacttagttcactttaggttaatttcgaactcagtgacaatggagagacctaaagtgaacttattcgctaggagctagcctccgtatcaaccgccacgcactctgggctttgcctgggccagaaagaaatgtgtaaccagcattgctagctatttgagctaacggtacttgtaagcagtaattggcttgcaactcctgtacgtgctcataactggcttacatgaagagaatttggagcagaattactatccctgcgatgatgtatgtgttgatccatgttcagcaaatactctcgaatgcacaatgacacgaatgttatatatcttgatctgattggcatagctctaactcctaacttcaacttacctttaactaaagttatgccaaacggtcaaaatcctatgtttttttggagtggggtttgtagagttactcctagaaaatgaactaagagggtggagccgggtttttactgttccatagccccactccacccaaaaaacccactgctctttaattattagcaaatttttctaccggacatcacaattttgtggttttaaccgtaggacaccacacaaaatcatttttgggaaacacactctgaaaatatggttatttgctaggggacactctatccattaaattaatgttttcgtgttgactagacgagagtgggctcacatttttacgtgtcttgaccaaattacccattctttctttctcttccttatctgaaatctctccctctctcttttttatctcttctcccggcggatggcgtggttggcagcgtcgacatcgacgtcagcacccggagcgcgtgtggcctattcagcggcggcggtggcggcagcctgctcggcggtggtggcctgttcagcggcggcagcacgcacggcggtggcctgctcactggcggtagtctgctcgacagcagcagcagcctgctcggtggcagtgcccggagcgcgcgcggcctgctcggcggcggtggcggagcccgaagcacatgcggcctgttccgtggacggtggcgcgcgcggcctgctcggcagcggcggtggccacggaccacgccagtgcgtggatctctgccaccagtccaccacggctcgctcggtgtggacaacggcgacaatgacgacttcaagtgcccactgtacagggaagtgacggagggaggtgtcggacgtatgtgcctgccacagtacggttcggcaacggcctcgccattgcgagagcggcagcggcaccggcggatgaccacgacacatcatgggcacgtggtgctcatcgtggtgatgttgctgctgttggtttggtggtgttgctctccatggttatgctgctactagctgctggttggtgatggggaagaagaagacgcactccaggcagtagatgtccaaccactcctcattcgccgatagacagagaagagagatgggagaactaacatgtgggtccagggatatttttgatattttatacaatttttctctcctctctatctgaaaattattattttaatgggtgcagtgtccgctggcgacttaccacgtatatggagtgtctttccccaaaagtcatttcgtgtggtgttctacaactaaaacagtaaagtcacgatgtagtgtagcaaaattttctttaattatttgacgtatttacgcgaaaatgccactgacctaccccaacctcctcacctccctacccgacgaccgggcgagcagaaggccacggcattccggcggcggctcggcgatgcgcgtgcgggcagcagggtgacgacggtgctccggcagcggtgcgcggacgggcagcagggcgacggcggcacttcggcagcggctctgagcgcacaggcagtaggccagcgacggcgcagcttggcgacgcgtgggcgggcagcagccgcagcgctccggcggcgtcgcgcggccgggtagcagggcgacggcggtgctccaacggcggttcggtgcgcgcggccagcaggctgacggcggcgcggctctgagctaatcccctagaccctttttccttttttttttcaatttcaaatctgcacaaaaagaacaatagggtgattttgcatgtatgttgtgggggatttcttttttatatgaactatatagatgtgaaaaattatcatgtgtttatacaaattgaagtgagaacaaaatggtagactatacaaatttcaaatctaaaccaagaaaacactaggatgctttcactaattatgtcaattattttggtgattaagttttaaccttataattatgttgctgaaattctaaataaaaataaacatttatcagtcatacatcacggaaatagaaaaaaaccacaagggtactattgtcaacctccccctatgctctgtttctgaagttctgaagcagagtaagcttgtcaaacacttttcacatgacatccaactcccacaggagcgagtgagagttaggagctaggagttggaatttggagccctcccaaacaggccttcctgcataactagctttgtcctgtttttgtacgttgctagcacattgtgatttaaactatacaagacaaaggtgagaaaaataagtgaaaattcctttataataattaataggacgttcccgtcattaacttaaccctacaaacattgcttcattgcttgaaacatctaactaaataattttaaattctatcaaaattttatataataaatcatacgaacatcttatataaacagtaccgtggacgtgttctcagccatacttaaaatgtgttcttgctggctttcccaaactcaccctccttgttttttgcaaaaatattctatacacaagttgttttagaaaatcatattaatcaattttttttaaaaaaataatgcttaattaatcatatcactactagaaaaacgattttttatggcgttggcctaatattttctctggcgataaaatgtgaaaaccgccaacaaggttgtaacgaggggtgggaggcaacgaccgccagcaaaaaaagattttcgttggcggccgagtaatacaggccgccagcgaagatttttttattttcgctggcggtaccttctaagtgccgccagcgaaaataggttcatcttcgctagcggtatgatgatatggaccgccattgaagatgaacctattttctctggtggctctctttagccaccgccacctctatcattttatatggcggtgcattaagtagtccaccagtgaaaattggttctcctatataaggccgtgcccaagctaccatgccatttgagcacgattttctctctcttatgaactcaaacatagggggagaagtttttgaactcgaatggtttgatagatattttgtaccaaaaggttagttatactttatagttctccatttctcaattttttttttcatttttatccgttctatgttgagattttgcaaggtcaagtttccaaggcatgttcgttttgatttgttttgtggtgttgaaaacggtcaaaattgttatgatatattgtacatgatcaatgtatatagatttcacaatgttttgatatgtttatttatagaagatctatatggcacggttgttttgtgcactttaaatctatatatctggttatgaaagagaattgagagaaagaaagagggtagtttggtaattttatctagttttttctagttgtatgtctagttgtcatgtattgggaatatatgagtggtagtttttttttaaaaaatgaagtcataatatagttttaatttttccgtgtttatactaattgtaatatttttcacaatgtttaatttatttgtttacatattagcataattattttaatgtgacatattattaaaactatttaaactaagttagtttttttttctcaatgcatagacgatggcagacagatcatgaatgttcatgaatgtatagagagatatcgtgcgtcatatattgtaggagtcaatatatttatgaaagctgcgaagaaaaatgctgtagctaagaagacaaaggaaattaaatgtccatgcaaacactgcaaaaatcagaaattttggaatgattcatctgtaatcgagcaacacttggtgacacatggatttgttgaaggctacacaaactggtcacaccatggagaaatccctgcaagcttccaagttcccaaccaagagatagtacaggatgaagtgttcaatgattggaatttcatggtagtagaagaagaatcggttgatgatgatggttatgacacagctaatgatgttgatgatggtcatgtcacagtagatgatgctaatggtagtgatggaactgcttttgatttggaggagatgttgcgccatgctgaacctgagacaattttcactggcggctcccttgagaaagccgctagcgaaaatagatcttctctagtggttggactccgccagagaaaactctacatcttcactggcctttactctctggcggcgcctagtaccgccagcgaaaacctgttttagctgccaaaaaaacgtatttcgtagtagtgtatggtaacgagttgtttcgttttgcgtcgaagggattagttctcaacgaacgcaccctgtatgggcagtgatatataggcaagtacgcatgcagccttatatgggtagtcaaatgtagtcacgaattaaactctcccttaggtacaacatatgcatatgccactttcttcatgagcaaacatcgctatggatgctagcaatgttgcgccgattgatcgaaatataggtggcactaggaagcatgccaaatggatttgcagccaaactattactggtgtaagcatgcaatagcctccatctacacactcccagaacaccactcaactcacactacttgaaaaacgatttttcatgacgttatcctattttttcgctgtcggttatataagaaatccgcttgtaaaattctgatgagggatagtgtgtttagaaccgccattttcgctggcggtgagtttagaaccaccagtgaaaatccgttttcgctggtggtaggttaagaagtccgcttgcaaaaatatcccaatttttgctgacggacctcagcgaaaatcctagtggaggaccgcgccgctctggccctttaaaaaatcgcggcattaaaagtcgctccacctacccatccttatctcctccttccactccctctctccctccaactatctctccctccatccacaggcatgagcggtgagctcgggcacggccagcggtgtgcttcggcgcgggtagaggagagggctggcgcgggcggcagcgagctcgattgtgggcaacagggagggcggcggcggagcttgggcgaaagggagggcggaggagagggctggcgcggtcggcggtgagctcggttgcgggcggcggttgtgaaaagaccttaatgtcgcttagagggggtgtgaataggcgttcctaaaaattatcacaacttcatagcatattagaattatgagaactttcggttcaaacaggaacttccgatatgagattggaagttccggtctcaaccgaaaagttcggcggataatggaataaaacactagctatgaacttgtagctcaaataaacaaaatgtatatgaatcaaaaagtgacaaataaggtatctaaacaagatataaggtcaccaactaaatcaattaagcatgcaagtagatcgggtaaaaacaagctcaagcactatgagagaatacacaaatggacaaaccaagagaggagacgcatgatttgtttcccaaagttcggatccacggatcctatgtctccgttgagtagacacaagggccgggcctatttcaaccctttcctcacgaggttgcacaaatgcactcctcggtttcactcttgatttcttcccttgcggaggcgaaatcgaagttttcacaaactttccgtggcacaccacaaccttgggtgctcaccggcgacgcctagccgtctaggagaccttagtccccaagagtaacaaacataatcgaagatttgcttgctatgaactcgagtgctcaaagtatggagtgaagctcattagctctcaacttctcaatcactcaatccaactctttcctcttctcaaatccctctcacaaagaggcaccacaaaggatggagtgaaactcactagctctcaactcctcactctctcaatccaactttctctctccccttctcaaatcctcctcacaaagaggcaccacaaaggtagggaaatggggatggctatttggctttggatgtgtctaatactccccaagagcagcagccactcaaaggtggggtggaggagtttatatacccgagcctcttaaaaactagccgttggaggccaagactgtaatttttggatttttcgaaaagcattttcggacaattccgaaaatctacagaagcaaatcttggattctgtagatttatccgaaaacttttcagagttttcgataatttttcggactttccgaaaagcacagagtaaaacaactataacttttcgctcgggagtccgtttttgatgatcttggactctatggaaagctcactcagaggactacccaactcaaccaaaaacaaggtctaaaaccactcaaaggataggttaaagcttaggtttctctcaagatagcactatgataggtcactttgagcaccgagacatacacaaacacctcgaagttgcatccctcttaatagtatggcattcctaaactcaaatgtaaataagaagataattataccattaggaatacctttttttcatctttcttttattgtcttaagggatgccaatgccgataccgtttcaccatatattcttcaaatgattgatgcggttacttgtagcttcaaatggtctcgcacggtccattatgacaaagccatcactcgacctttaccaccggatttggttcttcggcgccaagccccttgcttgcccttcaccgccgcatggtccatcgcgatcgagcatcgcttgcccttcaccgtcttgccataatagctacttcgtatcacacatcttcaatatcttcactttgtcattcttggtattgttaggtgtaattgtatcacttgaacatcaacatctttgtaatccttgggacctatttctttcattcaactcaataaaattattagtcccaatgatccggttgtcaacctccactgttgaccaaccgatcgcatgtataaaaggatatgaataaatgatgagtattaatcaacaccacaagtgtcatatactcaaacatatgttcaaatgtaaagatcccaattaaatgaaggtgaataacttggatcgattacatgcataactaaagtataggatttgctccccctaaatgtatgcatacaaaatatttgtgtgaagtaagagtatgcataacaagatattaaacattgagagcttatcctatacaagaatagaaggcatttatcaaatatagacaataaaataaaaacataccttcatcatctccatgttctcaatgtaaagagactaaacaagatatggctcaaacaaaacattagtctcacatgctgtagcgcccgttccgtcgtggcgcctagcgggaaaaattaaattctaaaaaccctaattgcgaaatctgtttcgttgcttgttgtcagtctccatgccaatccctgatctcgaatccccaatctatcgtcaaattcaaatcccgaatccaaatctctccaaattcaaatccctctgtaaaagtctagtttgccttcctcaggttcggtgggccgatttccctctcggcccatatctctctctctctccgtcagctctcccctcgctctgctcgtgcgccgcaagcgcgtgcgcgtgagccgacgccgagccgagctctttctctctctctctctctctctttctcgttctcttgctctcgctctccccggtccatccccggcaagctcacggcgcgccattgcgtcgcgcgcgcgcccccgcgcggtcgccgccgtcgtcagctgcttgttgcccgtgcctgtgccgtccggccccgcgccctgccgcgctgcgccgcctgcgctgcgccctgccccacgagccagcacgcctgcccgaggcacgccgcccgcatccgtccaaaacctgaggcagcgcctcccgctcccatctctctccctccccaaattggcatagcgcgagctccctttccccccctccgtttctccctttcccctttcggcctggcccctgcttcccccattctgttcccgcgccatggacgcagaggagcagccgcgccagccgtcgcccatgccgtttgaccccacgcccgtgagcccatcccttctcctcgaagctccctcgccccagcactgctccgaggtcggtttccgaaccgacattgccaccccttaaaagccgcccctcccctctctctctcgatccccctgtttcgctcgccgttcgttgtcgcgcgtgtcggaggagccggcacgagcgaggacacgtgacgtggactccgggcacaccctctccttcctcttccccggcccgaggctggagcgatcacgccccgcgccgtcggccatcgtcaccgcgccccttcaccccgtcacggtagtgctttcctccgttctgcctcctcgctccatctcctccccttagactcgggtagtagcacgagtagaccccccgtagctatctggcgccgccccaagccttgccgccgcctattgtgtgctcaccgccgtcgccgcccgagctccgtagcgcctctcgtcgctggcctccctcggtgcatttcctcctaatccagcgcaaggaatggattcgcggagtcgcgtagatgctctagtgcgaaggaatcgaactcccgtcacgccgtcgccgtttcccccttctctcgccgccggttgccgccgccacaatccgccgccgtcgcactccctccggcgaatccgagccgttagctcgtctcctctagtcccgcgctacctcccggtgtgttcgccctcgcccgcatccccgtatatcgccccgccgctcgccgccgccatccgccgtccgttcgcggccgcgtcgtcgtcttcctctcgccggtccgcgtggcagccacgtcggcgccagctcggccaagaccgggtcaagcagaccacggccccccgctccccttcgccacgctcgcgcgcgcggtccaccgcgagccgtgaggctgcgcgtgggcccgccgcatccgcatcccaccgcgagccgcgcgcgtgcaccgcgccccctccgaaccctagcgccgcgtcgcgtgctcctcgctcactgtgagccgagccgccgacaagcgggtctcactcgggaccacgcgaggtggacccagcccaccggttccccctccctctctccccgcgcgtgccctttggccgccttctcgggccggccggcccatttagctcggccaagccgcccttttctctcgggccgcgccctagccgcccgagggaagtctatttcccctccctctctcttttctttttccaaaagggtttaattaaatcctttgtcctttagaccaaaaatccaataattttagaaattcaataacttctcaaccgtacatccgtttgactccgttcaacttccaaaaatcctcaaatctcgagatctatctaatggcacgcctataggtcaataatagggttttattttcgccatttgttgagttgtcccgtttcacgtgtagttttggagcccgaagacccgcagtgcgaggatttcgaggatcaagctcaagatctcgagcaaggtaagtcacctttgatcatcttgcacctataatttaaatctaagtatttcttttccgcaaatattgcatgaataggtttaacacaagtaattcggccgcggcttgcaagatagcctacagaccccaatcctaattgctgcaattaccctccttgaattattgaacaattaaaactcctttgtcgacttttgtgcttcgatgcacgggctttcgggcacgcgcattgaaacacctcccctcaaatataaaatatccaacaatgggtaaaacttggggttttacaaaagacttagaaaaacctgacacctgggtcggtgtttgcgaactaaatgaatttccaaaaccgcagaccgggggacgtaccgggagtacggtttcccgctcttgcacttaaggaccgtttccttggaatttcatccgaacataagacaagtgcgaccacatgggtgtaatggaacgcccctggctgagtaattagctaatcgggggagccatgatgccaagagacatgtggattcaacggggtggtgccggggagaacccccgggtttcctggcacagtatggtctgggacctaacctggtgttggtctgggacccctctcgttggcatatggtgaacctgtgtcggctttcaaaatgccttgtcatgaaagcctcaaggtctccagacgtggccgttctgcacgggctgggtgattcgggttagtaatgtcatgtgggtaaagtgtaccccctctgcagaggttattaaactgttcgaatagccgtgcccacggtcatgggccaatgtgaggtgattcctagcgtagttttgtttgactacagcttgtgaacttactgttgtggaatgggttcgatgtttggaaaatctgcggctgatgggatcagccaggcccgggtggccgtttgaaagctgttggccgggtgccaaccttgaaccaattcaaagactgatacattgcacatactccgaccggacaagacgcactgtctcatccgtgtcgtttgagaagcactcacttagttgtttcaaaaaggagtttaaataaaatcaattgtaaaaacaacagcctttcctttgaatcctgcattaaacacttaattcccatggcttgctgagtactcctgtactcagccttgctctatataaataatccccccagttgctgaagaagatgaagtggatcccgctgatgaggagttcttccaggagcaagtcggctacgatgagttttagggtttcggcctagttcccaagtcgcgcctatgatgattggtccaagtcttggcttccgctttcccttttgtaatgcatttttttttgagctcgggatctgtccgcagcccaacatgactgtactcctactctgtaataaagagatctctgttgctgtgatattctgtcttcctgtgataccaacactgtttcctgggactggtatcgattaacaggttaatttggagcgtcacgggctagttccgtttggggctagttcggggcgtgacacatgcttatgtaatcacatgaaaatattatatataaatatatcaatatgtgcacggataaaaagagtggtacatatagcttgatctccatacatttcatccttgtgatttaggtacaccatcaatgaacgtttttctcttaactcatatgaagtccagaaatcacctctcacatattccactttcatatccatatgagactagtagacaaagaaatgcttataacaatgttagtctcatgtaattggatttgtcattaatcatcaaaaccaaaataatggcacttgaactttcaggttagcggcggcggagctcgggcgtggcggttggcggtgctcgggcgtgggcggggaggtcggatctgccgccgccgcgccgctgggaggccggatccactgtggggacaaggccgtcgccgctgcaggggacaaggccgctgccggtggagctactcctcatccaggtctatcacctcatcacctcccaatgtcagcacccatccgttcttgcgcttcgattcgccatttttgttgacacggtaatctgaaatccgtgtgtggtggtggtggtggatgcgcagaggtgacgaaggcgctgtgggcgaggaagaacgagaagatgcggtggtgcgagcctaggcagtagcatgaccagctccagcgaggcgacccgctcgccgatgtagccaaggagagatgcagcggcagtggcgaggggacttcaaattttttttattgtgttgatttttgtgatgctattgtgttgatttttgtgatgcttgaatgtttgagtgaatgaaaattctttaatgtaaatttctgtggaattttgaatgcttgggtaaatttctgtgaaatttttgaatggtgaagcgttgacggaggcggacggagcagtgttgctccatccgtcgttttttttaaacttggcaagcattaacactggcggctggttcctataacccaccagtgataattcatttacgccggcggctggcttaagacgaccgccagcgaaaatgaattatcgctggcggtcgataaccactagcgaagatctacattttcactggcctttgctttgtggcagctgcgatttccaccagcgaaaacccaaaatggccgccacgaaagatggtttttgtagtagtgtcaagagtaagacatctgagttttcatgccgcacagcccatggacagatgatggttgatggcttcaaaccgtctattgccatgtcatatgtgcaagcaaggtccctgctcttatctcgtgggtcatacgtcatgcatataattatgcacaagcttgagaaaaagaactgtaagactgctgtgatatgttagttgataaaaggaagatgagttgtgggagatatgacaccagagataatggtgagactactatcttagatgcaagcactggtagagaactcatattcagtcccggttagaaacccccattaattccggctataacaaccgtgactagcaaatagagaaccggttgaaataatcgatactaaagatgcataccaagtcaaaaaaaaatgtgagcttggtaaggtcacagtgatgacagcacagtggctcgatgaggctacaacaatgacggagcgacggcataaggtactggcagctagcgatatcgctggcacgcgaggcaagtggtcatggtttgcgcctatagtgtgggcagcgaccactagtatcaattagcgcctcttcggataagaggcaactaaggaggaggctgttgcaaggatgctggcctatttgagaggaaagcttgtgaggaggtggacaagcatggtggtggtcataaggaggctaaccatctgttgaagaggaggtagccatgaggtggtcgatcgatgagctagcgactcttcaagaggctagccgacatggacgaccagtggatttgaggtggagctccccccagaggatgttaactggaggtgtggtggtaattacatgttagtgattgttggttggtggttgatttggaggatgatggagctagggcgtcttggcaaaggtaaggccgatgctaggcgaaagcctcatccagtgaccacaatctcctttggggtgttctcgtggtggctacaatctctttcccggtgagatgctctaggtaataatcattcccaatagttctttgggtgggcaacgatggctctttggtgtcacggctttattggaggcctagtccttggagaactgtctccgccttttcatttttagacagttggtcctcaccttctttggtgttcattgtatgtcatgatagcgatggatctgtctgagagacgagagaatctttcttcactctcaccctttacccccgcaaccctaatctgttgtgactatcaggagtccccgctcgaatttggtaactagttggctggtgaggtcaacactaggtaggcagttttgtggcactcctggctgatttgattgataatgggcctattagagagaagagtggatccttcttctttctcatcctctccctctgcatctccaagccgggatgggaattgggagcccatatgtgtttttttgagcggtttggctttgttggggttgtgggcttgtgggcttgttagaggcctagcagcggccacctagtggcgcacggtttggtgctaggttcttccttaagggtgtgtactggtgtcgtctgcacacatggttgtcttgtgggcatggttgctcagcaagcggacctctgttagactttttctgctataaaatatagaaactccacgtgctattcgttagaaaaatgatgctagcgcagtgcgctaccagtgacacctttctttccaaaagaagaggagtgttcttttcctcacatgaatgtgtcttgctaaaaaaagatgcgcacatacactttcattaggccatcaccaatgcgtagcctcgggtcatcccctcgccgacggacgtccggctccgtttgccgtccccccacgagagagcgcgtccctcagctgggagacgcgtcccttggtcacttttggcttagggatgacatggagcgatgcgttgggggtgacgggctcctgtggacaccgtagctccaccaccaaattctcctttcacccctctcccctctctctctctccggttcccctcgaggtcgagccggaggaggcggcggctgccgcggtggaggcgtggcggtgacgccggaggcggagaggacgaggatggaggtggggcgaagagggagagagaggcggtggcgcaccagatctggcgacgatccgcaacatcaacgggcggagggagccacgccgtcctccccagcctcctccgctggtcggagtcggagcgtcgtgccgtcctcctccgccggcgccgtgcccgacaccgccggcccctcgcccgcatccgccggtgccgcgatgagggagagacgccttgagccggagacgggagagagagagagggtgagaggcatggagccggcgacgggaggccggagtcgtcgagccgacggaggcatcgtgttagtgatatgccctagaggcaattatagagatgattgtatcacatactatgtttacatatttatccgacattgttccttgaaatagataactccttattggttaatgaatatgtgattctttcatgagactctttatgttgtttattactatttctaaaggatccctgatcaaatatcatatgtggaacaaatatgtttatatgatcagcacatgtattaattgatgatcatgtctcatggatcatggtatagagataccaaattaataatgtggacacatgttggtgaacatgttgttggatagacccaacatgagacactgcaagagccatatgtgttgtgtcatcagtgatctcatttagtgttggtgttgaatccttagacctgagattatcatggttctcaacatatgtagtagcttacttagggactgctaaatgctactccgtaaatgggtagctataaaagtagtttttgggtatgctatgaaacatgtagtgggatatgaataatcaagatgggatttgcccctcctatggagagatatctctgggcccccacgatgttgtagattatggaagtgcttggccatgccaaaggtgattgaggagtcaatcacaagttactatcaacaggttcgagtgaatgattgaactattagaggatggcacatatctagccttgagcttaatcgatattgtgaagcaaaggggttcatacaagtatacactagaggttcagccgatatgatctttatgtatgcccggtgggtcaatacgttctgctaagggccgctgttgacgcattgaccgaaaaggagttttcgtgttacagccgagtatatatgaacctacagggtcgcacgcttaatgggccggaacatggggattggatagagatccaatatgagcttaattcggatatggatccgaataggagtcctacgggccttggaggcaagagtgatagatcctatatattcgtgaggggcgtgaccagcggaggcattgtatcacgtgagaaaccctagctaccacttccctccccgagcaaaaccatagccgcgcgcgggtgctagcacatctgcgcgtggcgttcagtccttgtatgtgtggataccggtggaggtgccgttggtttgcggtgctgatcggcgtgggagtacggcgaggagaacgcatgaggaggagaaggtcgagccggtgcgatcgactacttcctctacatcgacgcgcgctactttgcgagagttccttcgacttctcagcgtcttcttttgctgcacagcgcgtcgagtggtaacgatctatgatctaatacttgcatggttcctagtttacgcaatagaaaattttgatttatgctatcgtagcctacgcgtatcccaaaagtggtatcagagccgccttgtatagtttatgatctagatcattgcatatagttagtatgcgggtgtagtagatgagatctattatgttgtatataagtttttaggtgatcggaacatgagatgaaccgatagacgcaagggttgatgagatcaatcggtatgtgtgttggtgacttcactgaaatgtttagtactcaccaaggccgagcgcgattgtgttcatcggatagtccgatgtccactggaaccgcacgccaatgagaaaaaacgaggcaataagattgactcagtttcggcataattcgattacgccgttaaagttttcacatagcgggactgccgtgtgcgttgtcccttagatttcgcttggggtttttatatctatcttactttattgctgttatatatttgatatgacataataggatagattccctcagaaaaattaagtgtaatgtatgctcttccaataattgcacctattacggttgtgatcataagtgataggtttgccatagcaaagtgtcactttttatcatgataaaataggatagatgtcggatatctatatgcggagattattggtttacttgacaaggttatcaaaacagttttggaccttggggcataggttgggttggacatggagatgtcaccccaacagcacaagagtcacgtatgatgtgattagcaaggtgttgcttacctattttgatagttgtctagctgtgataccaaagctcactagacactaataaaatgaggatcttggctcactatgttattagagggaattttgtttcacaatacatagtgggagtatcttttgttaaattgtttaatgaaaggttaaatgtaaacatggtgctgattttgcatacatatatttctattgtagatcatggcagctcctgcaccatccaattttaacttgcggtctattcttgagaaagagaagttcactggaacaaacttcatggattggtatcgcaacctgagaattgttctcaggcaagagcacaaagagtttgtgcttacagagtcttttccagctaacttgcccaacaatgctcctgctgctcaacgtagggagcatgaaaagcgatgcaatgattatcttgatataagccgtctcattcttgctactatgtcccctgagcttcaaaggcaatatgaggcattggatgctcatacgataatcacgggactacgtaacatgtttgagggccaagcaagagctgagaggtttaatatctcaaagtccttgtttgcgtgcaggctagtagaaggtaatccagtgagcccacatgtgatcaaaatgattggttacaccgagagtctggataagcttggctttccccttagccgagagttggctactgatttgattctccaatcgctccctcctagctttgagccgttcataatgaatttcaacatgaacaacctgaatagggccttggtagaattgcctgggatgctaaagactgccgaggaaagcattaagaaaaactccaaccatgtgatggttatgcataagcgcaagcccaacaacaagaaaagtggtcaaaagagaaagctaaactctgatgagatcacgagtactagcaattctaagaccaaggttcaaaagacagggcccgctaaggatgcagagtgcttcttttgcaaggagacaggtcattggaagagaaactgtaagaaatacgtagagcagctcaagcagaagcagcaagatggaaagaattccacctcaggtattaatgttctagaaattaatcttgctacttcctctactgattcttgggtatttgataccgggttagttgctcacatatgcaaatcgttgtaggggctgaaaagaagtaggagcttagcaagaggcgaagtggacattcgtgtgggcaatggagcaagagttgctgctgttgcggtcggcactatgccattatctttaccgttaggattagttttggagttaaataattgttattgcattccagctttgtgtaagaacgttatctctgtttcttgtttgcaagcagagggttatggttttagatctgtggacaatggttgtccagtctattataatgacattttctacttccatgcacccatgatgaatggcttatacattgtgaatcttgatggatattcagtctatgacattaatgcaaaaaggcaacgtcctaatgatttgaatcccacttttatttggcattgttgcttgggtcatataaatgagaaacgcatggagaagcttcatagagatggacttctacactcttttgattttgaatcatttgagacatgcgaatcttgtttacttggcaaaatgacaaaggcacctttcacgggtcaaagtgaaagggcaagtgaactattgggactaatacatactgatgtatgtggaccaatgagctcaactgacagaggtggttttgggtactttattacctttatcgatgactttagtagatatggttatgtctacttaatgaggcataagtctgagtcttttgaaaagttcaaggaatttcagaatgaggtacaaaatcatttgggcaagacaatcaagtatctacgatctgatcgtggtggagagtacttgagcctagaatttggcaatcatctaaaggaatgtggaattgttccacaactcactccgccaggaatgcctcagtggaatggggtgtctgaacggaggaatcgtacattgttggacatggtgcgatcaatgatgagccaaactgatctgccgctaagcttttggggttacgctctagagacagctgcattcacactaagcagggttccatcaaaatcagtggataagacaccatatgagatatggactgggaagcgtcccagtttgtctttcctaaagatttggggctgtgaggtctatgtaaaacgtttgcaatcggacaaactcacacctaaatcagataaatgcttctttgtggggtatcctaaggaaacgaaaggatattatttttataatcaggaagagggcaaagtgtttgtcgcccgacacggtgttttcttggaaaaagagtttatttcaagaaaggatagtgggagcatggtgcgacttgaagaaattcaggaaacaccgaaaaacgcttcaacgtccacataaccataagctgagcaagatgttgttcaacaggttgaacaagttgttgttgaaccagttgtggaagcaccggcttcatgaaggtccgataggatacggcgtacacctgcgaggtatgcgttgttaactacaggacaacgtgatatattgttgttagacaatgatgaacctactacctttgaggaagcaatggtgggaccagactctgagaaatggtttggagccatgaaatccgaaatagaatccatgcatgtcaatcaagtttggaacttggttgatccacctgatggtgtaaaagccattgagtgcaaatgggtctttaagaaaaagacagatgtagatggaaatgttcacatctacaaggcacggttggtggcgaaaggtttcatctacaaggcacggttggtggcgaaaggtttcagacaaattcaaggtgttgattatgatgaaactttctcgccagtcgccatgctaaaatctattcggattgttttagcgattgctgcctatttcgattatgagatatggcaaatggatgtcaaaacagctttccttaatggaaatcccgatgaggatgtgtacatgacacaacccaagggttttgttgatccacaatcagctaaaaagatatgcaaattgcagaaatccatttatgggttgaagcaagcatctcggagttggaatattcgttttgacgaagtactcaaggcgttgggctttgtcaaaaacgaagaagagccttgtgtatacaagaagattagtgggagcgcactggtatttctaatcctatatgtagatgacatattattgattgggaacgatattcctatgcttgaatccgttaagacatcattgaaaaacagtttttcaatgaaggacttaggggaagcagcatatattctgggcataaggatctatagagatagatcaaagaggctaattggattaagccagagtacatacattgacaaggtgttgaagaggttcaacatgcaagattctaagaaaggtttcttaccgatgtcacatggcattaatcttggcaagaatcagtgtcctcaaacgactgatgagcgaaacaagatgagtgtgattccatatgcctcggcaatcggatccatcatgtatgctatgctatgtacacgtccagatgtttcatatgcacttagtgcaacaagccaataccaattagatccaggtgagagtcactggatagttgtaaagaatatcctgaagtacttgagaagaactaaggatatgttcctagtctatggaggactggaagagctcgttgtaaatggttacactgacgcacgcttccaaaccgacaaagatgattttagatcgcagtctggatttatgttctgcctgaatggaggcgctgtgagttggaagagttccaaacaagatacagtggctgattctacaacagaagcctaatacattgccgcttctgaagcagcaaaggaggctgtttggataaagaaatttgtttctcaactaggtgtgatgactagtgcttctagccctatggacctttattgcgataatagtggtgccattgcgcaagccaaggagcctagatcgcatcaaaagtccaaacacattttacggcggtatcacctcattcgcgagatagtgggtagaggagatgtgaagatatgcaaaatacatacggatttgaatgttgcagatctgttaacaaagccactccctcagcctaagcatgaggcacacactagggcaatgggtataagatacgtttatgattgactctagtgcaagtgggagactattagtgatatgccctagagacaatcatagatgattgtatcacatactatgtttacatatttatctgacattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgataatcatgtctcatggatcatggtatagagataccaaattaataatgtggacacatgttggtgaacatgttgttggatagacccaacatgagacactgcaagagccatatgtgttgtgtcatcagtgatctcatttagtgttggtgttgaatacttagacctgagattatcatggttctcaacatgtgtagcagcttacttagggactgctaaacgctactccgtaaatggatagctataaaagtagttttcaggtatgctatgaaacatgtagtgggatatgaataatcaagatgggatttgctcctcctatggagagatatctctaggcccctcgatgttgtagattatgaaagtgcatggccatgccaaaggtgattgaggagtcaatcacaagttatataatctatcaacaggttcgagtgaatgattgagctattaaaggatggcacatatctagccttgagcttaatcgatatcgtgaggcaaaggggttcatacaagtatacactagaggttcagccgatatgatctttatgtatgcccggtgggtcaatacgttctgctaagggccgctattgacgcgtggactgaaaaggagttttcgggttacagccgagtatatatgaacctacagggtcgcacgcttaataggtcggaataaggggattggatagagatccaatatgagcttaattcggatagtgatccgaataggagtcctacgggtcttggaggcccgagtgatggatcctatatattcgtgaggggcgtgaccggcagaggcattgtatcacgtgagaaaccctagccgccacttccctccccgagcaaaaccctagccacgcgcgggtgctagcacatctgcgcgtggcgttccgtccctgtacgtgtggataccggtagaggcgccgttggtttgcggtgctgatcggcatgggagtacggcgaggagaacgcatgaggaggagaaggtcgagcaggtgcgatcgactacttcctctacatcgacgcgcgctatttcgcgagagttccttcgacttctcagcgttttcttccgctgcacagcgcgtcgagtggtaacgatctatgatctaataattgcatggttcttggtttacgcgatagataattttgatttatgctatcgtagcctacgcgtatcccaacacgtcggtccagctcctcgcctcctcggtggatgccacacgcggtagatgggagggagtaaatgaggggaagagagagaggggggagaagagaggggtagtatagtaaaatgtgcttttttggtagggatactcattgggctactaggggtatcctacattgtgacttgtgaggggagtttcctagagagtactctcagttagtgagggcacccatagagtatccctgattggtgatgcccttagtactaagcagagcccatgttatttaaaaaacaagtaccgtatccccactctcccatgtatataagtaccgcatcctctctctcatatgtactccatccgtttcacaatgtaaatcattctagcatttcccacattcatattgatgttaagggtatccataatgtagtaaagaagtgggtattagggattaaaatattcttactactaggtaagatacattgtggaaatagtaaatagctactaccaagccataagcttactattaggttatagcactttgtggtgggtcctacctattttttaattgtggcatggctcatgtttggggttatttttcagatgggtcccaccttattacccactctacacatatatacattgtggtgcatcttcaatctactattaccatcttacataggcccaccttactacctacttttgcaacatacattgaggatgccctaatgaatctagatagatgctaaaatgacttatattgtgaaacagaggaagtatatcattttcaaaagaaggcaccatgcagttcataccccattgcactggtatttttttaataaaaccacttatattttttaaatcgtatgttattttaaagatttgtttaaaccattttactccactcaaaacatgtaaaaaaacaagtctaatattaaatatattttgaatagcaatatagttactttaaataccatcaagagttagtaccgtgaagagtacgatggctcaaacggaatctaaaaataatacatggtttaaaatatgttatatttggtacatctagatttattaatattaatattaatgtgggaaattttagaatgacttaaagtataaaagggagggagtattataaaagaacatgtctacttcaccgagagaaaaaaacaacacgagaaaaacctggcgagcacaccaccaccgcatcaccggtccaccgctcttgccttcccctttcttgcagtgcaggaaagaaccccacgccctcatccaatcccagccgtccatccaccatccaacgtctctcaccgcgccgctcacctcctcaagaccaccacccaccactcccctcctctctcctctccattcctcctcgcttcgacaaacaaaaccccccaaaaccctagcctccgccgcccgccgccgccgccgccgcgcaacccccgagctcgagcggcgcgatgaacatcaagggcggaggccgggtcccggtgcccccggccggcgcgggcacgctcgtcaagctggtggtgctcggcggcacggccgtgtacgccgccgtcaacagcctctacaacgtcgagggtggccaccgcgccatcgtcttcaaccgcatccagggaatcaaggacaaggtaaccggacacgcccatccccccgccccttccctgttccatttcgttacttggatgtgccgcgtggtttggttgcggcgttaacgattcggtcgtttaggggagagattggttggaaataaatatttggtctcgcgcgctatcttatgttaggttgcagggtaaattgtgttttgaagcaaatctatttgggtttataggtgctatctggtaaatctgaactaaccaggtggtcttcatgatgtgtgagatacctgcctatctttagataacttgtttagctgcagcgatttatcaggctgaaaacatgacaagtgttccctttcttgtgggtgatatcatttgttgaggtttgaggattaaaaaggtcaaccattgcgtgtgctggaactgattccaagttcttggtaaaaaatccaatttgtagtatgattgactgctgattccagtaccttatgccttgaaaagagaattacctctgaaacaacacgatcgctctgtaccaatgtgtgtggtttccagtctggcttgcactgaggttatgaaattttcctgcgctagatacctgtaattggttctagaaagcagctgctttgtcttatttattggcctgcggcaggtccacgagtaccatgccgtggtgtagttcagaacagatagtcacatgatgtttctaccttcattttttatgttgtttgttgaaatgatctgaatgtggtaaacacttattgaaattaaattgtaaatgaacacgactacttttgttttatcattccttaaaaaccatttgaaaatatggtaacattcatcacagtccagtcgatttaatgcacacgagaccactgctggttggaagatggtgccaagatcaactgaaaaccattgacttctttcagtgtttgccgcattgtggtttttttataccaaatttaccatggacaagtgcaatcgcattatttgattttagtctggaagtctggctgtgaccattatatatggctcgccatcagtacaatcagggcatattgaagttgtttgtgttcacaaaaacacacattcttttctgtactcacaatgaactgcacatttagttctgtcacacatgcacctttttcttgtaatttctttaaatgtggttcatgggagtaacgcatttccttttaaaatatgtatctttattttatcactatgtggtttcttatgctctttctttctctcttttttccttttcaaaaagtaataaaatgtattgttattaatggcattcaattgtggttctctgtttcataatgcaacttaaatagcattaaatttgttagatttgttgaaaatatctgttatcatatatcttctgctctaactatcttaatcgaccttagatggccggttcctagcaatctactcaggaacagcctagataacgacagaggctgctttcaccttcttgcccataggttacttcgcccaaaccgacgacacttctccccacctttttgagcagctttgatacaggatatggcgactctttattgcgagtatagcatgactatgaacctgacatgcacacacaggtgcaaacaaatcataacaaggagtagtgtcttttacattctggctccttgcattattttggactaaaagtaaatttagggttgttttgtttgctgtgccatccttccgtcgccagctgtagatggaccccagacatctaatgccccctttgatatcttcctcgcccaaatgtgtcatgcctgagttagtctcctagattccttcttgacatatgatctcctgttcctttaaaaataacatgtccatatttcttgcctagaaaagtaggtttcaaatggaaacggagttacgtatgtatatagcatgcatgacttggtttcctttatatccccatagcttgatctttgtagttaccaaggcaggtgttgatgccgagaatagctctaatgtagtgtctgtccgctccgtgaagcgggaccaaatttgcagccccacacgaccagatcgtcattgggtgcaaactctgtcacttttggtaccaccaagcggcaccatctatcaggtgttctgttgctgccagtcctgtttttcaattttggctgcttgctgaagaatcgctcaaagcaattgaactaaggttgtgggtcttccttgctgttttaaatgtcataaaccctagatgataaaattgtgaagctaaagcttgcttgcaaacagaattaccgaaccctgcagcaaaccatagatggcagagcagctattagctcagatagcaagttgtcatgaaccgaaatcatgatgaggccaatgtcagctgggaggattgctgaatggtgcaggctgctactgatgagttgagggcttagactgggatcatgaacattaggggaaagattaacagtttaattttcttcattgaatcctctccggtagaccagctcattgcctcttatagggccagctcctaacagtgtaatctaactaatttaaattgattttatcagctaattaaaaggaacaacctagataactatggctgctgctgctgatcttcttggtccatgcccatggtaaccaatattatgtttttatcttttaagatataatttgtgattgtgagttatttccttgctgttcttgattttcgaatgagatttgttgtgtgcatgctatttattaaaaaagaggcatggaatcagattttacttcaaaaaaagagaccacatgtttgcatgttacgtccacctctcactgtttactgtgtttggttagtcattccaaagtgagctttagaatttccttattttatttcctaaataggatggtagtatttatctaaagttgtgttaacaatgcttgtatagctagatgctctattctttcattgttagtgctggagcattaaatgttttatgcttgtttaaagtgtattatgaaatatgcaagaagcttgcctatgtcttcatcattataattattgatcttatttagtataaaaaagagctgttgtgagtcctccctttcctgtgcatcagagctttgcgtggatctttcgcactaggtaaacctgtattcttattgtgtaaagtagttctcaaggttttgttgctatcatgtgaactaagttttggtgccctttccttgtgctgcgcttaatacttcagttcaatccaccttaacatagctggatgactaatatatatttaacatgtactacctacaggtataccctgaggggactcactttatgattccatggtttgagaggccaatcatttatgatgtccgtgctcgtcccaatcttgtggagagtacttctggaagcagggatctccagatggtacgtttgcatctttttaattctatattttcatcgttggaatgtgtgtatacttctcatctaatgatagatatacttgatttgatttgcatgctctattttcattgtcattgcacaatcaagttaaattgaatttaaagccaaaatatgtgctgcttagtgcttacatggtttcattgttgatgatgatgaatcatcacatcctacattgaatctttgcatacattaaagtattgtgtcattcataatcattaacatctttgactgttagtttgtttcagaagctattaccacattttgcaactaaccaaccttttgctgatggttactagggttctatagccttttgctatatttttttgtctgtttttttgcatgtttgttttcatagctatttaggttatgatattaagtttggagcatacctaaagtggtgtgattactcagagttcattttggctcatggattttagtaaattaattattggaggcaaatgttaattggtcattctgttattgtttatagataggtacgtttaggggtaaaccttttttgtgggctaacaaccagacagtccttttttacttatggctatattccaaattctttcctactttatgatagcatgttactccttgtaaagatatttgattgtggacttatttggtgattaaaactgttctactaaacatgccaggcatatgtggtcaggttttagaaaaaaaattgaactagtgagtagtgagccaattagaagggatgtgccaaattttggaaataaacacagtcgaagaaaatatgcaatttcggaaataaacgcagtcgatgttttagtttatggttgtgccatgtgcttttatgcttggagttccatttgctgaacataaaacccttcttcatattttttatgcatctattgtactctatttttggcaggtaccctttatattttttatgcatgtattgtactctattttgggcaggtgaaaattggtctccgtgtccttacaaggcccatgccagagaagctaccaactatctacaggactctgggggagaacttcaatgagagagttttgccttcaattatccatgaaacacttaaagctgttgtcgcacaatacaatgcgagtcagctaatcacacagagagaggttaagacctgaacatatgctttttatagtctttttttcttatatttgatgggggtcaacattacttgggggcgctaactgtttgtttcactctccaaatccagaccgtgagtagggagataagaaagatactgactgagagggccaggaattttaatattgcccttgatgatgtgtccatcacaagcctgagcttcggaaaggagttcactcatgctattgaagccaaacaggttgctgcacaagaagctgagcgtgctaagttcattgttgagaaagctgagcaagacaagaggagtgcgattatcagggcacaggtaagaaatctgttttatagccattgcctgatgtcatgtgccggagatacagtttgacagtacatattatataatggttttgccattgcatgtctagttaacattgtctcttaaacatggcctttctcttctttcaacagggtgaagctaaaagtgctgagctgattggtcaagccattgcaaacaaccctgctttccttgccctcaggcagatcgaagctgccagggagatctctcatacgatgtcatcttcagctaacaaggtgttcctggactccaatgatctcttgctcaatctccagcagctcaccgtggcaaacaagtcgaagaaatgaagtcattctcgcaccatgttctaggttattagcagatgtcagtctaccagacaatgtgaggaacacttggtcctctctgtagttgcactagtgatcatctgtgatacagaactcgacgagtgactcaacttttggcaaccggcaatctttttgcaaattgcagctaaactttgcaggctacattttgactctgctagtccttgaggaagttcaataaggaataccattctgttttaaggttctcaatctgtgattgcgatgatggattaagaaactgttagatctattgatcaatctggtaggtcccctactggtatgtttatctgatatcatgctgaatgtgtaattttcagcaacattacaggaaatatgccgttgaagaatctaaattagtacactgattaacagatcgtcgatatgtccgagtggagacagactcgaaatctgttgggatttgcctgcgcaggttcgaatcctgctgtcgacgttttttgcttaagttcttttttggctacgacttgacagatgatactccatattcgtttattggaaaaaccagaaagaagttgaaccagaaacattttttaagagaaaatattaataattttggctctttgagccttacattcgatcaaaactatcacgccacaggaaaatgaaggatctacaagatgtggtagttttaattttgtgaaaaaaaaagtaacttctatgctaacgcatatattgagtctccttactattactccctccgtcccaaaatagaaatatttttagcacatgttaagtcaaatagttttaattttgactattaataaaaaaataataaaaaagatcaatcatgttttgtgatgattttggggataattttgtgatgcaaatttgtgggtgatttttagatgtttttgtgaatatgtggatgattttggtgatgtaaatttgtggatgatttttagatgtttctatgaagttgcagatgagtatgtgatatcaatttgttgatgattttatctgtgtggatgattttgttgttgagttcggtgtgaaatcaatatgaaagtagcaaaaaaaaaagagaaaagaaaagagaaagcatcacgtggcgcttttatttttactcccgcttggtgactcaaaccaaatatcgctacctttagtcctggattctctctctcgatttgcaacctgggactaaaaagggttgcgaacggagagatgtggggtactctggtagtgatcctatataattggtacccactaaggggcatttatactcctataaagtaaaacatgcaagaagccacatcatcaataattttaagccatcagatcatattagtacaaagataacaaccgttggatcaaaaagctacttattcatccaattcaatcatttattagcaatccattcacctcaatttgctccacctcatagtcacacatagcattgttacatattttgtgtataacaccatgttttccgaatataattcaaattattgtttaacacgtgattattatttaatatgtgtgttttattttattatgcatgataagatggcatataattattaggtatcgttaactgaatacattttcagaaaaagacgagtgaagtagaggtatgcaaactgtctaactacaacgatacacatattgcgcatgaaagtaatattcatatattataacaatacacaatgacacttggaaaaataaagcatgaatttattgtaataatataaggcatatataaatccatattatcgtatattttgtatataaatagagttgcacctaaccatttaaaactatgattttgtttgatcataaaattacaaaacccgcgacaaagatgtggggtgccaactagtaagttcaatgacagactcctagcagaaagatccgctcatcctcgcgcgaacctagaacagaaaccgagagaacgccgaaggccaaactaggaagaaggaagggaaggcgagggaacatgacctcctaggtgacgcctccaagaaggttgcaacgtcaaaggtgccaccgtcgcctgctcatattggactaggttttcacctaaaaagtcatgtcggggagggaggatggcagctcaacaatgcccacaagagggagcacggcatcaagaggcgttgtcattctcggcccaaaaatcgagctaggcttttgccaactgtatcatctccctccgaaccatcgacatcccaaagctctgccacccgaacgacctcctccatcacgtgggctcgtcgcaccagagcccctccgctggccaacacccctgtcacagccccagctcgtgccacacactacctcgctccgctagcgcctccacactgggctcacctcacacaccgcaacagtctcctgctgtcactgaccgcattttcgcacgctgcatcagattccgcactacaagccgcgcctccacgcgtcacaccagtctatcgctgtcgccgaccaccggatctggccagagggtaccagatttggcgcccactgctgccgctaccgcctcgacattgccgccgtcactgcaatcccaccgcatgacatcgctgccccgccgcctatcaccacctccgctcggctctagatacagcgatgtccatcgtggatccggtcgggtttggcgcgtgggtggctctccgtcgccgccgttgtcgcctcccgtgccccacctttgtactctgcctcccgtaccccgccaccgccggcccgaccacgcttgcaccaccttttcctgcatgccaacctcaacgtcggcatccctccggccatcctcaacctttgagtctgccacgccggatctgtggaggccgccgccaacctcacaagtcgccggctttggtggccacttgctctggcggctgcgtctagggtttccacccgagtcgcccgacgcgggcagtgacgcggacgtgggagtatagtgttcttggtctattttcacgatgatacctaggagaggccggatggagaggacaaaaggtgggtgaggtaggatgcttgtagtccgggatggggtccttgacctggaccacgttatccacacgatttccagtgtgccaatgtatcggcccatttggtacgtgatatacatcggcttttacaattaatatataaataataaagcattagatgctgccaaatactcacgaactaatattaaacatgcatggttacacagaattatggagccccgttgattatcctaataaaccaaagctgttgacggtcgttatacaccaaattcgactgtcaatataactaaaataaagaaaaactagctatgcttgcaatgcatatttatttaagaataatatagttccacttgtacctagagtattatttgtctgcagagattaatacataaatggagaagaaatgagaacacttcactcctaagcaagcttaaggataagatgggcccacatgtcaggtgtaaccatgccggaaaccgccataactgccacaactgtcatagggacccacctgacagtgacctgaccgaagctggaggcctgctgggccggcccaggttcggccgaactctgacagcggtagctcagctcggctctccagtgtacgctccagatgactccccaatgacggttgcggggcatttctgacaattccaaccgttttaaccatcattgcaaggctatataaagaggtcacttcattcattctccaacacactcaagcaagctcaagatctttccctatactttagttttgtgctctagtgctaagtggagtagaatagaatagctcttggagtcctcagagtcttcggaagagttcgagtatggctgtagtagcttttctttcttcttttgtatgactttcagaattactagtatattattctttatatactctcggtactttatttgtccgagtatcggctttattttatatctatgtcattatagttgtgtagctagcctaccagagaggtgcaatggtgtgggtttaatgtccgattattcggttgctctgtgtcattccaggggacatagagtagtagaggtggtgtgtagattattaagtatcattatctgagcatatatgctgcgggacagtagaggtggcccgttgatggtgacaactcagtatgggtattcctccacgtcagtatatattcctaagacatttttctggggagggtactcctccgtatttagccccgattggatggccatgacaggttgtcataagaaactcggtaacctagggtggtctctcgaaacaccaggagggcactgttaggggtagtggccacacaattgtatactagcagatgtaaactaaaatggagtgtatactagaagtatatgaattgattgcttttctatttcttcttccacatagcttaggattaattaataagaagatctgagttctttttgctttgtgtcactctacccttatgaatgtattaatccctgcttagactctaatcgtaccagtggtgtaaataaattattagcatagttctatattataaatctttctttgggattaaataaatatgataccttggaatacttctgggtaaaatgctacaatagtatatccgtgcgcttgcggatcccttatgtaatcatatatataccaggactatttctggcgtcattactgggaatttatatttctagtaacatcgttaagaaataccatcaagcatttctagcgccgttgccgggaaagattaataaagagattactataagctaataattttatatgcattacctctgtatagatcactgtcctttgttggctaaccttgattgttttcacccttaaggagttgcctccatgaattcaaaggaggaggtttatgatcaaagatgaaaccattcatttgcctccaaatattcctagtcccacaaagattttttttccatgaaacaatggctttgataacagtttcttgattgtaccatcatgttatccaagctcagagatgtgtcccaggagatacctagaacatcatagcaagactttgcaaaggtacactgaaaaaaatagacgcaatagattctcaagatggtgaattggacaaagaacacaactaagatcacaatcaggtgggggcacaatgcttatggtccaacacatattttgtgttcaacctgtccatcaaaagtaaccaacaaaaaactttaacctttgaggtagccttactcttccatagccaaatttggccaaagaattgatgaagctgtccatgttctgtaatccaattcggccacctgttacagtgttgacttcaaacaaccgccaaatgtgcatacgagctctgttttcaactgatctatccccgtcgccaaattccatcttagtcatccgcagttgaagaaacaaggtgttgcatcatttgtaatgggcctatgagcttgtaattttgtctgggacctcggtccaactttcgccaatgtggggtgtgccccaatctgggggagcacgaacccaatggccctcttggttgtcctcccacctctttcaatagctagatacccctttagggtttcgcgggttttatttagattaaagtttagccattgcaacttttcctcgtgcttacgcgtgtcggttagaccgcctaattactcgtcttcggaagcccatcttatcgtgcattttaattcctatttgcaattcaaattgatttatcttgttcttgcttgtttctccgatttgcttgccggaataagattgatctgcaccggcaagatcaataacccacagagaggtgtatcgatcgctaagacacaacacaacaatatcttgtacgattatagttgggtcatcaacgtttctcccaaatgattgttatcatcaactcatcgaaagatcgggtcaatcgaagctgtgagcgtatcgagtggagctcaaggtttatcagagggtgtagttattttggttagtgctttagtcggcaaaaattccacaaacaaagcagaggagcaaccgtacattaggagatatggtctaccatgagcagcatgtctgtccagccaattacatatctcttttcctgccgtctagttggtggtgtgtgcttcactcatacattttgcacagtatttgcagccaaacaatactatctacagagcttaattgttcctttaaagtaatatgaactaatagttgatatagaaagtaagataaatataaatccataatgccgactgaaagatcttccgttggttcttttcaaaagaaagcaaaagaactttggttgatagatggttttcattgcacatgatcaaggccatatagatagttccacacttccacatacacttaccgacttctttttagaaagggttaagttgatttatgtcatttcagataaataccactactattcgtgtgttcgtaaccatgtcattgcaataactgcaaaattagatcataccattttatacgcataggattatcttttgaataatttttgctactgtatttttatatggaaaaaaaatacctaatctacatatgggatccagccgtaagtttcaccttcttcctccaatcctccacccaatccggcgccgaagctttctttgtgctgcacgaccccgtcgccgtcaacgccactgcacatgagggagccatggccacatttgagcggcatccctggtgatgagcctgtctagaccatggcggcggcctctccatgctcttcgacaagctagcagtgtcgcagccggcatccaaactcatggcaccgctgctacttgactcctgggttcatccaaactcatggcacagtgctgccaagccgtccaccgtgtccatcgcccagacgtccttgttcgccacgtggactataccatcccgaggccccatccctccagtgccgttgcctccacatctcggcttcctctcgttgccgatccaacccaagccggggcaaagctgctacacggacagtcagtccttgcacagcagtggcgacgggaggctagggttgatgcgtggtaatacgggtcagcccaaagttcgtcctccaggaacacatcggcgccagcagtggcaatggcatggagtgcacccgtggagcccgcgaccatgggcggtggggagccactgcggatcgaagaggtccatctccagttcacactccctatttcgtccatcgagcatccgaaaggggatgagtcaaatctttaatatgcaagggtaattttgaccatatgaaaataaagtacaaacaaaataagtcaaaccgggcttgtgatgtacagcatggcatggaaccaaattttttgtgtagtcaggtaacatggttatgaatagatgaatagtaatgtcatttatctgtaggatcgtaaatggtctttcccaccccaaaagctagccattgaggtgaggggatcgtaaatggccttttccaccccaaaaactagccattgaggtgaggggctccacggaacaggcccacggtccatcaggtatacggttcccgcaggcacccacggtccatcaggcaacctagcctggctctgataccaattgtaagatcgtaaagggcctttatcaccctaaaagctagccattgaggtgagggactcccctacttataacttaggtcctttacccttccacaactaatatggaactattcaacattatcaaaaatgacactattgtaatagcatggatcaaattaacccttttagaaatcactacacctaccattttgataacgcattgaacatttacctgtttcaccattaaataacaagaaattaaaccgtgattgatagactgcaccaaactagctttatatataccaatcttatcatattacacaaaccaaataacctttacatgaaccagctagaagggagaaaaaaaatcgttggagtaggagacatcaggaaaacatggaagacgtaattgtcaatgtaagcatcatccatggaccatgaaaccttgtgaacctataaattgatgaaaagaacccagattgggtgatgtccgctcgaattagagccccaatttatatactctgcttctagtagttccttgcataagcgtgttcaacatgataatccatcttttgtatcggtttacaaatcataggcttttgttctggccgttatattgagttggatgagaagttcatcatgtgaatgtagtattcatcagagatctggtttactgaacattgataaatgttttgtcaagtactaagatgacatatcaaataatatctcaattgaatattgcccaaatcataagagaaccaccaccttttatttgcaaatttacagtggcccccaacttcacgatcaccgttctgagacgtcatatgagatttaaaccacatttaatttaatttttggggtgcataattaaaggatcgctatgtaggaaacaattttttttataggtaacacaaaactttagtcatgacctcatccacattaatagctcttagctttgtcatccatgacctcatccacacaaagcatcattatcatacatagaacacaatagcattgcgactaacagaaacattaaaaactgaaataacagtagagggttataccctgtgaaagtccctccgctggattatgaggcagaactgcctccgttggtgttgtcgatcagtgcaccagctcccggtgcactagcttcggctccaactcccggcgcgctatctccaggtgcggcagacatgggtgatgcaaacgaccggtcaaagacaaacagaggacgaggagcagtcgtgcggaagcactccccaaaaacctaatcacccacctacccggtgcagatctcaggcgaaggtgtggttccgaaggccctgctcgttccgatctcttgtgcgcgcaagcgatcagaaccggggaagcagcagcagcacaggcagcgcgaggaggaggaagaaccagtgtttggaaagcaatgcaggagatctgatcgaggttctctctttccttatagcgcaggagagaaatccgcccgttgccgtagtaacgacacgatcaatggatattgaatcgcctgcccgttacagaggcaatcatgtggttggattccgatccgttgcaaaaggatagagagagagagtgagtcgcaatgcacgcatgcccgccacgcccacggcctcggcccgacctagcgtgcacgcgcgcgcgtgtggctttccgatccccacctcaaccggtcaacagggagcctccaataactctctatttaagttgagatactcctcttttaattcccatggtggtattattatccttaacatttattatgggcccttgagatttaatagaaaaatcgggcctcgcctatttattctaacaatccccaccaaatttcatggctcataagaaatgttgtcaaagttgtgcctgtttgatataccagtgttttggtggagactgttaagttgaaattccacctaggaaatgaactacgtcagaccacaactgaacaatggactatgccttaaattgtcagtcttgtgtgattaggttttactcaaacccttgactggtactaggctgccgtttgcaccccctctgtttggagcatataagtcaaactccaggccctttcatgagtatctagagatcgcccaaatctcatatactatgactagcagtcgaactcatataggtgtgttccttctgagatgttcttcaggtcaacatctctgcttagaaaagccacttggatcacattaaggtataagccatcctaccatgcagagtagaagagaagtacatcatgaaaatgagcccttttcaagggtctcttctctcagccacacaatagtttgtttcgccatccaaatttacgggatctccgatcacaatggacaggtttccactattatgcaaccttaagtgggtatcaagcacatttccctcgatgcactgtctatcacattacgtggtagccccttggtaaactgatctgccagatttttagccgtctggacatagtccaatgctatcactccggagtttttctactttctgacagatttcagtcttcttttgatatgcctagatgacttcatgttgtcctttgaactgttcactttaataatcactgtttgattatcacagttcattaggatagctggcactggtttttcaaccaccggcaaatccatcaggagttcacgaagccactcggcctcaactgtcgcagtatctagtgctgtaagttctgcttccattgttgacctcgttaagatggtctacttgcaagacttccaggaaacagcgccacctccaagtgtgtacacatatccacttgtggcttctatctcatcagcatcagatatccagtttgagtcactatacccctccagtacttttgggtacccggtatagtgaattccatagctcatagtgccctttagatagcgcattactctttccagagcctgccaatgatcatctcccgtattttgagacaaaccgactcagcttgcttacagcaaatgagatgtcaggcctcgttgtactagccaagta

SEQ ID NO: 17954 - DNA, 2052 bp, Oryza sativa
cacaagccttgccttgtacttttcaattgtaccatcaggcctaagctttttcttgaaaacccatttgcatcctacaggcttgcacccatatggatgctcaacgacttcccaagtaccattagacataattgagtccatctcactgtgtactgcttccttccagtagtcagcgtcaggagatgaatatgcctcttctatggttcttggagtgtcatccacgaggtatataatgcagtcatccccaaaggattttgcaaccctttgtctcttactcctacgagtatctacaatgctatcctcctcacgatttccctcaggcgtttgatcattgtgttctatcggtgcaaagtgctcataggatatgacagtttcttgactagaagtgctaggtgtatttttcatgggaaattcattctcaaagaatgtagcatccctggactcaataattgtaccaacacgcatgttgggtactctagagtttactattaagaatctataacccacgctgtgaatagcataaccaaggaacacacaatcaacagtattcggtacaagtttacgctttttggctataggtacatttaccttagccaaacagccccatgttcgtaggtatgagagatttaatttcttcctttcccatttctcgaatggtgttacttccttatgcttcattggagttttattcaggacatgacacgcagtcaaaaccgcctcaccccaccattccttggaaagtccgtagtgtctaacatggcattcaccatctcagttagagtacggttctttctttcggctaccccatttgattggggtgaatagggaggcgtcctctcatgaataattccaaactcctcgcaaaaggatgtaaactcattggaaaaatactctccacccctattagacctcaaccgtttgattttcctttcaagttggttttctacctcagctttataggtcttaaagtaatgcaatgcttcatcttttgttttcaatagatacacataacaaaatctagtgcaaacatctatcagtgtcatgaaatatttctttccccctttagtcaacacgccgttcatttcgcacaaatcggaatgaacaagttctagaggtgccaaatccctcgcctcagatgccttgtgaggcttgcgaggttgtttcgattgaacacaagtatggcacgttcttcagctgcacggtctttcccaaagtaaacttcagatcgaccgtaccaacaccatgaacagccgtaagtgacccgtttcccatcaacaaggaggaacctctcccgacctgataagaagaaaacagggaaatatcagcacatacatgaatattagcaccagtatcaacccaccaatctggtgaatgaaaaatagagagaactgtaggtaaaattttaccgtaccccgatgttcctctgccctcgctagtgaccatgttggcagacttcctatctttgcgcttaggacagtccttggcccaatacccagacttgccacacacaaagcagtctccctttgcctttcccttgcctttcttcttaaaattggttgtagccatgggtttaacatcaggcttgaatttcttgttgttgtgggatgcatgagggttcttcttctgtaccatattggcactagaaccaccctcaacctttttgtccctgttgtcctttgccctcgcgttctcttcaacacccaaagagctaatgagatcagaaacactgaactcttgtctcttgtgctttagagaagtggcaaagtccgaccaagaagttggcaatttggcaataatgccacctaccacaaacttgtccggcaactcacaattgttgttctcaagttacttagccagcatatgaatctcaggagcttgttctactacagaacggtcatcgaccatcttgtagtcatagaactgctccatgacatacagctcactgccggcgtcggaaactccgaacttggcctcaagtgcatcccacatgtccttccctgaaggcatgtgcatatacacgtccactatattgtcagcaagtacactgatcaatgc

SEQ ID NO: 17955 - DNA, 1609 bp, Oryza sativa
ctgaaataacagtaaagggttataccctgtgaaagtccctccgcttggattgtgagacagaactgcctccgttggtgttgtcgatcggtgcaccagctcccggatccctaaaaacctgatcacccgcctacccagtgcagatctcaggcgaaggtgtagttccagaggccctgctcgttccaatctctcgtgcgcgcaagcgatcagaactggggaagcagtagcagcagcacaggcagcgtgaggaggaggaagaaccagtgtttggaaagcaatgcaggagatctgatcggggttctctctttccttatagcgcaggagagaaatccgcccgttgccgtagtaacgacgtgatcaatggatattgaatcgcttgcccgttacagcatcgcctcgccctcgccctcggcccgggcccggccggccggctcggcgcgagcgcgcgtgtggctttccaatccccacctcaaccggtcaacagtgagcctctaataactttctatttaagttgagatactccttaacatttattatgggcccttgagatttaaatcgggcctagcccatttattctaacaggtacatgtggcggctcatcgaatccaaggcgccacagacaccgccggccatccctatcaagccacctgcaccgcctgaacatggtgatgacctcatgctccagcagcagcatcagcaatagcagcaagccagcaacagagtgtcatgcaaatgtttgatcctcttcagatgctcccagggatgggttgaattcggtatctgttctgcagttatgctcattacttctctgtattagttgggttgttcctccgtgaatccaatgcttgttttatgtacctttgttcaatgttgggggagattggaagagagtagaactgaaaatgaggaattgggagaattatttaatgaaccaattagcttcatgctaatcatctcgtcaacttcttggtaatgttgggtcgttagttgggtatataatgttgggtcgtaagaagggcagcggggaggcattgccggcggtgggattcgggtggagcacaagaccaagagaaagggtgagaggatgagggaagagagaggtagaagatgagggcagttttgttcaatacatgtaaaatatgaattttagtggcaccattgagattataaacgagtaatagtagcatcattacaaatatttgaatagtaatggcatatttccaaactgggatattttcaatggcatggatctaattaacccttaattatattacttggattggaaaaagttttggtgaggactatgcattgctatagaacctagcatccttgtcagcccaactatggtagagtcatgcgatccgtcacaaaagcactaacctgtgaagggctgaaaagacccggttgaagattcggccttatgacctaacccaacactgatgatgatgcaagttatccgcctgtcaaagattactatatatgaccatcaccaataatctctaatctataacaactataacaatacaacccgttagagataaaaaaaacatacctctaacgggttattctctctacctgtcgctgatgaggccaaactcgtcatcgctgcatt

SEQ ID NO: 17956 - DNA, 748 bp, Oryza sativa
gtacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttattcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacct

SEQ ID NO: 17957 - DNA, 593 bp, Oryza sativa
atccacttgggtggaatctggcaaagtcgtgtgatttgtatgatcttcttgggtttcatccattgttccttgggtggatggtgtctattatgcttatctccacttgggctagttttccgagaaccgtatatgttcttgtaaatggtccacaagtgatatagtaggttgtatctgtgtaagtgctgatatgcattatttgcaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttgagtattctatagtg

SEQ ID NO: 17958 - DNA, 569 bp, Oryza sativa
attggggttgagttgaactcgacacaggtagctgcaggcaaaaatgccatgttcaggtttctgcagcataagaaatacttgattgtactagatgacatatggacgacagaaacttggcttgaattaagcgaagctttccccaaatctacgaatggaagcaaaatcttgctgaccactcgctccaaggaaattgcggtttctgctgacccatcttcccttccctatgagctagatccactgagtgaagaattgagctttcagctattcattaccaaagtttttgggttgaatcatgttgacacaacaagttgtccaccacagctcaaggatgtagggcaccaactttcaagaaatgcggagggttgcctcttgctcttgtggaattgggaggactattatctgggaaggaaaagcaattcgaagtttggaggaatatattgaagagcatgaagtggagcaactacgaagctgggaatcagtgcttggagatactggccttaagctacagctgcttgccttaacatatgaagctgtgtttcatgtaactaggtgctttcaaagaagaaact

SEQ ID NO: 17959 - DNA, 659 bp, Oryza sativa
ctctttggtactccctccgtcttaaaatatagcaatctagtactggattagacacaacctagtacacgaatctagacctccctatccaaattcatagtacttggtttctatattttgggatggagggagtacatttatagtgtaaatatgtctttgcttcaacaaagaaaattgcacggtacttaaagtaagtattgagttaaatggttggacaagaaacctctagtattactatggactttacaatatttgtaatgttctttgtggatcatagaggcacacctcttagatgatatcaggttatggttaactatggtgttagaagattatatattatggtggcctcttttatcgtttacttcactgttattatttttattccccatccacagtgtgtgtgcgtgggcctgtgtgtgtgtgtgtgctggactgtagatgcctggttatgccttgtgaatgaccctgtcctaacatcctctcattttggcagttgcaacttcttaaattttgctcgaaatcggcactgccttgaatgcaaagcagatggaccaaagaagatagaaacagctaccactgaaatgaaaacgggagactggatctgtccacagtaaccatcgaatgccatatttgttttcttggactgttcaacattattatat

SEQ ID NO: 17960 - DNA, 1307 bp, Oryza sativa
attgttctgttttggtactgataggagcagtcaaaagtttcttttctagctcattctgtaagctgagtctaattgattctttaagacatcgatcagatgaccattttaaaccagttgccttttacggttttgcattgattatacatttatactagtgaaagagccaagaggagaagtggagaacagggtagagaggcatataacccttgcctgaatccgaacaagtttgtgagttactgagttagatgttttttggaatattgctgaatagaatttgttttgccaataataatcgctctgccatcctcgcagactatccaacaatatttccatgactaggatattttgaagtgaactgtattttgagttaaaacattatatatttgccaatagttcacggatagaaattccgtagtggatcttggtagtgattggtctgcacagttgatagatctctgggtgcttgcagcagttaatcgccttactgtggagaaagcattagggccaacagattacctgctttgcacagattgaagataatgtgtagaattggtgccttggtatcccagtttgactaacatcagaatgccttctcatgataactgattacagtccctaaattgatatgcttttgaagtatctattttgaattgaagcttggcatggttagcttatatgaagcttcatatctcatttgcgtgccatttcaggatgtgtagcaatgagtcctcttttgttttcactccgttaggccccttgtcagaggactgtcttctcttccatgtttttgtgctaaacacaagcatgccattctaaatatcagtgtgcatgcttaatgtaatgttttgcaagtgaattgatttttcagtaagatggtgctccatgcagccttttttttttggcaggcagatttgtggctcatgtacagttattatgagatattgggaacagtggtttactttaaatgtcctgttgacctggcaaaaggtcgggacatccatgttctcaactctcaatcgaatgtgtttttgtttgcactatgtattattcatattttttatggttcctaactggtgtattttcctgtgtaagtactgttggtttccagtggtctcagcacaccatgcaatcgaccaaaggtcttgaacgacagttacaatttcaagcatgacatatgtactcagataagagaaccgctatgtgttcaaaaagataaaaagatgcaccatttgcagttttaatctgtttttcccccgtcctgtgacaacataaagaaacagatcaatcgagtatacgtttgagtggca

SEQ ID NO: 17961 - DNA, 490 bp, Oryza sativa
tttcctgtgttttcaaaatcctataggaatccaataagcatgacattctattcctacgttttttctatccctgtgttttctcaatcctgcgtttcaaaggggccctcactttcatgtggtaaccgtaagcccaattaccaatgaaatggggttaccacggatagcgggcgattgccagcatgccccagctcacgtcttccagaacgcgaggcgcgacggcgccacgcaaccgcgcagccgacgcctcggcggcggacggcgctcgctgcacggaagcaaggcacacccccctttacgctccgctcgctaactgcgtttttagccgctggtttatagtaagagatgtagaatatatgattagcaatatggcattgccgtctctccggacttggtgttggtgatgccagctaattggtgcttttcttcgtcctccatggacgcgctccgtgtgctttcggttaaagttcattctgaacataaaaaaatggac

SEQ ID NO: 17962 - DNA, 1074 bp, Oryza sativa
tttcttctccaaaattggcattgttcatcatgtgtcttgccctcacactcaccaacaaaatgggtctgctgagcgcaaatatagacatattgtagaagttggtctctccttattatctcatgccacaatgccattaaaattttgggatgaagcctttcaagcagcaacctatttgattaatagggttcctagcagagttatacaaaatatcagtcctttggaaaaattattccaacaaaaacctgattattcctctttgcgtatttttgggtgtgcttgttggcccaatttacgtccctataataagcacaagttggaattcatgtctaaacggtgtgttttccttggttttagcaatatgcacaaaggattcaaatgcctataaatttctttaggtcggatctatatttctcgggatgttgtttttgatgaaacggtattccctttctctgagcttcatgcaaatgcaggcgctcggcttcggtctgaaatactcttgtttccgtctttgtttactagtggggatgacaatgtattacaccatttgactaatcctataaatcctgctgctaatgagtttgctgatgcaaatattgagattgatacagcacattccgtggccacagaagatcccgcagggattgattttgatgcagattcggcagaacaggagcctgacaccttcctgtcgccagggtctgttcacacgcattcgcctggacctcaccattcaggcgctgacacgcggcagcatcaggagacacatgctggcgacagaattattcttccaggaacagctcgtcaggaggcacagggggagcagcggtcatctccctccgccgatctgtcctctgctgatccatcatcatcgctgtcaggtactgatgaatattactccctccgtccataataggtgacgtttttgactttttatttgcaacgtttgatcattcgttttatttgaacaattagtataaatataaaaaaagataagtcatatgtaaagtacttttgataatagagcaaatgacaaacaaaataaataataattccaaaattttttaaataagacga

SEQ ID NO: 17963 - DNA, 725 bp, Oryza sativa
tttcttggcattgaggtaaacaagacacacaatggcattgttcttactcaggataagtatgctactgatttactaaagaaggtagggatgttgaattgtaaacctgctaccactcctttatctgttagtgagaagttgtctttacatgagggatctctcttaggacctaatgatgcaacacagtatataagtatagttggtgcattacagtatttaactctcactaggccagatatagctttctctgttaataaggtgtgttagttccttcatgctcctacaacagtgcattggacagcagtaaaaagaatattgagatatataaaacagtgtactagtatggggcttaatatagacaggtctgggtccacacttgtgagtggattctcagatgcagattgggctggcagtgtagatgacagaaagtccactggaggttttgctgtgttcataggctcaaatctagtgtcatggaatgctagaaaacaagccactgtctcaaggtcaagtacagagtcagagtacaaagccatagcaaatgcaacagcagaaataatgtgggtacaaaccttattagcagagttggggatcaagagtcctcgagcagcaaagatttgatgtgataatcttggagccaaatacttgtcagcaaattcagtttttcatgctagaacaaagcatatagaggttgattatcactttgtcagagaacgggtgagtcagaa

SEQ ID NO: 17964 - DNA, 726 bp, Oryza sativa
tatgccacgtaggatagatacacaacgaatccatacctctcacagtgcagggtacgatccccaaaccaaccaccccaacctattctctctcccgctttcccctttctctccttttccctttccctctcctactttcactcccaccgacccgacagagccggagcgcgcggcggtacaggtcgtcgtcgcccacggcggcgcgtgccgtccccgcgaatctctcggtggcgacgagaaggcggagcgaggaggacggcggcggcgcggatctggagcggcggcggcgcgaggggacaacggcggctggcggattctggagtggagcggcgcgccgtcctcgtgctcatgctcgtggtcgtcgtccttggagtggtcatcggagtggtcatggcgggcggcggcggcgcgtcgtcctcggagcggtcatggcgggcggcggtcctcgtgctcgtcgtcgccgtcctcggagcggtcatggcgggcggcggcggcacatcctcgccccgctctctcaccgcctgccccaacgccaagcggcggcggcatcctcgggacctggcggcgcggatctggagcgtcctcgccgtcctcctcaacgacggcggcggtggtggcgcgtcctcgcccgccctcaccggtgacagtggcccggattggagctggagccggagtcgtcggagtggaaggagttcctgctcgggaatcaaggtcggccgggctgcagga

SEQ ID NO: 17965 - DNA, 1461 bp, Oryza sativa
gaatagctagcatgcgcagcgcaggaggcgccgcgcgagcgagtgtagcccgtactgccgtcgcttcgcggcgttgcgggttgcccccgcgtgcgtcatgatcacgtacagcctgctaacgactactgactagggtgtacttagttcacgtcaaaattaaaatttacattgaaattggaatgatgtgatgaaaaatttagaagtttatatgtgtaaaaaagttttgatgtgataaaaaagttaaaagtttaaagaaaaagtttgaaactaaacatggcctgcagagtgctcgcgagtgtcaatgtgtcatgtacaagtcaacgggggcgaggccgagtatacgggtcaaactaggcccatgtagaaagtttaaaccgtgagcggaagcaaaggaatagtttacttcgaatccctcaaattatagtttaaacctgattcatttctctaaccatcatactggatttcttgatgcttaactattaaggccatgtttctttcagctcagaattattataatccagattattgggagtaagctgaaagaaacagacaacttattaaagtagcttattataatctggagcccagcttattataatctgataagctcatttaggtgagctttttccagattattggatgaaaaattatccaccatgccaccccactccctctttagacttgcaaacctaataatctaggctctaataatctagaaaagaaacaactaaccacttattctactacagattataacaatctagcttatactaatctgactcaataatctagattataataatcccaagctgaaagaaacagggcctaaaacatgtataattggactcccgcatcagcagttttcactgacgtgacgtgttgacttggtccgcatgtgttgacgtggtagcccaatcacaaaatagaagttcggcccacatgtaagtgatgggaaaaataagaaaaaatgtagggcctacttgcagtgcccttctcctctctctatcctttttctccaaccactccacacctggcacagcttaggtccgacccgtggtggccatcgtcggacaacacagcgacaacaaggctggtgaacgccgtggtggccacctccatgccgccggatgtgttacactacttctgaagtctatcctatcctccacgtcaatcacatgcaaccacgtgcgatcatgatctgcagttagagatagagttcctattatctagttaatcttgttttgcatgcgatgtaatctcttccaggttgttaggtagctccctggtgatcgctcccaggttgttgggcaacttcctggcgcacatgtatagccacaatcggggctgttccgatctaattaacacgaacgctccgcacagcgtgagtgcgagagtttccatccaatagagaaaactcacatggtatcagagcgttgatccaatctaccgaaaaatcaatcc

SEQ ID NO: 17966 - DNA, 425 bp, Oryza sativa
caccatttaaaatcacaagaacgcagaaagatcttcacccaaaggagaaatactcatttaaattcctgacaaacaacattcagggatgtcgcatttttgcgtaccagtttcgttgagcctcacgatcagctgctccctgcttggaagagtgtacatcccagcaccaacagccttcctgaccgcccagctgtgaaacggcgcgcaaacctgcccgtaagctgtcgtagcagcatcatacagcgaacattccctgcagaaaagaaaaaaaatgaatgccagaaaggccgtaagctgtcgtccattagagcagaacagaactacctgtcaactgtgtcttatatgagttacggatgccaactggccaataattctaccaacttagccaccatcggctgaatctgaatgtatatgtagtactaacaatt

SEQ ID NO: 17967 - DNA, 666 bp, Oryza sativa
agggtgcccgaagaacgcgcgcgcgcgtggccaaggtggtgggattgggacgaggctggcaatggcgtacgcggcgacgcctatgtataggaggaggagaagaggaagccgggagaaatggagaatctctttgcccgtgtgggagacgaggaggaatggaacaacagggggtgagctggtcggcagatcggacgcttcctttatataggcatcagcgtcaagattcgtgctgggatataggagtacgtgccacgagcacgagtgcacgaggtggagtcagccacgaaatgggaacacacaaaagtcacggggtcggcaaattttacacaaaaatataaagtgcatgttcttacaaaagggaagcattgcctttcatatacttgtcactcgttactatccagtttttaacatttgggacatgttcactttaatgacattttcaaccttaccaagttttggtatagttgctaaaaagaatggctacatttaatttgctgccaaattttaataactatataagaaatcttgccaaaatttggcaagttaccaagtttttggcatcaaagtgaacaggccatttatcactcatcttctatgtagaagttttatagtactatatacttagattgagaaaaaaatatttcttaatgtgatatccaccgttct

SEQ ID NO: 17968 - DNA, 529 bp, Oryza sativa
tcgaaatggttaacagaactagtatatatgtagtgaaaatggcggtacaattaaaacatatgtggcaaagcaatagcaggtgatatttatagccacagatttggtaaaccggaataccatgaatgcaagtttatcagaggaaagagtgccttacattgttgatgatcagcagctaagctctccgtggtttccccatctatctcgcagctgaatccatcctcaatacaatcctgagagaggactaacgcagtaatttcttcgtcgatcatcttactaaccatatcacccaccttgtcatcatcatcagaggacaccgcggatttatcctcactggtgttagccatgttcttcagcaccacattgcgctgcttcgaagttacatgatccattgcatcattcccttcaccacgggattcatatgatactgcactctttctgacatttgacaaatcagctgatttaagaggcaccagctgcaggacattgccaacaatctcggcacattgagctgccaagccagccatggcgc

SEQ ID NO: 17969 - DNA, 2453 bp, Oryza sativa
cctcacccactaagcaaagtattaaactaattaaagcctagttcatgcacagaaccgaggcgataataaattgcaaggcatccatctcacgggcaaataacctgaggagatcgaagcgctctcggccgaacttgaggcatgcgttcttcaacctgttcaggtccttggatgggtaattgtcggccgaggccccagggtcctcccccgccgccgccgccgccgccgcggcggtcgcagccacctccccctccgcagcatcagcgcgagacgcgagggtgggctgctcgaagtaccccttggcccgaagcttctcgaggaaatcgccccactcgggccacggatgatctggtgctgcggcggcggcaggagcgtcggcgacatcccccgcggcggagcagaagcggagggagaggagtgggccggtggggaggcggcgggacggggcgggcaggagggaggagcggaggaaggaggaggtgagggtgagggctaggagcttggaggaggaggccatggcggctgggtgcgatggtgtcggggaatcaggtgagcagggatggaggcgggagcgaggaggggattagggtttaagggtttagaaatgtcgcggtctcgtttagcgtccgtaggaaactagcaatttatcatgtttttgcttcaattttcaagttgtaacaccgttttatacaagctaaatttctaaatgcaaaaacagtaaaaaggttttatcttcacaaacgggattttcatgtaatttaacacgagccaacaaattaaatttaatacacaactcttagcttctactccctccattctaaataatcatctacgtatttataagatagagtaatagatagaaaactaagtggtataatgtataagatatgaattatctctatatttatactaatattgtgtgcaagttattttagagagattatcttcatagttacaatgtgaaaagaaattatcaatattgtgtgcaaattatcttagagatttatctatatattatattatcaaaggaagaggaagccatggcagtattgtgtataaagtagactttgaaagcacaattgcgttagacatatcgaacaaccattaacttatatatgcattgatataattatactccttatatattcgatcaatcatgaattaagcaatagcttaactggttggttttttttatggtggaacctatccaaccaaattcaaatataaaaattacgatataaaataatccctctatttcatattaatatatatgtgtgtgttgatttattaccatatatacgaatgtgggcaaggctagaaagttttataatatgaaacggaggaggaagtaatacgtatgtaaaattcactattaatttggtttatataaacactaaaatcgtacatgcatacaaacaaatccaatatagtcggtctcacaattttatttgtcaacattaatagtgtgcatgtttaatcaatcaacattagtttaagtgaaaacattaatatttttagtctggttttcatattttcatgatatagcatagaatacatattgtgttattttaacctaagcatctatgtttattatctttttacatgattaaatgtttagagttcttttaagtttgcccccctcttctaaagctgcaatccactcgaaaagaaagtagagcaagctaaaatgctttcagaaaataaagatggaacaggattttacactgttccacaactttactccaaacctatcgagttaaacaataataagttaaaaacctgctaagaccctgtttgatttagtttaggattattatgagtaaactgaaacaaatagatagcttattatgatagattattacaatctataagccatactactataatctgataatccactttaaagatgattttttaaaaattattggatagctaacagctaacaaatagctactaattaagagacataaaggttatgcttattataatccagcttatagtgatatagctaaataatctagattacaataatattattaagatgctcttaatcgagctaaccagcctttaagtttggaacaaaaaatcaacctatgtgtaacccttcttttgcaaccgatacccggttagccgctaccaaaaacccgcccagcctccagccacacggcaccaccaccaccgtgtagccacaaaacgcccacacatcccaccgtgtaggtgcgctgcggtggcgttggcgttggcgttggccggtggggtgggtcagtccggtccacgcataagcctccaatccccaccaccaccaccaaccggcacacaaaccagagccagcgcccacgaattccggccgagccaaccatccccggatctgatccagccatccatgcctagctaggtctagccaagccaagccagccgtcccgtctccatcccaccacttccccccttccagtccg

SEQ ID NO: 17970 - DNA, 1034 bp, Oryza sativa
cccgcgggacctcaacgtcttctacgaccgcttctccgagtccatgccctcgccctacacccgctcccagctctccgagaagctccgccgcctcaagaacaagttccgcggcatgtccgcccgcgtcgcacggggcctcgaccccgcccgcctcgcgccgcacgaccgcgacgtgctccacctctgctcccgcctctgggacccgccaacgccgccacctcgcccttcgccgccgccggtgacgcctcctcggggaacaagcgccgccgcgccgccccgcgcgccgggccgctcatgcccccggatccctcaggggacagcaattcccatgattacaacggcggtattagcgccggtacgcccggcgcatttggggatgggcacggtggtgaggaaatgatgtatcttgagcaggaaagtgggcactttggttatcatggagatgtcgcgattgcggctgacggaagccttgatgggattgtgaaggtgcagcctgagactcttcctgccctccccagtatcggggacattgcggttcacagtgagaatggcaacggcaaggccgtggtgccacgtagcaatgagcatcacatggcaaatgccgtgctggatatatttgaggagtgcttgcgagaggtgaaggccaatggcattacctacggtgctaatgtgaatgggggcagtgaacttgcaaggcgatggagagcacagaggattgatgagcttgatgtgttgagccggaggctaaggttgcttgttgaggatgctgcaacggctggtcgctaaacggacatactggtggttttggtgacgtgcttccgcccttcaccccatgtgtataaaatattaaaatctagattattatgctatatgcttttgtagttcctcactcagcttgggccttgccttagtcagcctaatatgcctattatttatgcctatgtacatcgtctacggatattgccttttagtttaattatttcatcagcataatatatatggttccagcattgttatctatacagctgcctgct

SEQ ID NO: 17971 - DNA, 1531 bp, Oryza sativa
  unsure (1)..(1531): unsure at all n locations
acttaaccaaatagggatcttataacctaaaacttgtctaatctgttggcattactgtccctctggcgcaggagcagcaatacccacagtactctgttatgccacatacataataagattgttcactttcgaattttttttctgttttaatatttcttaactaatcgtactgaatgaaacacaaggatgagaaatttcatagcatggggccctggaggcctcgaccatggtcatctcatattcccggttacccctctctatattctctaattagaacaagtctaatttgcctcctcacagttgctagttgtctccctcatcctaaaattggatatgtctccccatcttcaaaaaccagtgcaagttgactgtggttgacttgctaagtcagcaggtgggggtccacatgttagggatcagaggaaggacttctctcctcctcttctttgctcttcttcctcgcgcgagtgtgaccagatgaagccagttgtagccgaatgaggatgtagcgatggcgggcggggtggatggtcaccacagggctggaaactatagttggccaactgggctgctcggcacggcacagcccaggcccggccgtgcctgagtcgaggctaatcgggccggcacggcctgaccgacacgccgggccgtgccgtgccagtccacgggctaaatagtgtgggcttctcaatttttttaaaaaacatagtgcgggccccacctgtaaggctntcctctctctctctccccctctaacctctcaatctctctctactctctcttcctaaatccccatcccctctctcttccctcccctgatgcagggagcggcggcgcctggtggacgacggtgtgcagccatgggcggtgagcggcagcccggtggaggcgagggaggagaaggaggagtcattgctgttatcgcgctgcgcggcttggacggaggcgaggttggagcggtggatcttggcgacgagcgccgtggaaggaacgaagaggaggcgacggcggctgcgcggcctcgttgacatcgtcatgggggaagttggtgcgcacgcgcgggccaaccaagaaatcaaacagccatggccaagaaaccgccatggcgaggaaaaaaccaagcaatcaccgttgctcgctgcagcagggagggaggggagagagaggggatggggatttaggaagagagagtagagagagattgagaggttagaggggaaagagagacgagagccttacaggtgaggcccacactattttttttaaaaaaattgctgactggactaccacgtaggactgaaaccatcccggattgagccagggggggttatttgtccggtttgcataattaagtgtgtaaaatatccgtattcgagtttggggggggggggggtaattcgatcgcccataatagttcgggggtaatttgtactttttccataaactattgatacacatgtatgttacaaagacgagcaaatgctactacctccgtcctaaaatataataagttttaggagtggatacg

SEQ ID NO: 17972 - DNA, 1358 bp, Oryza sativa
  unsure (1)..(1358): unsure at all n locations
tttactattcaacttactaaattttttagtaaatacgtagaaatataagaaatgcttaaagtacgtctaattaatattaatataattcacactaaaatcaattatatttatttttttaaaaaaaatatgaatgttaaacttagccaaaaatcaacaatgccatctactatcttcattctaaaatatatatgaatctagatccaaagaaaacattttataatattatgaatctgaaaaaaaaagacatagccagaattgtagtattagaatatatttcatccgattttagatttttatatctaagacgaaggtagtatggccgtgtttagttccccatccaaatttttttgatgtatgtgtacacacatttaaacatagactaataacaaaacaaattacagattccgcttgtaaactgcgagacaaatctattaagcctaattaatctatcattagcaaatgcttactgtagtgtcacattgccaaatcatggtgtaattaggctcaaaagattggtatcataatttacaagcaaactgtgcaattggtttttcgtctacacttaatgctccatgcatgtgtccaaacatttgatgtgacggaaaagttggaagtttgaagtgaactaaacacaacctatattcaaataagggttaattggatacatgccattaaaatttttatggttttgaaattaccactagtattcatgtatttggaaatatgccattataatttcacacatattcaaaagataccactacttaccccttggatgcatttccagataaaaatggaccaaactacccattatcccctcgactaactacttcccctaactccttcctcctctcttccttctcaggggcgacgcggcgcgtcaacggtagtagcggcagcaacgcagcacggtgcgtcggcggcggcgcggcggcacagcagcaacaacggcgcgacacggctcggcagcgacagcgagacgcggctcggcggcggcagcagcagcggcgcggcggtggagcaagctgcagcgcgcgcagcgggatggcggcggagcgagcggcgtantgagaagagagagacggtagaagatggggaagagagagagaggtagaagatgagggtatttttgtccaatacatgcaaaatgcgtatctcagtggcaccgctaagattagaaacaagtagcaatggcatcggtacaaatacgcaaatagtaatgtatatttcaaaaccggtaaaattttaatggcatggatctaatgaacccttaaaataaagccccctttcctcatcttattcctctactgaccaccctgatcgagccgttaccaagctccaccactgacgcatgctga

SEQ ID NO: 17973 - DNA, 1432 bp, Oryza sativa
gcactgacagtctaaccaagcaggactgtcccacaaagtcaaagcgaaccgacttgaccaactggctacgacgaggtctctaccaaaatggaaacgtaccagacaacatccgggagacagcgaggcgaccggcgtcgtacgtagtacaaattagtcgtcgtactcgtaccctcaattgccccaaccccgcaccgtcgtctcttcgttttcccatcgcagcggtgttttgctcgtcgtttttcctctcgatcggcccttgaccagcttgcgctcaactttcgtggtttattagtccaaaagttatgtccacttctcggtgccgccatgtgggtggttggtctaccaaagttcgggaaactattttgatcactcgatgggatatccctcatttgcttaaaaattatttaaatagttacttcctccattccaaaatactcccaccgtattaataaagatagtcgtttaggacaatgtttaagtcaaaccttggaaatataaatcatgaataactcttaaattgttgagtttgaaaatttaaaaattatatgaatagatttgtcttgaaaaatactttcataaaagtatacatatatcacttttcaataaatatttttatagaaataagaagtcaaagttgtattttagagaccgtgtcgctgtccaaaacgacttcctttatgagtacggagggagtaaaaggctcaaccactcttaatctaaagaccaagaaataattattatcatctcatagtttggatcactcatgcaaccaatagaattaaatatattgagtatggaggattcgaaagaaaatgctagttaatggcatgtattcatgtattccttaattatattatgaaacatttaaaaaaaatagttgcgccttatataatggaatggagggagtataaaaaattgtggaaaaatttaataacacttatacaacatatctatataaccccacaaaatattaagttcaaactcaactcatatatcgagatataaaaatatcagcatatgaatagtattatacggatcacatctgaatttttcactaaagccgagtatttaaacttaatttttattacctatcgattttactatatactttatattatcaattttttataattttttttaactatttgtatcgaatttgaaaggaaaaaaacacaggaatatctcttcgagggattaaaattcactcccactaagtcgtggtttcctcccagctgccaggctagctcgctagttgcactgtgtcgccggcgcgtcgcagatcctatcattcccaattcccacgcggtcgctgagctcagtttcacagttttcacacatatgtacaattgacagccacaagctctaattttggttaattaatcaatttcctatttatttcatggcatgtaggagtaagtgtgtgttcagtgat

SEQ ID NO: 17974 - DNA, 733 bp, Oryza sativa
cgccgaggggtgccaaggtgtacaagtcgggcagcgaccgcgtcaccctggcgcgcggcaccaactacttcatctgcagcttccccggccactgccaggccggcatgaagatcgccgtcaccgccgcctgatcggccggccggtcgccggagtccggcgggatcgaatgtagtagtggcaatctctaaatatccgggaagtagatccaataattctgtcagtgtcctacgttgctgaatgaccgtcttcgtgtttaggcctctgctttgttgcaggttagttgattgttggcaagtatagagaggaatatatgatttatgtgatgtgtattttgagaagaatttaataaaagccaaacagctgcgttctggcccagccgtatatatgtagtacaaggttctgaaaattgctttgtgtgaatgcgatggttcatgcatgtttgtaccatcctacattcgtctgtggcagttgagagaagaagttcagtgaactggtataactaattggtgcagaagctaataacagtcaaatgtttagtttcaacattgagaagctcgcactgccgtcttgaataacagcaattttattcacacaagaacaaacaatttctattttatagttatgctcgttctggctggaaagaattcagatttcatagctacaagttcagttcaggcatagtgtaacccaagtccattgactacttgcaaactatgccagacagggctgcagg

SEQ ID NO: 17975 - DNA, 1451 bp, Oryza sativa
gtccagcgatctagccagaacgttcgtgtcgcgagtcaccgacaagtctcagctccgtcatggcatgggctgttcagtgggttggctggatggtctgcctaactgggccaaggattttagaccgtggaaaggaaggaatctctttttgtctctctctctctcttttgactcacgccactgcgtccctcgtgttgtgtcgccccttgggagagagctgaggagaatcggatgtaacattttctgtagatgtccgtggatatatcatttgcctgattccgagtccgtatgagaaagttacgcctattttaagaaatgacacccgaatgacgcctaggcatgtcggataagttcactttaggtccctctatgtgtcacccagtctgattttcgtcccttgatcgcaaaaccgggtacaacaggtcccccaacttacgaaaccgtttaaataagttccctcggaagaatttgaccccggttttggctgaggtggcacctacgtggctaatttgactcggtcttcatctacgtgggcattgacgtgacgcttatgtggcaatttgatccgaaaaatattaaaaactaggggatccacatgacagtttcacacacaataattaaaaaaaatggtggggcccacgtggaccccacctgtcatcctcactaccctctctctctatatcctctctccttcctctctctctctctcctcttctccgccaccttcttctccgtcgcttcgccactatccgtgtcgccgccgccgaccacccagacaccctccgcgcaccgggacggcatcgccgagtgcctctacgccgcgctcgtcgtcctccagccgccgctccacaagctacctgccgcctctcaagtctcagctccgtcgccgcccctgtgcgccttccgtcgccactcaccattctcagggagagagaggggggatagagagaagaggaaggagagaggatagagagagagggatagagagaaggggatagcgagaactgcgccggagaagaaggtggcggcgggccgcggcagcgcccggggcggacccaacaaggaagtcttcctcctcgtcgtcgctggactgcacgaaagcgaggcgacgaggccgaatatggcgagcatctcggcaagcagcgccttgggcctccccatggcggcctacacgaatgccaccgccgcggtgctgttcgacgacgcggcgtccctctaccccactgcagcgtccgccgccgctgagacggcgtccccggcggcggcgaaggtggccgccacggccctctcgacggctgctctgatggcgcagaggaggaggcagctgaggtagcccgggagctggaccagcatgagcaggagcacgacagccatggcggcgcccttgaacaccaccgcggacgagtaggcgatcccggctcagccctgtgatgaacagcttcgccatggccatt

SEQ ID NO: 17976 - DNA, 894 bp, Oryza sativa
tcctgcagccctagcctatatggattaaaattctagacttgacagttgacgttagtacccgtatttatgactaattattctttcagtattaggcgaggtacctgtcaataacaatatgcccgtcatgtctgtgggtttataatgtgtttttttaaaaaaattaacagtggtttttatactactagtatgctggtacacggtcggtgcacttgtttagccgcgcataccacgtgacgcgatcggcgcacggttccctccccggtccgtaggccgcagccacccccacccctccaggtcaaagccgccggggcagccagccagagcccggccggtccaatggcgccttgccacgtgccccctccctccccaccggtccactgcgcccatcccacgcacccccctcttctcctcgcgcggactccccggtttgaccgcgcatcgccacgcgtcggctcaccattggccggggccgcgccaaggagaggccaggcgagcttcccgaggagccgcacccgtcgctttctaattttttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaagaggaggaaaggtgatctcttctctcccccctttttcttttttttttttgcttgtctcgctttttatttttttgctacctttacggttgctgggatttgggggagttggtggttggttggttggttggtggttgcgtgaatcccaggggtgaggagaaggaggtggagtactcgttcttgatc

SEQ ID NO: 17977 - DNA, 529 bp, Oryza sativa
tcctgcagcccgccgatcagctgtaggaatttggactggagtggatgggtacgacttatctgatggtgaaattttcctttttctaaagaagatgggtagcgtacatggtgatggtacaaaaaattacccaaaaaaattatgccttctgaaaaggatccttgaaaacctccatggaaatacgatggatgctgctgcttcatacctcggacaaccaaggggagaggagtagcatgctagcagccatggcagaaggtgcttttctttctagcctcgttgaccgtctaagcaccacagccttgtcggggatcacctcgttgtggggcgtgaaggagcaggtggattcactgattcacgagctccaggcagtggaatgcttcctcaaggatgccgacctgagggagatccgtcggcaagccacatccaacaacaactggttctggttacactccctcagagatgccgcctacgacgccgaggacctcatcgagagcgtggagctccatgaggggaggtatcacactctgaaccc

SEQ ID NO: 17978 - DNA, 903 bp, Oryza sativa
ttcagatatagttcaagcagtgacgagccatgagcaacttcataagctaaaactacaaggaagagtacatcgcaatctcctgctagaagatccacatttcagttgcatcaaaagcatcacattatctggctcgtggattgttttgagcccgatggaatcactaggctcactcacaactctttatgaactcaagctaaaggatgacgcgctccggtgctcagaggtctcatgtttacaaaacagtttccctgagctgcggtacctgaaaatcagtggactaaagaagcttagggtgttccatgtggggaatggctcatttccgaatctcacccgcttctccatccacgactgtacagaattccttagcacggttgaggttatggagcatgctacaagactgcaagttctgaaaattaaggaaatgccgtcagtcctgcctgatgttacagatttttgccacagcagaaacatcaaccttatcagctgatctggcatcaaagttatgtatagttgacaccattactgcaaacaccgtttatttttttatctcgttcctttttagtaaaattcagctcaggttcttctgagttctgatggcaagaaaaaagaaggcttagctgatctgatgacaagaaaccatacaacgttccaggagaacatgatccaaagccaggagtccagcacatgatagctgtttaatttctttgcttgagctcaatgtaacccaattgtacatggaaaaagagtaatgctagatatttggtgtaaactttgcaatattattgtctactaattattctctggagatagatgatgtcagtaaactgtagtagaattggtgatgagaagtgagagttgtacagttaagtgttgtggccacatgtttttcagggggctgcagga

SEQ ID NO: 17979 - DNA, 990 bp, Oryza sativa
agtagtagtacatacttatatgcattagtatgtctgacttataaaccatttgtatccgtttataagaagatgcagaatgtttttagactattaaacggttgcttagatctattgaggccaaattgtcatatgcacaactctcggcccaatctgagaaagcaactctagatttcaaacccaccaggaggcagcgaggcgagagggtgtcgatggcccaaaaagcgtcatcatgcagtcccattatcaggactctggttttcggttttctgagttgtgactggctgactgctctgaaagtcgaaacaaaaaccacacgctattgattgtctttgtcaaagtaacgattaaaatgtatgctgtttttacattcgaaaatattttcataaaggaaaattcatgtctaaaatacgtacttttgaaatatgaaaacgacatacattttgaaaaaaaaggctaaaatgacggaagtatatatttgatagaagatgtacgctccgtccgtctcataaaaacaaaactaatactgtaaatctaaataaaagtttgtgtcatactatagttttgtattagagatagagagagagcacttactatcaagaaccgtggcaattggcatggctcacctcccagtctcccagcagaattcccctcattttgtcgaggtgagttggacacacttgacgatagtctcaaactcccaatgctccaactaaagtattcagatcctgaccagtatccccaattaaaatgtttttatagtatagtaatattatatggcttgcatgtttgtaaggcaatgttaataatgagtgtgatgaaattgtttgtgcatattctcttcattctataaaaaccacttctaacacgtcaaacaagtacctttaaagatgtttttgccagtactttggtacgccatccgtgaataagtcttttttaagtttgttcgtttttagaaatacagatccgtatttaaatcggtgggctgcagga

SEQ ID NO: 17980 - DNA, 671 bp, Oryza sativa
gcccgtaggtgtagtacaccaaagaaaaatgtcaaagtgcgtgtttaattggtgatatgtcaagattgaggagtgggtgacaacgtggagtagctttgaagtggatcatacagtatactattcaacatggtacggatcgtgcaaatgtccccatctcttcattttataatctgtcaaagatcgcagctacttgttggcacgacgttgatgaaacttccaaagtttacatatttagtatttcattactcatttcaagaggtatatataaggtgtgtccagacttcagacttcagacttcagactgctcgagtcgttgctaaatcgctattaattatgggttgactcgtacgtcagtgggtaatgcagattgcaaccctgcaccaatcaccacagttatgatagtctagtctatcggtgtcctttgcattgagtagcaaagaaaggatcacttgaactgaagtttcatctgaatttgcaccaaatggcacacctatcactttgtcaaccatctcatatcttggtttctgatcgatcatagtggttctaacctggtcggattaattttttggcaaatgcttcaaggggctgaacttcttggcgatctttgggttgatcatctgcacggcttcgttcggcatcaacctggtcctgagggaatccatctgagctct

SEQ ID NO: 17981 - DNA, 671 bp, Oryza sativa
ccgtaccacggccgcctcgcagctctgctatggccacctgccatccccctccccctttgcctgacctcaaaacctaacacttgagagctcaaactattacgactaaaaaaaagtgagatttgaagggagagacatccctccaaatatttttttagaagaaaatgtgagtgcgtcgggattgaacacaagaccttagggttgaaaaccacacacctcttatcacccgcactattaaatgcatctaaaactactattccatctgtcccaaaaaaggtgaatctaagactggatgtggcatattctagtacaacgaatttggacagatgtatgttcagattcatcgtattaggaggtgtcacatccggtactaggtaggtttttttatgggacgaagagagtacgactgaagcatgaatcaaagaataaggggatgtttggttgatgcctaaccttgccataactaagtttaggcatggtggcacaaatgtggcttagaaatagttagccacaagtgtggcatacttagctctaaatttgagagcatgacatgtgggtcccaaagttaagaaagtgtggcataacacaattgcggcagcgaaccaaacacatgcctaaaaaactgtagcatgactaaagtgtggcgtggcaaagtgtggtaaccaaccaaacag

SEQ ID NO: 17982 - DNA, 1801 bp, Oryza sativa
tgctggataatcatgctcttgagatgggtttctagctagctgggaggtatgcaactcatttacatgtatattcaagtctgcatcggagttatcaccatgctcctgtattagaaatgaattaaaatgtaagtcaccatagaagagaaaattcaaaagcacgacgtgaccagtaaaaaaggaagcaagggagatctccctccttaacacaatgttcattgattatgatactacaaatttgttcgtaagcagttcaagctttatgtcaggaagcttggagcttctttcaggtaaacatttgctatcagcagcgcagtggagtctataataattcagacatgcctaaaattactttttttttttgcaaaccagtgaatattaaaagttgcatcaatgtggcaatagaagaacagaataggctgcggtgagacatacagtactttgaattcctgttacacaaaagttattcccttattcatagttcatacaggacgtgaattaacaatcatggcaagctagattagcttattgcttacaaattagtttagattaaattaacaattgtgtttaattttaactcaggacaaaaaaaagtgcatgccatctacccacaaagactgaggcatatgttactaataaaagttataagtaaaagacttcgttgataagtaacaaatgcagacatgttcttcacaaaagttaaattaaatttgattgttttagttcctatttcctagggtggtcttgcctgtgctctgacaaatgataacaaaacacaaatgaataggtgatcgagcatgccttcattgcttgttagttgcttccttaatataaactctacctccaaaattggtcgtcctatgactcgtattcctatcgctaacaacagcataccgccataccctacgcgctttgggtacgattaagttcagaacaaaacagagcaaaattcgcccaaattcacatgaaaattaagaacttccgaacaaaggatcaaggggtaaccaaaataacctataaccaacggcaacaaaatggatggggggcttggaacagaccggagcacgtagaacacttgcactgagcccgtcttaccgggattaggatttagccccctttctacacccacacccacggccgcggtggcctggtctagtatctcaccgacctcggccttgccctccgccggcgacgccgcagccggcgagaccctatggcggtggcgatggtggccgcgcttgtggcgcttcggggaggaggcgccgtcctccgcgtcgtcgtcgtcgtgcggcgagcggcggtgcttgcgcggggagaggtgcgagcgggcggcctcctcgctggccatggagacccgagggaaccagctaggcctagggtttggtacggaggaggaggggatcccgcgccgcggcgaggaagggtatgttggtttggagttggaagaaggaatcggatcgagcccgggaacgaattcccctcgtgatcaattcggccaccgttttgtaggaggaacggtcgattggagcagaccgttcgagttagacccggatgaggattgaggcggtgaggcctcccttcgagcttacagatttggggagatttcaaatagttcgattcgaaaaatgaaattgggaggttctttgataattgaaacgcagagatccttacgattattttatataaaaatagttcgaatcgtacaaaatccttcaaaaatttcacgttcaaacggacttcttagaaagcaagggaaccattggcttgggccattgtttcctttccggaataagttcactttggg

SEQ ID NO: 17983 - DNA, 1046 bp, Oryza sativa
gatcggttttttacttctttttttttttggttcctgtagggtgtttgtgcggagttgcagatggggcgaagggagggaggaagacgaaagggccggtgatcggcatcgacctcgggacgacctactcgtgcgtgggggtgtaccggaacggccacgtggacatcgtcgccaacgaccagggcaaccggatcacgccgtcgtgggtggcgttcaccgacgacgagcgcctcgtcggcgaggccgccaagaaccaggcggcgctcaacccggaccgcaccatcttcgacatcaagcgcctcatcggccgtaggtaaatgttcctcactagcttttcttcttcttcctgagctctctcgatgcaaatggagaagctagccgtggttgattgattgatttgggtggatttttccggcctgtcgccggcaggttcgacgacgaggaggtgcagcgagacgtgaagtatctcccgtacaaggtggtggacaagggcgggaagccgtacgtcgaggtgcgggtcaaggccggcgaggtgaaggtgttcagccccgaggagatcagcgccatgatcctcgccaagatgaaggagacagccgagtcctacctcggccagcgcgtcaccgacgccgtcgtcaccgtgcctggtttgtaatgcgaaagcttctggccgccgctccagaggttgacgacgacgacgacttatgctaagtgtgctctgcttgatttgcagcgtacttcaacgacgcgcagaggcaggcgaccaaggacgccggcacgatcgccgggctgaacgtgccgcggatcatcaacgagccgacggcggcggcgatcgcgtacggctcgacaggaagggggcgggggagatgacgaacgtgtggtgtacgacctcggcggcgggacgttcgacgtgagcgtgctgagcctcgaccacggcgtgttcgaggtgctcgccaccagcggcgacacgcacctcggcggcgaggacttcgaccgccgcgtcatggaccacttcatccgcctcgtcaagcggcagcacggcagggctgcag

SEQ ID NO: 17984 - DNA, 721 bp, Oryza sativa
gacctggaatacttgctacatgcgttcgcctcccgtctcctccattgccctcctaccgaatgccgatgcatgagtctccctgtcgttccccgccattgctcttctgctgccgcgcatcactcttgtttttgtcgctcaatccaaagaaataaataggaatacgaaccctcgtccccaaagcccgggtcctagactactacgatagaaagatttctacggatattcttcgtatcaattttataatgcttatcacctccttctgagctattcccacggtgccttcgggtcaaagcttaatccttaatagccaaccgatgcctggcaccaccgctaagcacaagggcaagaaaaagattggctttaaaagatccaaatacttcctgtgggtttataaaaaaccatatcatatcgaagaacttgatggtctttctccacccgttcgattacttcttaaaaggattagatatagaaaaaaagtagtctactcaggagaatgagataatgctcataatatcgctagtaaccaaccacaaaagtaaaccaccgtgcaaaggaaatatgggaaagagtgaagtaaggaaggaaaggagtcactgacatgtggactttatatgttaacttacgtggttggactaggtcaatgaaaaacaccttcaaaaccactgagggagtcattttgcattggttttaaaagtttggggatcaagatatccacggttac

SEQ ID NO: 17985 - DNA, 726 bp, Oryza sativa
tcctgcagccctgacatcttgatggtattgccaagcggccaggcatattggaccaagtctattagcactattttttttctcattctacagtagaatacactcgcagcttacgcaagaatcaaacacatacagcacagctcaaacaaaaattcagaaagcttaataacttgagagaagctaagtccaaagaaaatcttagctatcaaatagtacatactcaataaacagaaccatgtaggagttgtactacctccgtcccaaaaatataagggaaagctatgcatttacattgccaaaatcccttacattttgggacagaggttagtatcgtttttgtaagtgtagtcataacattatattatgattagcaacatttctatggtacaaacaggcatacaaaccaatgtcatggcatggcttattagatgaattagttaacagcattcaaatgggaataagaatgaaatccaaaatggtagtcaaagatgcccttctgcaacatgatgaaaagctaaaaactcatggtgttttacttgtggcaagcactaaaagtaaagcaattcatcagaatgtgataaacctggtcagaaataactggtgctaacaatggtattgattcctggttttataaactacctgaggggatcatcaaaaggccaatttatgcccttagcccctcacatatttcatatgataatgtatcggtgtaatctgacagttaaatat

SEQ ID NO: 17986 - DNA, 730 bp, Oryza sativa
cctgcagcccgctcggtgatgagattgcagtaggactcgagcatgaggaaggcgtcgagcgtgttctgctcgcggatgacctgctcggcccggagcagggcgcggccggggtggccgaggcggagcagctgctccacgtcgccgcgcgcctgcgcgcaccgcacctgcctgtgcccgcgcagcacgccgagccgcgtcaccgccagccccagcatcgacttgagcctcgccgtctgcttcgtcgtccgccccagcaacacgtccagcgtcctccccatcgccgccggcctctcccctctctcacacacaaaaacgagcaactgcctcctcttccacgctctcctgagacttcgagctcggtcttatgtaccccctcgtgtggcgcgggtgtgtgaaagtgtgaaaatggaagggaaaatgcgagggaacgaaggacccgaggcgaggggatgtcacggttgattagatcgggtttgctttgtggcgaaggcgtccgtccgatttcggtgtcgacgtcgacgtcgagcgcgacgtgtatttaaagccgttccgagtaagcaagacgcgtgcggggccactggggccaggcggcccccgctcgcgctcgtgagtcgtatgacccgtgcagctgcaggtgcagccgtcctcgcacagaactggttcacaatctcccatggaccacgtccccgcggctcgctcgcaccacgcggcctcccgcgcgcaggagatg

SEQ ID NO: 17987 - DNA, 441 bp, Oryza sativa
ggtcatgtggggttttggaggaggggggccgttacctcattgacgaagctgaggacgattcctgcaaaggagagaagaggatgaacaggggcgtcagggatcgtcagatgcaatcgatggaattgagcaggcgaaatcgatgcgagttttgttgcaaaatcgggggagctagaactcgagcccgtttcggttagaatggggagatggattgtacgagcggggcacgtaccttcgacgctatcagatttgggaggcatcgccgcctcgctgcgccgccgccgccgccgccgccggcgaagggcgaaaaggtttgggggagaaatgaaaaggagagggtctttgcgactcctttgctattgttgatgagagtcactgcacggtggggcctaccgaaatcggtgaccttggggttttcccgccaaaggacaacgctggtgcgct

SEQ ID NO: 17988 - DNA, 748 bp, Oryza sativa
gcatatctcatgaagcattcaaaaatgacaatgacattgaaattgaagtagagtttcctaaatagtttagaaaagtagaaatgagtgtgtagcggggacgtgcaatcagttgttcttttcttgactttaatcgatcgccagtgtgcataataacagtcgttcatactgaacaagacgtacttatctgctagtcctggcctcctggcatcgactcgaacaaggagcaaagttaataacaacctccaatttcggggcatacgtgatccgaatcaaaaacctacaggatgctgatgcataactcatcttctgtttgaagtgtctccgtacaaccaagatcatatcaccgatgaaattattcacacgactctaattaagattcgacttatgtattttagttttttttccggtgatgaaaagttgtcatttgaatgtgtaccagtaccaaatcagtcctctaaacattagcatatactccctccttcccaaaatataacaatttatccaccaatattctcttcccaaccaatcacaatcctccaccattcactttttccacctatcttcactactcattcaatcacaatcttccaccactcacttctacctattttttttaataattgggtataaccctaaaacttcttttatattcgggtaggaagggagtataagcaaatcatcgacgtacgtaacccagacaaacgatttatcccggtcactcaacagcccagtgtgtcatgagtcatga

SEQ ID NO: 17989 - DNA, 1541 bp, Oryza sativa
cgggggccgcgacgacgacaggagacggccgggaggcgcgcagttcgacagggcgacgaagagacgctcgccggcggcgaggtttcgggtgatggcaagaaatctggcaggatcagacgtgccagcctcggccggaactacagttcagagatcgaggattcagctgaggatgatgaagtggtccgccatgagatcactgcagagagcgaggtgaaaccgcggggtctgaccaggagcgtgccggtatcagtcagaacaaagagggtgagttagctgcaaccagatggcaacaagagtgatgggagatgatttcttgattcgtgatattagcagctgctattatatttttgcagattcatcgttcgttagatcctaggcctgtaggccattgcatgcatgtaattaaatggagcctaacaaaaaaaaaggaaaaaaaaacttgattcagattttgttcatcggttagtaggagggagcaaaagtcagcattgtagttgatggcaggtttcatcattgattgtagatatattagaggatggattgattttatattacaacaactgggaccaaaatattcctctaatctcgttacctctggggaaataaactaatgcagcgatactactaacttatatgcattaactagaaatttcaacagcagatatgaccgggtctggactacgagtattcatgaactgtaggcctgtagctggtaaaacttctctcatgtaacctacatttgatttgagaaactcccatgctggatgatcagcgggatactttccttcttttactgagactcgtcagcatgtcactgtaagactgcaagttaacaccgacatcttcatcatactcgagaccaagctcttcctgcacagatacatattattcattaaaatgatgaccgtgctggatgctagcaattggtaacttttcaatctttttttgcagggcagaaatgagaaaatctgacaactaaaaattatctttcctgttgtattaagagaagcatctagtgtgtattaactactaagtgcaggtaaatgtaaaagaaagaagtgcatcaaaaccttaaattccttctggtctttagggctattctcagtgatattatcccatagctccttgaacatcctctttcgctttctccactggttaactttctcagagaagctctcttcaataatcttcttgtcctcaggtttcaccaagataacaccattcctcaatttatttagtttctcttccatttcctggacctgcaaaaatacaagacagccattcttaaaagttaatacaaggaagacattgaaaccataaaagataaaaaaaatcgcatatatacataacggaacacgtttatgcacatacttctctttgcaatttagcttcctttgacttgatctctgctaaagtcaagtttgactgcagacctcgtacctctgcaatagggtttgtattagacatttccatactatgataatggcactcagcattgaaattaaccaccaataagatcatagcatgaaatggaacctacc

SEQ ID NO: 17990 - DNA, 876 bp, Oryza sativa
  unsure (1)..(876): unsure at all n locations
tcctgcagcccctcgacgtgacgttgtgacgctcggcatcgagaccgccggcggcgtgatgaccaagctgatcccccggaacacgaggatcccggtgaagaagtcgcaggtcttcacgacctacgaggatcaccagaccacggtctcgatcaaggtaagcacatttcagctcgtgcattgacctgataacattgattcttcagttcttgagactgacgaagctctgaatttctttttcaggttttcgagggcgagcggagcttgacgaaggactgccgcgagctggggcggttcgacctgtccgggattgcgnnnnnnnnnnnnnnnnnnnnnnnnnnnnnnnnnnnnnnnnnnnnnnnnnnnnnnnnnnnnnnnnnnnngacggccnnnnnnnnnnnnnnnnnnngacggcgtcggacaaggcggcggggcggtccaagtcgatcaccatcaccaacgacaagggccggctcagccaggaggagatcgaccggatggtgcgcgaggccgaggagttcgcggaggaggaccgccgcgtccgggagcgcgtcgacgcgcgcaaccgcctcgagaactacgtgtaccgcatgcggagcgccgtgcgggacggcggcatggccggcaagatcggcgacgacgacagggagaggatggagtccgccctgacggaggctctggagtggctggaggacaacgacggcggcgcacggacggcggagaaggaggactacgaggagaagctgaaggaggtggagcaggtgtgcggcccgatcatcaagcaggtctacaagaagagcggcgacgcgtcggccggcgccggagacgacgacgacgtgaatgagctgtagagcattttcgctgctccatgtatagtgt

SEQ ID NO: 17991 - DNA, 415 bp, Oryza sativa
gccgcgctcctccaggcgccgctgcgtgcgggacgagacgccgcctctgcgcgcgcgcgccacgtgcagcgcggcccggctgcccaccagcgggaggtcgagccgggtcgccgcggcggcggaagcgggaggggcgcggcggcggacggccgcgccgccgaacggcgtgggcgaggtgaggagagacatgagccggcgccggcgatgtgacgtggaggctcgagaggctggagctgctgctgcgagcaactcctcttcctactggctgtcgacgcttctcaggatctgtgagggctgggagtgagagggagatgagataagattttcattttttctttttctccttttgttttctagttccgcttctctatttttcggttttcatcgtttcagtcgtgtagcaggagcgctaaaa

SEQ ID NO: 17992 - DNA, 234 bp, Oryza sativa
gatatggagaggagaaactcaatgatagtatagataagagagataagagaggctttaggggtaaggaaatggatgcttgttggtctagagcagtaaatgggaacgaagggagtatcagctacacgcatgcaaactatggtatgtctggcatttacaaagatggatcaagctttggtggggatgatacaaaggccaaatgcaaaaggagatctgaagaagagaagaaagaacctt

SEQ ID NO: 17993 - DNA, 500 bp, Oryza sativa
agaaatcactaatctgtctgcaaaccattaagaaaccaagcattgaaaaagaggggatttgttttgagtttgactgcaaaagaaaacagtgtcgaagtcaagaaagatagtcaaataaggaacactgaacaagtatgtaactcacttatttcaggtgcccggtagaagcggctcacaagatacggtgtgatctcattatttccagcagacatagcactaccgaagtcacacagcttcagcaaattgttatctttatttacctacaaaatgacaaacatcaaaaaagctatgctaaataattcttctaccatatatacaaaagaaaagggggtgtaagtcatttttagccttttcctttctcggtcatcaagtacataaaactagtcataatttgtccaggaaaacaataagagtagactatgatactcagcaagattacatacccgtatattgtctggtttaatgtcacagtggagaacaccacagtgtcttagatgctt

SEQ ID NO: 17994 - DNA, 613 bp, Oryza sativa
cggtatgaaattcagcagtgggttttattcatgcttgttgtgcctaaatgatttgcatacttcaactgaaaggggctcagtcaacgaagcatgtatactctgtagtctctccagattttttttaaaaaatgtcgatttagaaaaaaaaaattgttttagacgagaacacggtatcctaaaaatgactctgaatatatgtagggctattaataaatatatatgattatactgaagtaattttcaagattaatctatacatattatcctatgtttttaaagtagatattatttatagacaatttttaaatgtttaatatagtttaaaagacaattattttcaaagtaatttcctactaattatcgaaagaatctggcaaatctccttctatacgaagtgcttccgcagccgctgtagtcacctgcagaatccaatgcaacatttcggcgacagcaacaaagcagtctcggtttctgtttcaattcttgcgaattcaagaactgcatcagttttcagtccgtgcggctcgtgtattgcgcgtatcgactactaccaactcccaaccagtaatgaattgcatcacccagttaccccatgagaccgaggatcaccggg

SEQ ID NO: 17995 - DNA, 988 bp, Oryza sativa
ggtgtgatgttcctttaaaaaagttctcttggttgccagatccttaagaaagaaataatcacggtgaagttcaagaaaagcagaattatcatcaactaaacggtgtacagatataagattccttttggcttgtggaacatatagaacatttttaagatggatatcacgattactaggggtatgaacaatagtattgccaatatgacttagatccatacctgcttcgctggcggtgtggatctgttctcccccattatacttgtcattcacagtgagtttctccagttctcctgtgatgtgatcagtggctctagtgttgatataccagttggtatcaacgccataggagcttgttgctactgcagcaatattcttactgtcaggaatataatccttgtcatacctgtaccagcaatctacggcggtgtgtcccctcttgaagcaaacttgacagatcggtctgcgatccgccccactttgcgcgcgtcctcgaccgcgcgctccattgcttgtgccgcggctaggaaaggcacgaccgccgcgtggagctcctccgccgcggccaggaaagctgccgcggccacctcctttgttggcgacgttgacggtgttttcttgagtcccccgatagagagacctgcgggcctcaaaattgaggacttgattgtagaggtcacccaccgtcatgggttctagccgtgcgcacacggcggagatcacttcgctttagtcttcgcccaacccagtgatgatgtactggattagttcctcatcgtcaaccgcttgccggatgcggtggccatctcatctcctagagctctcatcttcccgaagaactccgggagcgagagattgcctttcttggtgttggagagcgcgaatcttgtgttgatgcaacgcgccctcgtttgcgtcgagaacatttgctcgatgattgtccatgcttctgccgcagtttcacacgtcgcgacttgcatgagaacatttt

SEQ ID NO: 17996 - DNA, 10634 bp, Oryza sativa
  unsure (1)..(10634): unsure at all n locations
ttctgtttataaatgctcgctttatgcaaatgaaccactctagctctcctttgataattccctgcatcatacccctattccggtatgacttgctgagtacagtgggtagtactcagtcttgctctattttttttcccaaccccagagttcgggtatgtgtcagatggaggtttctccgaggagtaggcttcatccgtgccatcgagggtgcctgtggagtggtgttcccgctgcagttctagtcaaggcttagctcctgttgtcttcctttttccgctgcatttatgtaagacttttatgatgtttgtaagacgtggatctgaatgtcaacattatcgtttgtgtaccccggccggtcctggacggggattttaatgcacattctgcttggaattctattcgggaatttctgggcgtgacaaaaatgcacaaggttgtttgctaagaaagtagaaatgtagaaggtcgtggcaaatataacagtgatgtgttggcaaaggaatgtgatggttcccgaggaaagccgattgtggcaatatgttcatgataggcacttaagaggggggaaatgaaagttaggaggttttccaagggaaatggaagatggtggtggtggatttggcaatggtaggcattggctaaggggtaagacgatagtgctcaaggtgtgtgacagaagggaagtatgcccacagtggtggatctagatattgtggccacttgagtggtgaaaatggtaaggggggggtgtgtttgccacataagtggaagattgtggtggtggatctcaaatggtaggcattggagaaagggatgacaatggtgcatgaggtttgctagggaggggaaagcccgtggtggctgttgggaagggagaagacaacaacatgagagaggtttgccaataaagagaaagtcgacagtggcaaatcaagtggtggtagccaattgaatgaggaacgcaatggacgatcgcaggaggggagcaggtagggaagcacggtagtcagtgggtctttactcttgagagggtgtcggcaaaattaggccatgaatgttggtagtggtacatagattatgtatgagagggcgggcaagagacagagagggagcggagtccttaaggtttataaagggatggaagtactaggaccatattggattaagggagtaactatataacattttcgacaattatttgggtgaaaccttttcaaatataactataatataattgaagtgtaattatagataactaacatataactactaggtaaaaacacgtgtgtggcctaggctagaaggaccggtgttcacgaagcatgtcacaggcttgactctttgatcccacatgtgctagcgaatgttttttattctttacccgcacaaatctcgaggtaatccgacggtcagaaattcaaatgttttagagggaaaaactagccgatgtttttttagtaattctgttggatcaaatggttaaaaaaatatagggtacaatgcttagattataaaaacacatatgcgctatacatcatgatttatgtaaaaaaaaagagccactttacatgcacttcactaaaacaggaggcatgtagcaccatcgagatcctatttaggagagtttctagcggctgcaattttcactagaacctctaactccccaaaacagttgaggttcttacttggtttctaaaaatctatagctatagaatgtagaaaatatactgaaaatccgaagccgggaaaattagctactaatcagctacattttagcatttgaactttctaaacagatcccaaatcaaatttcaggtcgttaccccgttcgacagtgaaacaaaacggtcaatcccatcgcccttgcgaagctacgctgcctacgcacacaggttaaactgctgcagacgcaacgtggcctccattccccgccgacacgttcctctgcacccacccacgcggaccgttcggcctcgtcgaacagcagcacgtactacccgatttctcaagcgcgcacgcaccaaaatctatctatagattgcgtgcgcgcgcgcgtgggggcaaccccaattatcccccggtgtccggtgaggcggtgagtgctacctccttaatactctcctatctgcaagaaccaagtaatcctcctcgttgatgtttgactgtttgtacgtgagatgagtctcacgtggccatggtgttggtgcgtatatcatcccgagaagtatagcggcagcatccatcccatccagccgtccaaaaccttgctatctcttgcagccctcccgtcctctggcacagtatataaagcgtacctgcaggtgcagcacctgatacctgcaaagtgatcgatcgatcgaggccggcattgtgcgtgcgtgtgccaaaggatgacgaagtacaaaggtgtcaggcagaggcactggggctcctgggtcgccgagatccgccaccctctcctgtacgatcatcattcaatctccctttttctgccatgaactaacatgcatcatacggagatgtacgtgtactacgctgacgatgtgtgttctgactggtacatatgcatgtaccgtgtgtttgtacgacgtttgtgtgtgtgtgtgtgcaggaagacgaggatatggctggggacgtacgggacggcggaggacgcggcgagggcgtacgacgaggcggcgaggctgatgagcggcccagcggcgcgcaccaacttccctctcagcagcagcggcggcaacgcccgcagctgcctctccccgaccctgcgcgcgcggctggagaaatgctgcggcgcggggtcatcagcgcaggcgcaacagggcgccgtcgctggccaggacaacgacgatgctgctgcggcggcggcggcgatgggcgtcgacgacggcgacgagtacgtcgaggagatgatccaggagctcacgttctacggctccatagagatcgtccagccctgatctgcttaattagcaaaagcctagccggccaacaaccgcagtgtaacttaaaacttaaattactagagtatagacgtatagtatataaaaaaccttgtgctagctacttctgtgccgtctcgttaggcacattgcgttggcaattagtaggtgtcaatggaacaaggtaatggacgagcattgcagagtgtgcatgcagctagccaggacatctccctgggatcgcgatgtgtttgcaaacaggggaaggggaccaagaatctttcaggataaggcctcctgatttggttcatgatgtgaagttgggtcgggctctcgtcttctagcttctttggatagtactactagtagcactcctgtcttccttcagtcaccaggctacaatttctggtacggcgcccagagagatggatgatgagatgtgacgacgcgacgcaatgggatggatccgatgcatgcatatcttttgtgctagagccccggtacgtcgacgagccgtcgtttccactgtctgctccatttcgagatgtcaatgggggattgcaaaatgccatgaacggagttaaagagggaatggctaggcacaaaacgtagcggagcttttgagccatacaagtggccatgtacagaacaagatagcaaacgaacgcgacgggtgaggcctctctcctatcaacatggctcgcgtcagcggttagacacatctaaggagatgatttagtatgggcaaacagtgcccgtgatggcggtggtcgtgccccaggttcacgttttcaatgataaccgacagtagatttcaagttaattttcaaatggttttcaagaattcagattcgaaacagtaaatgtgacacaaagatttttatcaaaattcagcaaaaactgtcatgctgcctaaggttgggatccggcgctcgctcgaaaaggtgaaccatggtcgtgctgcctgaccttgaaccaacaaacattaacgttacaaaatgcaaaccgtagccgcagttcatttaccacacaatgaatagaatatccgtagtacgaaatactggttacatgtcgagaatcctcagcgtccagcgctgcatgatactgaagtagtacatctctagtcacctagatggctagccatttactgctacaacaatactacaaacaaaccatttgttcttccatctgcacaaactactcataagttttacactgagaagaaaaaaggaggcatctaccagtcctagtaatcacatccaaatcgtgaaacgtagtcagtatgacgcctacaataatacaacatgggtacaaagagtgggtgcacgataaaatccaccgatcaatgctaactctagttaacctaggtatcattatcataccacccatttgggccgttaatattagtggtatacaaacaattgtgggtgcagtagatgctcttctactttgctcttcctctcgtgcctcggaccacccttttccgtcctcgccgaacgtaggctggttttgggtctacctgcgcaggttcttctgaattcaatcgtgtgccattctccacagaatcaccatctgcggcatcagctttaggatcattaacctcgttattggtgggaggcacaccggtgctcgagttggtgcaactgggattatcattgcccgaagattctacccccgagttggcatttgattgatcccgaaggctgcagtagaggaaacagacgaatgccaaacatgtcagtccaaaacaacaacaacaaaaaaaaacttctgcacttgaaatataagtggcttgtgcacattatgttacccattggcagaagtttttttggtcgacccatttaagctcgcatggatgtggggacctgtatcctttgttctcaactctgaagaaagtttgaaaataaaccacgataagcatgcatagtaggtactacattcaacttagagagaaaaacatctaaactaagatcaagtcagaaacagaggaatcatatgcacaatttctgctttagcttaagtgatagaatcagataagacatttcaagccttcaactaacaaaaacaagaagagatgttacaaaattcattcatatttacagtagttctgagtgtttggtgttatatgacctgaaggattatacccttgggtcaatgctcaatagtttgtactgtcatccaaagcttcagaaaaagcatagctgtgctcttgtaagtcatttgggccggttgctggacctattcaggcaattttgtttttctaacctatgccacagtttaactcagatggaaatcttgaagaacaaaaccatttgtgcaatcgaaattgacgaagtactaaccacaaatagcacttttttctgcttttcttttatgcaaatcaaccataattgcagacaagcctgtttgattaggtaggatttctctctaattaggcaaaatccagtccttcccaaaccgttgtttactagttagctacaatatttgtcttccttattccttaaaaaggaagctgttagcttccgaccttaggtaggagcagtagtcatatgtcgcctacttgatagattgaccaaaatttaattgcatctcgtcgggccagcgtatgccggacgaattttattaagcttgggaaaagagttataagctacatgttgcaacgaaagccaaccaacatgatcccatgcaactggaccacacaggaacacactggcaaatgacagctacaggttacaaaccaggacgctacatcggcagctccttgctgccgcaaaagttaataaaatctgaaattatacccacaacatgtggtttataaaatgtagtgactgactaggaaatacagttgccattagtatccaacaccttggagttccaaaacctaataaaatcatgggttgtgatcattttcagggcataaaacaaattacacaatatcagcttggtctctataagttacaaaattattgcagtggagcagacgaacatgattcaaacaacaaaggagtaacaagagtaaaaggaacttctccaactacatcagatcatgcaacaacagagattttattggaagttcagagttaagaaaaatcaagctgattcaacaaaaagaataaaatgcataggcacacgagtgaaataacacacaaaccatggcaaaattaatgtcagaaaagggacaccacacaaacctgacgctgagtttatatctgactccatgtgaatttccggttctgcaacaggagctttaacatccccatcacggtcagcatcctttgtaacactgagacaagacagcaaatatcttctttgaggaaccggctatttgaagaaacatgtgttcaatgacaaaatgaacatacagaaaatatctccataggacccaaaaaaaacaagttcaatttcaaaaaaaaaaaaaagttcaggctacataagggttaagaatgaaacgcagcacatattgagagcaatttgtgctggtgatgtaatcacaaagcttacaactagatgttgcaagtgcagcaaatgttagtcattttcaatgcaaaagctgaccttgtggaagatatttggttcccctgtgatatctcctctgcaccataaacaacaacccatgtaaattagtccaggatatgcgtaaattttgatttaagtcatatacaaaaattatacaagtcaaatagctgacaatattttttatcatcaaagaacacaaacaaatagtgaaggaaaaggagagtctacctatatgaactttggatgcagcattgcattctttgacaacattccctatgtcatttgcagggtccacaggatcaacaaacaccttaagattgatgaaaaattgcaccggtaaataaagaaatgatacttgtgatatttaaaacatactatagagcaatattttgaactcatatttacaaacagataagaatgtccaataagataatgctatacatacttttttttttctttaccaaactcttacaaacgctgacatggcatgctatgagtatatctagttttcctattacttccatctagctaaatcaaacggttgagaactatgtttgtgagtttcgtaagaaccttttgtacgtatagcagcattctttccaatatatctaaattacttccatagatatttgaagttctacaaagttcaggtgagtaaatgacccatcatcgtgaagggcagccaaacaattttatatcacaaactggtgaaagtcaaagtaattttcgcaaaacatacaacagaagcaataagcaatatcaaacttagtcaaatgtataaatacaaaaactaccatgactcacatgatttttatcagtgataggtgaggagtgcccattagccggttctgctcctgcaaccttatcagaacctaaaatatatgaaataaattattttttcaaagccaaaaatttctaagaatgagaaatgatccataatattcatgtcaaggaaagttcaggtgagtaaattagtctcacctttattattttgctcaggtttgtcaactttcttatcagtacccgatgagaatatagatgtatcattctcaaacaatctggaagtagaaccatactgcctgactttagaagcatctggagaacttccagatgatcccaggcgagacctacgagattcctccaaattttcccaaaaattggaaagatattcttccttggtggtgaccttcaaaaggtaaagcatataattatgaagtgaaaatgcaattttagttgacataaccatgtaggtactaactaataaaagaaaagcctgcggcatgccaccccaaaaattcattaactttcagttaattttattccgttccgaaattttataaatatctgcagtatatatgatacatgaccagtagcattttctcaatacctcgtattctacagtagctcaagactccagaatatgaatcaagacagccaatgtagcaatatttacagtatttcctaaaaacctaaaagggatacagtatatccaaaaaaaactgaagttcatcaagctccgaaccaaatgacattatctgaaactaagcatcaatcaacatataataatcaaagacaatcatgcatcccacatttacatcaaggacctagaattaaattgccaatgctttttaacctttgcattacctttgatgaggggagagaatatttggacttcccttcataatcatacatatgtaacccagcagagggtggtgttttaaacttctggctacctaagaatggagattgccaaggaggcaatgactgcatgtatgattttgctaaatcaactggagaacccatgtcagattcaaacccctgcaaaaatgaaaactcataaaggtaagtcaacaaaggaaccaaatattgctgtgacaagcacataaagattgatggctataaagatgagaatgaaaacacattaatactaacagagttaagcatatcagtgtttaatgtgcaaggtccatggtcttcaggctttgaacctaatccctgccttttctcttctaaccatttctttgcttccataactgctgcgcttaatagctcgggcgatgcatggagaggagaaccaggagaaaagctaccagatccaatactagagaatggaactggttcagtgccatttctgtggcgactcaaggaacgccaagctcccgtgaaatcatttccaacaacagtattcctggttggaatttctttcggcgttccatactcaggtgcttcaggaagtgcagcatctgtaactcgtgactgtatgagctttaccattttatcacattcatccctataaaaataaacatgaataattgagaaggaaagtaataggttataaggattttatttagagtaaatttcagataactacaactattttgccaaaattatcagtttactgtaacatgcaatactcatgcaaccatgtgcacctttagctaggcatttcagagaactgcaactataataaaggattttatcagaaagctgcaactttatttgtccgacaagtttttggcccacctgtcacacccatgcaatattcatgctggtaagtcaggcccacatgtcatacacacataagggtgttgctgctttgtgataaagttgtttggtatgattgcggttttgtgatatagcagttaaagttgtagcaaagtgatagttctgacaaaataattgcagttctgtgaaatttactctgtttaagaaaacgtagaatatgtatggatctattcaacataaaattctcagtatctcggcagcacacaccacaggcagaattgcatgcttagtactttgaagtgcaattttcctcatcctactgctacagagtgtctatcttatccagttgcaataatatcatgactttgattccttctccaactcaaatttgaatagttttacccttttaattcatagtaccctatagaattcatagtacaaaaaatcaaaagaagagtagctccaacttaggccatatgcacctatgcttgtattatcagaactgttttgtaaatgagaaataaactagatttctttactgttaaatttaatcgttagcagttgtccagggaaaaaaatatacatctaagcacacatgtaaagaacaatagcattacagttaccttgagaatgtctccttcataaccatttcctcaatggcaagctttgactcattgtatgaaactattgctccatgattgtcttctgtttcatctgcacaggtattacaaatgaacgcactcataaaccatcccaaaaatagttcatctgaatgtgggcagcacaatgtagttgtgtgagcgaacagtttacgaaaggtaaaatggctcaacagaattggaaacactgttccttcatatgcaaaagtacaaaacactgattagtctgcagtgcatccctctaaaatggtctaaggtcaattaaaagtgctgtccaccattacaaagctaaagatcgagcaccttctcaaaccacaatagaactaacaggtcaataacaaatagctcaactattctacattctggaaatatctagcatatgtgacaaaagatggctcaattattttctgaattccaataatatgcaccatgtcatcctaactcgatgttcatgcaagtaactgtggttcccaaatgaggttgattctgaaaacaaccatgccagatctaaattaagccctctgcacctcgtatcataattttcaggacattataaaccttaggatggtggcagctaaccaaatacatgcctttaattttgtgttgatgaatcaatgatggtatcttcgcaagcataccaaatggaagtgtgatgctgctgaagcatcgattgatgaatacagcagccggagcactccacattgtaaacttcaaattctaattccacaacactaggactgtgtaattggagtcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17997 - DNA, 9000 bp, Oryza sativa
  unsure (1)..(9000): unsure at all n locations
gggcggccgaatctcccaactagtggatcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactttctcctagaaacgcatgcttgcgacgcggggaattagcgttgctttaaccgaagcaaaaaaaatattcctcatcgagaagcagcagcagcagcgtgtgaggtgtgagtgagcgagtgagagtttatacgtgtctcgctcgaagaatttggcgagatttggaggaaaaggatttgattgggttttgctttgctgttgcgttctgatgcgctaaccgctaaaggcgataaaaaaccttggcgtttcttcgacgcattttgtcggtgtacaagcctttttggtggtttccatgctgtacaatcgcaacctgctggtttcccatgtagcatatgctgtgaacatcagggatacacccccactgatcgcttgttgtatatgcagaattaacctgtattcagataaagaaatgtcttgcaaagtaattaactgatttcagataaggtgccggttgcctgaatttggctttggtgttggaaggacataaaggaaagccgaatggtacgtttgatttggattattgaacggactattaaagcggattatcgatttgatttagaaattttaagaaataaacatgatgaatagtttaaagtggtccaagtaatacagtagaaaatgttttttagaatgtatttttttcaagcatgaaattaatagttaaataatatgatgaacaagtaaaaaaaagtatcatatgcacataaatctttttgtgtgcacaccacctaacaaatttcactaaaaattctagaaaaaatatatatctataattttagtagtattacatatatgtataaagtttcatcttcaaaatcattatatttagtgagtaaaaaaaacaaaattcagatacatttatactcttaaaattgtcagaattatcatctttttattaacgttaaaatataataaatttgaggctaagtatttacacataggtgtagtactggaagtacataaataattgttttaaatttttgataaaatttattagttgatgtgtctgatgtgtacccgagaaagattctgtgagtaggattacaaataaagcatatatagctcttttccccctgtcttgtaaattagttatgtaagacgatttagcacactagctttgaccagcaagctgtgtgcagtcataggatcatcgattgttccaacatcggatgataataacagcgtgttacttccagtaatctatatactccatctggctaattaagacagatagatgggttttgatccagtgatgttagcggtgactgacgcgggcgcgccacgccgccgtcaggtgaccgatcgatcgattgctcgtacgtcgccgtcgtcatgatgcgccatgggtcaatcactgcctgccatcatggtgggcggccggcgccggcgacggcgacccgtagatctcgattgaccgattagccggacaattagtgcagtattcagatccataagcccatttagaattttcgcttatatttatacttatcagccaaaatttaaatttaaatttttaattttaaaataattttaatgttttttcatcataatttatttttcagcaaattttatttttcgtttgcgatacgccgtttgtcttattcctcgaataagccagataatggggctgtttgtagggggatgaacagtatttcgggcattggttccagcttaaagtgattatctaattactgcaattccttgtgcaatctgactgctgctcccggtatatggcagacgattattgcacggataacgctgaagttttttttttaagcaaaggataaagctgaagtagtcgagtgggctgttggcctagggccaatgggcatctggtcaggccaccagaagatgggaattgggccgatcctgaaacataatgggcctaggaggccataattactttttgggccacttaaatctcatcgtttggcccattcggacttcggagtgtactccgctgccgtgggcgggccgcagggaagcactgtgaacctgtttgtttgggagaaaagtccggagatggtgagaagtcgttgatgagcattccgctggtgaacgccaaaagctaagaaattccgattccaagctgctagttcaggttttttggattttgtagctagaaattcttaaaatatgaacggaaatctgattgagttcctccatgagatttatttggaattgtattttcaggtcaaaccaaagtcgcaacaaagttatcgatccagggcagctattttctgcaactttgaacttgccaaatttcaatacaaaaacggatgagatggaagaccagtactgaaacaagcttgaaatcaggtttacattcgataattaaccactactagcatctagcaaggaaatgaccaacgacgacaacgacggttcatcatcctcctgttctcaggcagttgggctgatctgatcatcatatcgagatgtcggtcagtcacttcttcctggacttgcgctcggcccgccgtcgcgcgcggcgctgccggccgccggcgtcgtcgagctccgagtacttctcgtcgagttcctcgaaagatttcttcatgcaaccaccgacgaaatcaattaatggtgagaaaaatgcatggttgaagatggggacgacgacgaggagagctagcagtatagcagacgtacgtctcggagctccatgaagctgacggcgtagaaggtcacggcggcggcggcgacgatggtgaggatcggaccggcgaactgcgcggctacaccttccatgagcgctagccgctaggttactggttctgatgagaaagaggctcaaaagctttttttctcagccaaccactactccagtagcctgtgtaaccctatccagaattcagatagctcactccgtcactcgtatcagcatttgtcgatcacacaaacaccctccgaaaaacagtatatttatatacgtgcccttaaaagcatcaagtgatatcatatatcagttgataacaccttaaaccaatcttatatatgtcattatactattcaactatttagagtcatgccattataattttttagatatacatgggaaatataccactacacaccctttgatgatgtactgatctgattgctgatgttatactgagatattttcttacaagtacaaattcatcatatggtagtttacaaacattgcaggccataatatgcagaacatgtatagtcgtggcggggggagagcaacgtcgtgggatgggaggtgaatgtgatcgtggtgacagtaagcgtcgaggccaatcgtgatcactgcagtaggagggaagaaacatatttctattggtagtttttatagggcctatacttttcagtttcagagaattaattatagctcatctcttggagagatgatattttcacatcttaaattttgtttaggattatctttactattataaaagtttaagatgtttttgccgaaactattttcgtacctcgtggtatccgattctgctcgctcatgcgccacgccccacgtcgcgttcgcatgcatccgagtccgtttcgcatgtgtttcctccggccgtgagctggttaattagtcgactgtatgatcgttccgttcgacgcaatgcgagaaggttttccgtgcgcagcaaaggccggccagtccggatcaagatgtactgttaattatctttgcacgtagatagattttgcatgcatgcaaatcacagctagactcatattttcctggagcaaataatgactggctagcaagatctcagggatcattgcgtagaggtcagaaggctatcccagcacgatagctggttgtggagaaaataacaaaacacgagatagattcaattttcaataggtgcaaatttgcagtaaaaaactagaaatataaaaagtgtcatccaaactatatatggtaacaattgcaaatcgtgaagataaaatttatcaaaaaaattaaattattttttaatttatttgaatttgatatggttctcgtgcaattaccattatcttaccttagtggtaacctaccatgtaataaagtaattcatttattagacgtataagttttagttaagcctatggtgggtgacagtcacataaaggtcgagtgaggacgcagatcgaggttgttcaagttagatcaaagctggtgatgctcgatcaaaggtcaattgaattaatttggatcaaggaacaagtgacattatagagctctacaccattaagtttttggatgtcattgcacgtgctccacatccacctactgttgtagtgttgagagatgtcctcctcggagggtgaaccctccagctatagtcggaacgactcaagatacaatgtccatttatgagtccttcatcctaccatactagattgcctagggtgaaatgacaataagaaaaacctaacatgtatcatctctctttttttttatctcgattaaaccaaaacatgtgccgctaaaaatattcacccggtgtaacgcacgggcattctttctagtggaaaaccaaattttggggatgaaactttaggattctgttggcgatgctcttagatgacatgcaagtaacgatggggcatccctcgaggatgaaaattcatatctcatatattcccaagcacaaaggtatgtttagaaattcaaaaggaactataatatttgaattgcatgcatttgtggtgatatgatacgcaccatgatatatactgtgttttcattaattcttgtatacagaactgtaaaaaggatatgcgtaagtccaattaaactatatatactcatcgagcgagcggtaggcatcatcgtgatggctggcgacagatgataggaaagatcgtctggatatagattgtgcacggccgtggtccctcgttccatgtcatgagcatacaaagcagctctgttgttcagcaaccagtaataatagatgcaattcggttttaggccagcttcctccgcatcgaacgacgctccaattctatcttgaccgatgaaaaacgaccttcgtccaccgagcgacttcaccttcatccatgtcgctgatcccttcgccgccatgtaatcaagcttatagacgctgacgcgcgcaacgatccggaggcatcggatcgggtatctaaaccaaacgcagtacagctccccgtccgattccacaaggttagtggagttggacgtgcacgccaccgagacgccctccgcggcgaccacggtgaccacgggctcctgcgacgacagctcgagcacggcgaggcggtgatcgacgaggtccacgaggagcttgctgccgtctaccgccgtgagccgccctatcgcgcggaggacgtcgtcgcggtgctcgtggtgaggcgtgccgggctggaggtactcgtgcctcgcccattgctggtcgtcttcttcttctggtggtggtggtggtggttcgtcggtgccgttgccacggccggcgggcgccggacggcaatgccagagcaccgtgtcttctaggtcgacgacgagcacgacgcagccggggtccgtggggcggcggcgcgacaggaggcaccggcgccgccagtggtctacggcgaggacggtgccgtcgtggtcgggcgacaggccgatcctggtgccggtgaaagggtcccacaggaaggtctccggagagccgcggcgcgccatgagcagccagccctgcggcgtggcccagattcggtggtctctgacgaacgcgctccccgggtgaaggcacggaagatgcagcatctcaccccgtggcaggctatacacggacatgccgtcgccatcgtcggcggcggcggcgtgtcccactcccagcagcagcagcggagcaagccggcgatccaatgcatcagatggcttgtggcctgcctccatgaattcgatctcaatttactcctcttcttggtgtttttttcctgatagagggtatggctggtgaaactgaagcaaaaactcatcaatatacatgtacgtattccatgatttatagtaacagagatttgtttccatgtcgtaagtaagaggtgtccggaggaaacacgaaaagaaagcagcataatacgcggcatgcaacacacgtataacagaaaagggaaacactaatcatctcttaagggaatatcccctcatttttcatgtagcttaaaaagtcatcaaattttttttaaaaaaatcaagatagatcaatatgtgatatatcacttcacaaatatgcatgttcaaattcaaattatacaattagaaaaaaaacaacaaatttgatattgaatataacacgtaattcgcagttaaatttattatttttgtttcgaattgtataagatgagatttaacttgcatgtttgccgaaagatatatcatatatttatttatcttaatattttttttaaaaaaattaatgcctttttaaatgatatgtacaaaatgagaggatatcccctcgagggataaaaatccatcgacatctccaaatgaaagagagagagagaagaattcctccctctcgatctccctcctcgaggcctcgaccaatcctgcacaccgcacgtgcgctggtgttgaacgatctagaaagcaaaagatggagccgacgagcttcctcgggttgtttttatttttgctgattcgcgttgattaggggaaacggaaataggagatcgagtggataaaaaacactcaaccaaattttggagattaagaaagattcgactggatttgatggggagggtcagctccgcattgtacaagcacgagactgttgttcggaggacgctacgaaaacgggtgggtctggcttgacagcttgcaggtaattttcagagcaatatattagctccggtagtgggcacaattacataaatgtaatgaagatggagagttcctgattgttgcatatcgtaggcttgaaacgacggttatgcaacttttttctaattatggatggagattcaccaatagaccggaataatgttctccttgtcctgttcggttttcttctattttggttttgtcacgccccgaatgtcacgcccggaaattcactagtaatttccgaacttatttgtgcataaaatcctcgtccaggaatcaaccgaggtacacaaattgacaatttaatatacagattcatcaaattaactaaaacgataaatacttacttaagaggcacttagtcctcaccaagaagaaaactgcagcggaaaataaaatctagcgaagctccggctccactcccacaggcagctcaactggggtataagccaaacgtcttctccttctgaattctttttcttcaactgaggttgatcgattattgcaagaatgagcatatgacatactcagcaagccacacagcaaatatgcaagtgcacaaagataccaaaggatggcataatataggttcatttgcaaaagcagcatttagcaaaacttttaagagaagtaaaaacagtggagtgattaatcagaaattttaatcaacactgaacagcacacccatgctgcacaggcccaaccatcctgaacaaccatacccggctgtacagatctaactccaaaccaggagctaagcaaattattaccaggtataacatccataattattgtgagaggtgtgggactaatcacgaaaaacattgttcaactcgcccataaccgcgggcacggctattcgaatagttttactctggccagaggtgtaccactgtacccacaagacacagccccacatcatgtcaccatgtgcctcagtaccaccacggtacctcggaaaggggctgtgacaataccccttgcacaacacaatccaccacagcgcacctttcctggatcataatcaccccctcaataaccagaggcatggactccccagcgacccccgtgggcttatctctgccacttctcagtctgatgctccgcaatgaaccatgctgtacaaaaggtaaagccattgcccacgctagcttgtggttggcacgattaatgtttcacaatagtagctcgcgaaccggtccttaattgtcatgagcacgactctcaaaaccatatgctcacaacccaccattatcaagttttagttggcaaataattaattaaccaatcacgattgaccatcgtgaagtatcattaagccatccttaaataataatgagtcataagttatcccaatagtgtgctaatgtttctaagcatggctaagcaattacatctaatatctagctgaaccaatatataaagctcaactagtcaagttataacaacccaaggtatccaggaataaagtaatcaatgcaaattggccataacaaaggaatagattctttattaacctgttaatcgataccagtcccaggaaacagtgctggtatcacagggagacagaatatcacagcaacagaagtctctttattatagagtagaagtacagtcatgttgggctgcgaacagatcccgagctcacaactgcattacaaaaggaaagcggaagccaggacttggaccaatcatcacaggcgtgacttgggaactaggccaaaaccctaaaactcatcgtagccggcttgctcctggaagaactcctcatcagccggatccgcttcatct

SEQ ID NO: 17998 - DNA, 57650 bp, Oryza sativa
ggcgagcggcagagcgaaccacggcgatacgggcgaaagcgagcacaccgggcggttgttcgtgatgaggggagacgagccaacggctcggattcgccggagggagcttgacggcggcgaatcgtggcggcggcaaccggtggcgggaaaaggggaaaacggcgacgaggtcacgaggggccaattcccggcggcgagagcatctacgcggccacgggaatccgatgctagcgtcggattgggcggagctacgccgagccaggtcggcgacgagcgggtgctacggagctcgagcggcgatggcggcgagcactcggcgagcgacggcaagggtcggggcggtgccggctagctacgggggggctactcgagctactaccgaaaactaaggggggagatggagcgaggaggaagaacggagagaggcactaccgtgcgggtcggggcgctgtgacgagaggccgacggcgcgggagtaatctctccggcctcgggccggggaagaggaagaagagggcgcggccgaagtccccttccgcgtcctcgaacgcaccggttctcccggcgctcggcgaaggacggcggaggcgagacagagcacgggggcggcggcaatggcacggaggcgaatggaagagggagggaaaggggaggctggggtttaaatgggcggcaatgtcggtttgggaaccgacttgcgcggtcaagggcgcgagctggcgctcggcggtcgcggccaaagcggcgacagggaagatgacgccggcgaggaggaaaaaggggaaaagagggggagaaaggggcttgcccctttgccgattcgggaaaaaggaggaggtgagcgggggcgacgcggcagagggaggagggaggctctgcctccgtcccttggaggctagcgcgggagtggcggggccgaggcggtgacgacggcgatgacggcggggcggtttggagcagagcggcgacactggcgacaggcgcgtgcagaggctgacgacggcggcgaccgggcggtcggccaccacggcacgtgcgcgcggcttgcaacgggaggcgcggcggatggagtggcgcggctcgggcacgcgcgctggctcgcggggccacgcggttgcgcggctgcaggcggcagggcagcgggaccgggtggcgcagacgcgacgcgacacgggcggcaaccacgcgggcgcgcgcgcgaacgagcgcggggagcggcagcgagggagcggagagggaagattcggctcggcgcgggcggctcacgcgcacgcacgcgggcagagcggagaggcgcagggcgcggctctcgcgcttgcgcgcggcgcgcgagggaggggcactcggcgcggcgacgcgcgctcgcgcgcgcggcgcggggcggagcggagggagagagggagcgcgccgggggagagagagcgagagagagagagagagagagagagagagagagagagcgccggggagaggacagggccgggggagaggagaagatgggccgagagaatttcggcccatcaaccacgggggaggcaaaatagacttttgcggaggaatttgatttggagggatttggattcggaattgaactcgacgatagatcggggattgagatcttgagatggcacagacactagacaacaagcaaagaaacaaatttcgcaattagggtttttaggagataattttcccgctaggcgccacgacggaacgggcgctacagaccaacccccctaacaagaatctcgaccccgagattcagcacctaagggagcagctccggaaactcggcgcggagaagatcttctcgctcccaggttgcctcatcttcagaatgattgctccattggactttgtagaacttgatggtcttccttcgagtctgacgttctgcctcttcaagaaccttgatcggtctttccttgtaggtcagattcttttccagtacgatattacccaggggaacttgctcttctggaactcgaagacatttctttagctgggatacgtggaacacgttgtgcacatctgcgagaccttcaggtagctcaagctgataagccacttcgccacgtctggcggttatgaggtaggggccgatgtagcggggtgctaacttgccggacatcccaaacctcttcataccacggaggggtgatacccgcaggtacacatgatctcctttttcgaactcaaggtcacgtctccgattgtcagccaaatttttctgacggttctgcgctgtctttaaacgttctcggattagcttaacttgttcttctgctgtcttgagtatgtcaggaccgaatactagtgcttcgcccgcctcattccagcacaagggagtgcggcactttcttccgaacatagcctcattcggcgacatctgaatgctggcctgataactgttgttgtatgagaactcagcatacggcaaacaacgatcccaagtgccttcgaaatccagggcacacgcacgtagcatgtcttctaggatttggtttaccctttctgtctgaccatcggtctgcggatggtaggccgtactaaaatttagatcggttccgagagcttcatgcaactgcttccagaaccttgaggtgaactgagtgcctcggtctgacacaatcttcttgggacagccaaatctacatacgacatgggtcatgtagagttctgctagtttctttccatcataggtggttttcactggcacgaaatgagccgatttcgtgagtcggtccacgattacccagatggagtcgtacccgctaggggttcttggcaacccggtgatgaaatccattccgatttcttcccatttccactcgggaattggtaggggctgtagcataccagctggcctctggtgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaattccttcctggccggtacacagatgcgtggaccgcatcaaactgtgccttggtcgtccatggagaaattggtgtctttcttctcctgtattctttttattaactcttgtatcccttcgtcgtctttctgagcctcccggatttgcgactctagggtaggctatactgtcaagctggcagggacacctgactgtaccatggtcagcctcaacttctccaattctctgcacaggcgatcttggtcaggccgtatttgagctacattgcaataggccttgcgacttagcgcatcagcgaccacattagctttaccgggatgataatggattccaagatcgtaatcttcgattagttccaaccatcttctctgtctcatatttaactcggtctgtgtgaagatatacttaagacttttgtggtcggtgtatacttcgcatctgttcccgattaaatagtgcctccagatcttaagagcatgaaccacggctgccaactcgagatcatgggtgggataattgacttcatgaggcctgagctgcctggatgcataggccacaacctttcgttcttgcattaagacacatcctacgccttgtcttgatgcatcacagaagatctcgaaatcttttcggatatctggcaaggtgagaactggggcagtggtcaaccttttcttcatttcttgaaagctgtgttcacaggctgcagaccattgaaatttcttgcccttctttaacagctcggacataggtctggctagcttagagaatccttcaatgaatcttcgataatatccagctaagccaaggaagctgcggatctctgacacattcttgggcgggttccaagcaagtacagcttcaaccttgctgggatctacttcgacaccattggaggagatcacgtgtccgagaaatgctactcggtctaaccagaatttgcatttcgagaatttagcgaatagttgatgatctctgagcttttccattatcagccgcaggtgttcagcatgttcttcctcattcttggagtatatcaggatgtcatcgatgaacaccacgacaaactggtccaggtattccataaagattttgttcattaagttcatgaagaacgctggagcattagtgagtccgaaggacattactgtgaactcgtatagaccataacgcgttgagaaagcggtcttcggaatatcttcagatctgattttaaattggtggtaacctgatcttaagtcaatttttgagaaaactcttgctcctttaagttgatcgaacaaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctctaattcttcgatttgtcttttaacttctgctaactcattagctgccattcggtagggcctttttgcaattggtgcggtgcttggcgctagttctatggcgaactcaatctctcggtctggtggcatacttgttaatttttctgggaatacgtcgggatattcacagactatgggcaccgactccaaggaggtgacttgtaaacaggttaggatagaccgacttgcggtaggggtgttagaggtaaagcggacttgctttcctccaggtccttgcaaggtgatggtcttttcggcacaatctatctgtcctttgtgcttagccaaccaatccatccctaggatgatgtccaagctttgcgagtctaggactatcggtttggctaggaagtcaacttcctcaattctaaggttaacttccgggcatacttgagttgcccttatattcctcccaggggaatgtactatcattggtacacgtaaattttgggttttccaaccatttcttttcacaaaagcttgtgatatgaaagaatgggaagctcccgaatcaaacagaactattgcgggtatggagttgacagagaacatacccatcacaacgtctggagcatcctgagcggtctcagcttgaatgtggttcacccggcctcgaccaaagttgttggatgcacgagaaccttgtccacttgcctgagagctaggacgagactgagctgccgctggagtaggagttctggcagtgctgccattagcatgacctaagctggtgttggtaggattctgagggcactgtctggcatagtgacccatctggttgcaccggaaacactgaactgctgacggtccctgtggtgacttgaaagaggtaacactgtttggcgcagtattgccactaggggcacgctgctgtggctgaggtgccggacggttcatctgaggacgaggggcgtagcctggctggcggttagcctgagtgaccgactggtggtattgcatgggttgaccgtagcgagggcaaggtgcgcctcgggaagaatttccctgatggttagacttgcgtttcttgtattcttcggtagcctcttttctggcatcctcaagtagaagcgccttgttgatcatatgttgaaaagtggggaaatcatgagcaagcaactggagtctcattccaactgcgattcctttcaagaatttcctgatcttcttcttgtctgtgcccacttcctcaggggcgtaccgagccaacttgttgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgcagcaggtcctcttagctggtgagaggcgtagagcgtcttctcgaccggagtacactgcactaagttgagttttctatcaacatctttcagccaatcgtcagcctcaacgggctcgacggtctgagagaactctggcggacgtgacctcagaaaatctgtcagcttggatctattgttgctcatgtgagggtggccatttccatgcgcattatgctgaaaaccggctacggctgcggctaatccttgcaagatttgtgtctgaactgccattaagtgttgcatgttgttttccacatgaggtggggaagggaggcgttcttctccagaattgtgactggcagtgcggtgagagcggtgagactgttccatctctgcattacgggaaactgtgcgatgcgagcggctgctgcggcggggttgctcaacttctgcgttgcgggaagcagtacggtgcgaacggttgctgtggtgagactgctcattagctgactcatgattttcttctggctcaactctaccattttcaaaaccaaagcgggctggtgcacgagctgcacggcggggacggctagccatctaaactcccagaagagggcggggtaagagtcagatagcacttaggagggcaaggagcaaagtaattagcaactcagatagcacacactaggcataaactggatttttcaaatcataaagacacctgatacaacgggtgtggacaagtcacagagctacgccgagcttgactgcgcgcacaccacctaggagaaccagactaccaaacaacacccacaacaaacacacgcacgcactacctcgccacgactccaaaagagttggcggtggaacaaaagggcctaacacacggacggctgctgaagactgcctcctctactcctcgtcggcctggctgccccctgtggtcggctcctcagtcgaagaaacgtcgatcggctgacgcgaagggaccggcggaacctgtcgagggccggcagcagcacgggccgctggcggtgggggagctgggtagtgaaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaagagacagtgtcaactgaagtgacaccctcctcggccagacgggcctccagggcggcgtagcggcgggcaagggagcggtaagcctccaggagtaggtcgtgctgagtggcctgagcctccgaaagctcaaccatgcgagtcagcactggctgagactcgctgtacggacaagggtacctggcgtctgagtggccagaaggaaggcgtggaagctgccggaaggcggagcccccgagacggtggctgtagtcgtgggccaggcgacgaagcgcagtccaggagaggtcctggtacgcgatctggagagtgggcctggccacggtgaagtggtgtggacgaaggccagctccgtgtatacctccacgggggtaaaggtacacagagagctcacagtgagggggaacacggtccacggagtaccccgtgtactcgggacacgagaagccaaggaaacgggcgaggtcacgaagctgagcgacgtggtgaccctcaccaaaaccgtgggagctgaagctggcgttcactgccatctacaattttgaaaaagggagaaaggatcagtaaccatttttagaaacaaactattgaaaataaagaaaacaaaagaaaccttagcttttcgcaagtagttttgaacttagtatccttagggtcgtcctaggcgtcgggtttcgtcctagggccaagcttgtgctctgataccatctcttgtcacgccccgaactagtaccgaccggaactagcccgtgacgctccaaattaacctgttaatcgataccagtcccaggaaatagtgctggtatcacagggagacagaatatcacagcaacagaagtctctttattatagagtagaagtacagtcatgttgggctgcggacagatcccgagctcacaactgcattacaaaaggaaagcggaagccaggacttggaccaatcattacaggcgcgacttgggaactaggccgaaaccctaaaactcatcgtagccggcttgctcctggaagaactcctcatcagccggatccgcttcatcttcttcagcaactgggggggattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtgcaaatgtatcagtctttagaattgaaacaaggttggcacccggccaacagcttttcaaacggccacccgggccaacaacttttcaaacggccacccgggcctagctgatcccatcagctgctgaatctttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacagcaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacccaggtgtcgggttttccaagtctcttgtaaaacccaagttttacccaagttgtttttcagattttaagtttgaaggcgtccgtcgatactcgcactgggtgcacgaatatcgagacgcaactggatggttacaaggggacatggtataacaattatcaaaggaaggatcaaatgcaacaaactaggtaggtccgccaatctgccttgcagacgggacaacagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccggaactacacgcgaaacgggacaactcaacaaacggcgaaaataaagccctattactgacctctaagcgtgccattaggtagatctcgagatttggggagttttggaagttgaacggagtcaaacggatttacggtggggaagatattgaatttctaagattattggatttttggtctaaaggaaaatgatttaattaaatcctttttggaagagataaagagaagaaaaagggagagggagggaatataaacttccctcgggcggctagggcgcggcccgagagaaaggacagctcggccgagcttaacgggccggccggcccaagaaggcggcccagagcggcccaagacgcgcgcgcgcggaggaaggagagagagtccggtggaccgggctcaccacgcgcggtcccgggtgggacccgcttgtcagcggctcggctcaccgtgcggcgggagcacgcggcgcggcgctagggtggaggatggacgtggtgcacgcacgcggttcgcggtggacgcaggtgcggcgggcccacgcgcaacctcacggctcgcggtggaacgcgcgcacggggagggactgaccggggtcggcccgtcccgacctcggctgagctggcgccgacgtggcgcctacgtggctgccacgtgggctggcgggaggtagacgacgacccagccgcgaatggacggcgtgcggcggcggcgagcggcagagcgaaccacggcgatacgggcgaaagcgagcacaccgggcggttgtttgtgatgaggggagggagagagggagagagggagcgcgccgggggagagagagcgagagagagagagagagagagcgcgccggggagaggagagggccgggggagaggagaagatgggccgagagaatttcggcccatcaaccccgggggaggcaaaatagacttttgcggaggaatttgatttggagggatttggattcggaattgaactcgacgatagatcggggattgagatcttgagatggcacggacactagacaacaagcaaagaaacaaatttcgcaattagggtttttaggagataattttcccgctaggcgccacgacggaacgggcgctacaggtttggtgtgtttcgctttattttagactacactcttttagagtgcttcttttagagtgctagattgtaataattggctgtagctcttttgagcaaatgtcaggatgtttcattccattatcttaaaaaaaatagcgtggtatcactggaaaaaaatacctttacctattgcaatgcacggatatttttttttgtaacatcatatatagaagtcgcatgaaaaaaactggaaatagctagctgtttaagtcttgtgtattgaacatgtctttgagtagtaaatctgtatgggacaccagctgctcgcggacagggtgcgaacacgagatgacttaatttgggtggcacgttagcaccaaatcgatacatatgtaattttgggacttacattgtaaatacactaaaattacatatataatttagggacttacaatgtaaatatatgccgactattttttgatgaaaaatatgacgccataaatatagctacacccatcaccatgtgcatcagacgaatcaaaaacgggaaatacgtatacgatgggacgggagctagcgtatgcacgatcgatgtggatgagtggatcacgttcatgactcatgaccaagagtccgaagaaaacacgaaaagaaagcagcataataatacgcggcatgcaacacatatataacagagagaaaaaaaacagagagagagagctctctccctcgaattctcgaccgatcctgcacgccgtaaagtgcgctggtgttgaacgatcgatcgagaaagcaaaagatggaggcggatgcgacgacggcggcgcagggacgacgacgggacgatcgctggtcgtccctcccgttcgacatgctcgtgctcgtcgtcgaccggctcggctggtccaaccacccgagcttcgccctgacgtgccgccactggcgctccgccgtgtcgccgttctacccggcgtggatcaccccgctcctcctcagctccgccgacgtcggcgtcgccaacgccagctactacagcccgtacttccacaggagcttcgaggtcgacggctgcacgctcaacgtgccgcccgaagccaatctctgctgctccaacggacgacgcctcacgctgtgcctgcctaagctggtcctgcaaaccgatctcgtcaccggcgccgtcgacgagctaccggagatgccgttctactggttcaacttcatcgtctacgacgacgccgaccggaggatgtactgcgtcaacacgatcttcgtggtgcggctcgcccgcgcgattcaagacgaggacggcgagtgggggccatgggacctgacggagttcaacgtcgaggaaggagcacagcttcaggcctcgccgatcagcaacccggtgctccatggtggcctgctgtacgttcttggtgaagacgggaagctggcggtgtatgatccgtgcaaccacgatgataatttcaaggttgttgataagcttaagggatttgggattgagcatgatcgcgttgacagctacctgttcgagtctgatcaaggtgagctcatggctgtcctcgtcggctacactggtacgcctgtccatgtcctcaaactcaatgaggagacaatggagtgggagaagatggaatccttggatggacgggcattgttcaccggaacatacacgacaatgatgagaaaaaccaagcttaagtcgatgcagaacaaggttttcctcccgaggttgtatgagtggcctaagaccattcatgttgaccttgttattcgtgatggcgaaccagcatttataccaaagtcacactcgcaatatagcatcgagaagatcacctctaatacgagtatttggtcctataaagttgggcagcaggaagaagcaagaaagttttggggatcggagaaggtagactatagtatatgggtcgattttagtactaatttacaataattataggataattaattatatgtacggaagattatagtaagagacagtaaagagaagatactattgaactcatagtggttttttttttctcatatttgcaaacatgtctacatatgagaattgctgtttatgagaggtatgagaacaactcgtcgatgctttcttacagtagccccggttctttaaaaaaccggggctaaaaagcacttttagtcccagtttataagtttagaggtattttttttatttttaatcctggttggtaacaccaacaagaactaaaaatcatttttagtcccggttcaataactgtcaggccatgtcaggcatcgagcgaactatagtctccattggtgataccaactgggactaaagatcatatctttaatcccggttgatattggaaataaatatctctctcccacgtctctctctcataaccgggattatagtgggttatgaaccgtgattgaaagtgggttagaaaccgtgattgaagatcatttctctagtagtgatagtagtattgtaattaattgcgctcacgagaagacttgtgtgcacatgttgtctcaaccttaataaaatcatgctaaaagcccgtctataaatgatgcatataaaattcaagaaaactacgatttaaactctagcgagggaagttatatacccacaacttcaacaccactacggctctacccaaaaaatgttggaatgagtgagaaacgaaaacaagaacttcaattatttatcttctcatagttatactagtagtacttgtcccagtacatcaaatgcttacaagtcacaactcacaagcatatcacttatcactacatgtttattcagtagaagcagaattagtcgcgacaacatacagttgcacccgtaattaattactaccagtacgtacgtcacattacagttacacaagtgacaagtcccatagcctgctcgatgcagtcgtcatctgccattatattgcagttgcaatctctcatccaagtttgatgcctgcagctgcagtctctgcagcattgcattcagaaactcgatacatcgtcacatgtccttgggaatgttcgagccggcgagcgtgacggcattgacgtagtcctgcaccctgtggaacggcaggccaggcagcgccaccgccgccgccctcgccgccatcagcagccacccttcccggcagtaggcgctcctccagtaccccaggtacgcgctccgggccagctcccacgccgcgttgatgcggctcgtcgcgaactccgccgccgacgacgacgagctcccatctcccggcaactccttcaccacctgcataagttacacgtacagcacgattgatgagcaatattcagagatcgtgtcatggaaggggacatgcatgcagcaacaagatctttcatgaagaacagcaaccaaatgtacaaccttcagacaggacattgcagataactgcagaacagaagaagattgtattccgtttaattttcatttggtttcattcagacgatgataacgaatcttggggctgaattcaggtacaactctggctcagtggttctcgttgaatttccctacatcaatcactatccaccacacttcatttatctactcatcactacatctgaagcatacaaccagaaatttgtgtccttacatcagcaatgagattattcaggccaccatcaagactgcctgcctgcatgtactagtgtcataagaaccgaacaaaagctcactttcactggattctctgtctggattgttcatacgatgtgcttgctgtaccactcaaaatgaacacaaaatctgaaagaaatttctttaccgtatagctaaatttaccaagcattctttggggccaaccggtcaacatcagtacatcacccgtttctgatttgtctgtctaaaccattcgtcttatataaaaatttagtgtaaatttataaaaatataaattaatgttagagtttctttgatgataaaacaagacacaataaaataaataacatttatatattttttaatagaatgaatagttaaatgtcacgataaaagttaacggtgtcatatatatatatatatatatatatatattaaaaaatggaaggagtatatgttatagatgagtatcgggaaactgttttaatccctcgaggggatatcccctcgttctttgcatgtcacttaaatggttataaaaaaatttggaaaaaattgggaaggtgtattaacatgtgatataacactccacaaacatgcaatttctacatctcgtaacgaaaaaaacaaattgaaccgcagctagttaacgtatattcagagtcaaatttgtttttttcgttgcgagatgtagaagttgaatttttacttgcatgtttgtggagtgatatatcacatattaatacatcttcttaaattttttcaaattttttcataaccatttgagtgacatgcaaacaacgagcgaatatcccctcgagggatcaaaatcctcttccatgagtatcaactaacctagaattttattaccgtatcctacaccaaaaaacgaacatctattgcctttgatccaacagatcggttttttctatactacattgggttaaaattaacctgtttaagcctgaatataatacctcgagtaccaatgtatcagaagctggtatatacgtgcttgtaaaagcatgcattgatcaatatatgatcagaaggagaaaaaaaaatgaacgtttttctgaaggaaatataaccagacagtgatcaagctagagaagagaggcatggatgttcaccttgaggttgtataagctgtcgaagtggaggcggatgccgaagtggaggaagtgcgcggcggagctctcgtgcggaaggcgcggcagcgggtcgtcgccgtaggtgatccggaagtgcctcttcctcggcctgtccaggttcctctcggcgaacatggcgagcatggcgtcgccgacccgcggctgcccgaaggtgtacacgccggcgagccggtccagcgccgccttctccttgtggtacgccagcaccgtcgcgaacagcaccgccagcgcgccgccggagccatgcccggcgaccagcaccctcgccctgccgttcgcctccagcagccgcttcacggcgtcgcggatggcgtagtaggcgtgcacccgctgcggcttgcccttcacgtgctccacccacttgggccacccgatgttccgctgcgcgcccagcgcgtgcgtgtacgccgcgtgcgcgcgccccagccgcgggatcttgtaccacgacgggtccacgtcggcgcaccaccgcgccacgtccagcgccggcgtgccccggaacgccaccaccaccagctccgcgtccgccgccttgtcgcagaacacgaacgcctgcgccgtgtacgcgttctcgaactctgcacaatacaacaaacaccacacgcataacatcaaacacgttgcgtgcgtgcgccggtgcgcgcatggagctgtacagaacctgtccttgatgctgtgcttaccgttccagcagttgaagaactggacgaactccatctgccagcggcgggtgacgacgtcgcggatgaacgcctcgttctcgtacgccaccttggacgccatgacgcagagcgcggcgtggtaccggctgtccgccggcgtgatgctcctctccagatcaaccctcgggtcgatgagcccggtgattgatcggtacgacgccgacttccgatcaggatactccattctccctgcaccaacacacaattagggttaactatccgagacatccatgcaagctagtgtcaccactgaccatggaggacgttgctggcgaggttgagggcgaactcgagcgcgccgccgaggacggcgacgagggggccgactagcgagaggaggaagagctgcaggaggaggttgaggaagatggagaggcggcgccggaagctgtggagctcggtgctggtgaagcagtcgacggccttgttccggccgaccttgggggagaagaggaggtgcaggagctcgtacgcgccggccctgtcagggcgcagcaccatgtagtcattgctgaagcagtagtcgagcttgctcatggcggcgagaactcgatcgatcgattgctagtagagctcgtcgtcgtcaatggctatggatgacaagtcgacgacgacgacgacgacgactccagatatctatctagcattctcgctacctctccgctatgcaggccgagtaaaataaattaaatggcgttcacaaaataaagctgtggactgtaacattttttcggatgagtagccatgactgattagaagatctctgaaatctgaaaaaaaaatgttcacatatttcattggctctggagcatctcttctcgtatgttcgatggatatcttgcgacaatttgtttgtggtttactgtagactagttttttgtggcagtgagatagtcacttgtttttgttccaagattcaggataaccgatcgagctatccggtgtacagttgtagtgctattactttcatcttgcaatatacgagcatctttcctatccttgagaaggtatcatgaggtacgagatatcatgaggtaccaatgtaatctaaccgttgatttagcacggtacgatcggactaacaaaaataaggtctctcttcatcatccgtgccggccagggacgtcacgcatcgaggtagccacgtcgttgcgcatcgaggccgccgccgccgccgcgcatccagcccgttgccatcgtcgcccatcgaggccgccgccgccgtcgtgcatccagccggccgccgccgtcacgcatcgaccccgccgccgccgtcacacatcgaccccgccgctgttgtcgcgcatccagccgcccaccgccgccgtcgctcatccaggcgccaccgccgtccccctcgagcctgccgtcacgctgctgctctcctgaggagtttttttctctcgtgaaacaaacaaaaggacagaaataccctcccgcccatggtaccgcttcaatggggaggtgcagtaccatgaggtacggatgatttctgaccgttgaatgatgccagatcaacagttagaatttggtactgcacaacctaaagaacagtaaaaaaacctcgcagtataagctcaaaaacgggtcaatgccgggcatttacaatgactgaaaacgattgcaaaattgactcgagtagttttgtatgaaacgattcgaataattctgattcagattggtgacactaactacttttgaagtggttgccaagcgtagaaagattggcgccgtgctcgtacttgaattattatatgcttttggaactttgttgctttgattatgtgatgtagcgaatgcccgaaaaggataacgctacctagatgcttcgctgctatgagtcatatatagcacccatatatgtttgaaggttcagtattcagaagtcctatatactacaaacgttcaggattattcagagatgttctatactacaaaagggggaaatttgatggaaacagtgaaataaaatactagctgatcagaattataactgaattcaattttgaaaaatataaattcatggcatggattgattggagccgagaatgagaaaggatgacacgttcgttcacctgaactctgaaatctgaagcctgatcaaaacctgaagtagtctcttctcaatattcagaaaaaaaagagctgcatttttttttatggctgatgtagcgatcggccgcatcaaaatctgaggctaaaagccaccgggatatgctgcgtccacggagacgacagatgcatcctccgcatacacttcagatttgctatgatcactgacactgacacgaacgaacactcgttcttgcgtgctgcaccactcggtcgcagatgcttctcgcgcgccgcgagctgaatttttcttttgttggctagctcacctgcagccaacgccactcgctcgccgcgatcgatctatccacgtactgatcaccagcggttaaaacccccaaacacatcagcagcagcctccgtcatctccacgcagagattgatcaaactcgtcagttaatcaccagttggaacaagatcgcatcagagtttccggaaaactgttggtataatttgatgggggcgctggcggcgtcgatcgcgtcgcacctgccgtcgggggtgtcggcggcggtggcggcgctggcggcgagcccgggggaggtggtgaggagggcggcggggctggaggacgagctccgggagcttctccggctgaacggcggcgggcgcgggcggggcggcgcggcggcggagcaggggcagggcgagcagacgagggacaggttcgtgcgcgcgtacgagcggctcaagagtgagctgctcaacgaccgagccttcaacttcgacttcactgaggagaccaggcagtgggtcgccaaggtacgtcttactctctctatacctaatgaacacgattaattgcaagtttattactgtacaacatacatgtggtttggattaaatcatgcttgatccatggatcgttaaggtttagatgcagatttaactcggttttcatttgcatttttttttcaaactgttaaacagtgtgtttttttaaaactttttatataaaaattgctttaaaatatcaaataaatttattttaagtttaaaataactaaagctcaattaattgattttttttcgttttgtgtgctctgactttatctccatcttaatttctcccaaacactgtgcatacatagttctgtcacggacaaatgtcaaaatttcaaacctaactttaaactccatgatggggtttttcaccccaagtatattttttagcattagttttttaactataaataatacatactttgaccaataacatctataaaagtaagatgctttaaataaaaagagttgtatattatgatagtttgtttaatgataaatctagtaacatcaattttatattattgatcttttttattttttttgctattaaatagtcaaagttaaaaatgattgacttagcactattatgaacatgcttatactttgagacggggacattataaaatatttttggttgcttaattcatatggcttctctatacgcatcaaattcacattgatggttatgcctgtcaagatgagttctttaactgttcttggtactagtaccactgaaaaaatggttcttttgtttgtaacttctatgttcaatacttcaatctaatcaaacctgcagaaatattttaaccttgatggtttgtttggtaaaatacttttatatggtgttatctccgttgtttctgacgaaaatggaaatgtaatgcgtcctctgttgttttctttgctgttgcagatgatggactacaacgtgccaggaggtgagcaagctagcatccatgcccatgcagaattgatctggccctgctgccctgaaagctaagctgacatgtctcgtgacgtttttctgaagggaaactgaaccgtgggctctcggtggtggacagctacatgctgctgagacaaggaaccgaggttgacgacgaggatttctacctcgcctgcgtgctcggttggtgcgtcgaatgggtaaacaacaccgtcatccctgcccaatcactagcgaaacaaaactctgttgtgtcagtctgtcagatcttggtactattcatcatgaattttggtgcctgaattctgcagctgcaagcgtcagcccttgtgctcgatgacatcacggacaacgcctacacgaggcgagataacctctgctggtacaagctaccaacggtgcgatccatttcttgctgtgttctctttgtggtagatctgaatctctgtcctgagaatgattgattaactgaaaaatgttcgtgtaattgacaattttgtcaggttggcatgtctgctataaacgatggtgtgctgctcaagtgccatgtccaggcaatcatcaagagatacttcaaggagaagttctacttcctggacctcatggagctatggaacgaggtaattggagggcctgaacaaacacaaaacttgttaggatttcatctttaattggcatatattgctcagttttgatcttgttttttgggacagataggcttgcagactgccatggggcagatgctggatctcatcaccactcataccggcgccaaggatctcgccagatacagaattcaggggtatgcatgcagtgtataagtaactctactcaagttaaaatagcattagtgatttctcttaatttgctcccaaattgattctgccaggtaccgtcgcattgtcaagtacaagacatcatactattcgttctacctgccggtgagtctgagcttcaaactgaacagttaaatgaatgatgaaattcctctagttctgaaaagacaactgtttgttgtagtagaccagtagttctgaatttgtttccttttcatcaggttgcatgtgcattactcttgaatggcgcgagattgagtgactatgttgagctgaaaaatgtacttatcgaaatgggcgtatactttcagatacaggtccgtttatacttcctaaatggttgtattgtcctcaacttcatgattaattctgacataaatgcacttctcaggatgactacttggattgctttggtgacccagaagtgattggcaaggtacttacataaaaacttgtctttacattttgtttctgctggtaaaatgctctgctttactgagctcaatgtggtacaggttggaacagacattgaagactacaagtgttcctggctaatagtacaggctatggaactcgccaatgagaatgagatgaaaatactatatgtaagaaaaaccacaatttttttcttctatgctatgatctcttcggagaaagcaaccacagattttttccaagtactaactgcacatatatttgcgtgtaaatttgttgatttctcaggagaactacgggaagtctgacccaaaatgcgtagcagaagtgaagagcgtttacagggagcttgatcttcaggtactacaactctttctaaccagactagttagaaagcataataagatatgcaatgccatgacccttttaacaagttcatctggttctgtattagccaccctgattgttactcgaaaggtgaattttccaaccacagaaaaacgagacatctaactgtgaacgtttttcttgctcctttattacttatgtaggacatatttttggagtacgagtcaagagtttacaagcacctggtttcgaccatcgacgccgagactgaccgtgcaattcgggatattttgaagtcgtttctgaagaagatttacaggaggaagaagtagaaacacctttccacagtggctgcttgagttcggacacaaccgcttggcaagttggacagttggaggatgcgatgcgctacattgaatgacatgcatatgccctctgatactgttcacaaaaaaaattgtaacttctggaactgggagaggataccgccatgcacacatgtggctaagtaaaagaagacatatgtattgtgttgctatgtgacactaataatatgcaatagaatggtcttccgtagtatgtgaaaagagtatgttttttaatgttaatttggtaataaaatttttagtacaatggtatgtatggttgtagatgtataaattcatccatgttgagagcattgttggaccggacatggcaatccatgaagtgttttagttgggtggatgggacgttttatttttttaagcatgagatgagccaatcttttttttttaataaaacatatactaattattcttaatcttattctaatcaataatagttactccctccggtttaataattcttaatgttttggataatgacatggtctttaaaatatatcttctaaaatatatctttgtctatattttgttattaaaatatacgcaataaattaatatttttttacttttattgtagtactttatatggcaaatatgcatatgttgttctaatgccttaaaactaaataactttccgttctgctaaatttgtggcgccacaattttaccttgatttcagtcgattctttgacccacacgattgacgccgagattcgtgctcttgtacataaccaccagaaatacgataacttcaccgagcagatgtgttacgttgggtactgctacatgctcgtacacagttgcacattggtcaaagtaagagaccggacgaatgagaacacgtaacgagagagggataaaatagttagtgttatataattacttcctaattacactataattacatactatttacatatgtaattttagaacttacatatgtaattttgagacttacagtgtaaatacattgaaattacatatgtaattttagggacttacaatgtaaatatattctgactattttttcatgaaaaatatggcgtcatatagatagatagtcccataacttttaagttattgatagtcaaagttataaaaccctctgcgccaattagcattgcgttcatccaccctcgttgaaccaaaacacatgtaaaattaggggagtaagttcacttaggtccctctatttatcgcccagtctgattttcatccctgagatgtaaaaccgggtacgactcgtcccccaacttatgaaaaccggacaaacgaggtccctcggcggttttggttgacgtggcgcctacgtaactaatttgactcggtcttcatctgacgtggcaatccaatcaaaaaaataataaaacccatgggacccacatgtcagttttacacaaaataataaaaaatggtgggacccacgtgggccccatacgtcatcctcactcctccctgttctctctatcctctctctcccctcttctctctatcccttctctctatccggtcgatggagcggggcgagcggcggccggcagaaacgggcggggcggagtggcatcgggcgtcgcgacggacctcaccgcggctccaccttgcccagcgagtcgatgatgagcgacaagcttcagatgctcaagagagggatgtgccccgtcatcgcctctcacggcccgaccgaccgcctcgccatcgtcgccttctctggcgccgccaagcgcctcctgccgctgcgccggatgacgcgccagattgtcgaccgcctccgccgcccagggccaggaacagccgcaggccgtctgcattagcgacgcgctgcgcaaggccaccaaggtgcttgaggaccgccgcgaccgcaacccgtcgccaccgtcatgctcctctctgacacgcagcagcagcaggatgcgaggaagcccggcgcggtccggcgcccgccagccgcccctccggacacgcgagtcacgcacgtcttgtgcggccacgggcagcaggcggcagcccttggcggcggtggcgacggctcggcggtgagtgtctccctgggcgagaagtacgcggaggatattcgatttgtttgtatgatcctatcaatccgtaaggattcagtggctcatcttcatcaaccatctcttgtgcttctgcagcaaatgttaaccccaacagttaggaatcaaagaaattgaatggcaaagcgattttagttctcatatgtggagtaataatgaagaaagatacatacttatcgatgatttgtgtaggtcataaacaaccattagccgtctctgcaggattgccgccatgaagacaaacatagaacacatgccaaacatgacagtgatagggaatgtctcgtcatcgtcgtcgccttcttcctctggcttcttggccaacggcggcgatggccggtcgcattgtcttattcgttggtttcttgccaaccggaggcgatggtcgcctcgtcgtcttcctcgggtttcttggcgaatggctgcgagggagatcgtcgtttgatcttgtcaatggttggatgcagcgggcagggaggagatcgtggaggcggcagtggaccaggtgaaggtgctggaggacacggtggccgtgctggagcctggctggaggcgtagtggcgtacctggaggtgcagccgtgcaggttggcggcaccgccgccgccgccgaggtgtccgtgtcgtaccgggaggcggggagagagaaggaagataggagggtgagaatgacatgcaggacccacgtgggtcccaccatctttagtttcttttaactgacacgtggacgtccagtttttattatttttgggatcgaattgtcacgtaagcgccacgtcagatgtacaccgagtcaaattagccatgtaggtgccacgtcagccaaaaccgatatcaaaaccgccgagggacctcgtttgcccggttttcgtaagttgggggacgggtcgtatccggttttgcggttcagggacgaaaatcagactgggcgacaaatagagggatctaaagtgaacttattccaaaattaggatagccaactctaatgagagatcctaaattcaaaatgtcacactcccaccaaattaggtctttccttagatcttgtctgggccgtagcaatttgattgtgaatattattcagagccaaattaggcccatcataaattagagaaccgatccaaattgggccatgctaattggaaggaggactggacgacctgcctaaccggcccatgcattcattcatgatcaactactaattagctgatgcgcatcttcagagtgacagtcccagattaaagctaacacagcaaacatccagctagatatgctttcatctcaattagttcttgtaatccactagcttcttgctaaacgttctagtgaaagatgtaattgtgttttcatatcaataaaacgcgccaaatggcttccctaaaaaaaaatcatccagcaaatcatttcaattcgctcccattcaggcccaacaaccccacgtcccggctttactgacactacgctaaatccagcaaagttcatggacgaacatgcatgttccggcgatcaaccggctcataatctcagcggtttccgcacctgccactgttgcagcaacaggcaaccacagctgccgttgccgcaacagtacgcgtagttagagacgcagcgtgctcgcatgttaggcgtcacgtgaagcagcggccttagatcgagccaagcacgcgaaagttggcccaaatggcgtctagaattggattttttttcattttcaattttatttttttaatatttacagaaatattataccatctaaaatatttacacaaatgcaatttttgccgtactaaaaatgcatttttctagttttttttcaacttgtctgtccctcacgtcaccctgccgccctacttctgtaaatattttcgcggtacaatatttctgtaaatattaaaaaataaaaatgaaaaaaattctctagaattgagcctacgtacgtgctgtagagtttagttggcgatgatgagataatacctggtcggccgacgtacgtacctgacggcctgaaacgctggatcgatcgaacctgtgtttagcttctcttcttctgtaatcagaggataagagcgataaaggcaataacaagctgagaaataaatgcaacttgttcagacttcagaacttgattgattataacttagtacttcatccactctaaaatatgaaaaattttaggttgtttagtaaatacttttttgaaaggaatcagcacgagattgtgctatttcattagatataggcgtaaaaaaatacaacccctaggggcaaaaaaaaaagagctgtacaaaattacataagcgctatgattaagttggtaggaattctccaagtcgccttgcgcctgccattatccaggttcttgcctcttcctttatttttgctataagattgggggccgccgtttccttgtgctcgaagatcctttggttctgtttagtaaatactaaggttaagtcaaaataatatttccttttagtaactgctgttaatttaaatacttgaaaatccttatattttgaaacaacataacgatattctaagtacctcttcacaggcaggcctgcaacatgcgtcacgcagactttgatgattgatgcatcatgcatcacgtgctcatggtggcagaaggggtcggcaacgtagcttgctgttcttttcgctatgatgacgccaatggagctacgaagtaggaaatacattggtatttcagtatttcagtaaccagttccacgagcagcaatagctagctaccaccgcccgaaccacctgtttggcagaaaattgaacactcgcatgagctcagcaaaaggcctaccttctggttcgatcttctcccgccacgttctgcacttgtgcagtcaacaagcaaccgatccagcttcgggggcctctacaaatacagctcctccatagacttcacttacctcgcaaatcacaagcaacatcaccacagatcgatcgagacagctactgacatcaacgtgaaaaagggaagaagaactaaccatgtccatgcaggagatgctccgcattggagacgacgacggccggagcgatgctctggaacgcgagctcaaggagaagctgaggttgcgcggcgatgcctcaccggcgaaatgcaccaggcaggagcagcggtggcggtctgatcatggcatcgtcgacgcccgcgagaggttcgtgcaggcgtacggccgcctcagggacgatctcgtcggcgacgactcgtgcgagctcaccgacgaagccaggcgctggcttgctcaggtatactgtatatacattattcacttgtaacggggaaactgaagctaatattttatataatttcattgttgaagaaagtgaagttaatcttctatatagtttcagtgctaaaagttttgattccttcttatctttattttctttgggcagatgatcgactacaatgtacctggaggtgaggaggcatcttctaaagcattgcaagtctgaacatctctgatctgaaaattggacaagtgttaaaaaaatatagtgcacactttacattcagagagtgcaagtgaatctagctgagtttcggttttgaaaaaaaaaaaaagagaaaaaaccttttacaagtgtctcaactctcaagtcacaaaattttcaatgcaatcttctgtttctctaaaggaaagttgaaccgagggctgtcagtgatagacagttacctgctgttgaaacaaggaagtgaggttactgaagatgacttcttccttgcttgtgtgcttggttggtgtgtagaatgggtaatgttgctcaatccatctgctcatcatccttttattcctgaatctgctcatgccgatactaacaggtttcaattatctttggttctatcaaaaatgcatgtagtttcaagcatgtgcactactacttgatgacatcatggacgattcacataccaggagagatcagatttgctggtaccggcgacctgaggttcttcaacccatcttcacatgatactctgattctcttaataagctgtaacaaaacaggccacttagttcttccacctatatttctgttacaggttggcctcaggggtataaacgatggtatcatactaaaatgtcacatcttgataatgataaaaaagtatttcagagaaaagccttactttcttgatatcttagaaatatggagcgaggtcagcaaacatctgaattactactgaaacatcaattatcataatttctgatggtggttgatactgtttagaatggatattttgttcagatagctctgcagacttctctggggcagatgcttgatcttattagcacacatactggagcaaatgatcttgcaaaatacagttttgaagggtacataatctagatccatctacctctacctctcttttatttaatatttgatttgcttatgataatattgggatgttgctcgtattcaataactatcttttctcttgtcatgtagctaccgtcgcattgttaagtacaagacagcgtactactccttttaccttcctgtaagtctggaagaccgaaactcagatgcagtcctacttttcacttgtcataacgtcatgtatctgaatataggctgtagaactgtacaagttcttcaagttcacgatatcatatgaatcagataaatagaggggtttctttgcggcaaactcttgaaaaaaggtgcaggaaaaacatgttgaggaagaatgaagtaggctatcctaaattctgatcatacctgtcctcagttgctacatgaatctttttcagacagaaattacgttcttcagatgataattgtggcgtgcagtacattggttggtaatctatgtatcttcaattagtgcattatgatgttcacattttcctctacaactataggtggccaatgctttgctcttatctggcgcaaaacttgaagacttcagtggtctaaaggatatacttattgaaatgggcatatattttcagatacaggtatatggcatgcttttttttctttaatgaaaccttaaagtcaattttacctttactttgccttttcaggatgactacttggactgttttgctgaccctaacaccataggcaaggtaaggacaaagatcaaaatagttttcagcaactaagagaacaactgacagctgacattattctacattgaagattggaactgacatcgaagatcataagtgttcctggttaatagtacaggctcttggtcatgctgacaacaatcaaatagaagtactacatgtaagttaccatcttgttctatctgaaaaagtatggacatgaacagaaataataacctcctgcgcaattcacagaggaactatggcaagaaggattcaagttctgtttccgaagtaaagaggacttacgcggcgcttgatttgaaagtatgcccgtgatgttaccttttctttagctcatttcacattgcttgctgtagtaatgtagatatgggccattgatttggctgactgtgagttctgtcctccccaggatatcttctccgagttcgaacgtcgatgctacaaccacctggtcacctctatcgaagctcagaaggatcatgcagcacgggagatcctgatatcatttctgaagaaaattcatcaaaggaagaagtagttaataagttataacaattatgacctgtatgagcttatggtaacatttaaaaatgatcgaaatctatctccccataagttataataacactatctccggtttcaaacgtatgacgatgttactttttaattcgtttgagtttaagcaaaaaaaatcaatgggtgtcacatacatttaaaaacggagggagtttcaagttaccaacggccatattcattgcaacattcgtaaatcagattaaaggaaaaaaagatcaatacaatgcttgggttcccaatgactttgcttcttacatttctctagtacgattggtcggatccaattgatcaatatttacgaatggtctagcagcaatgatttgtgcacatgaatccaatcacatatccttaggccatgtttagatcccacccttaaacgtttgaacacctgtatgaagtattaaatataggcttaaaaaataactaattgcacagattgcgactaatttgcgagacgaatcttttaagtctaattgctccatgatctgacaatgtggtgctatagtaaacttttgctaatgacggattaattagtcttaataaattcgtctcgcagtttacagacagaatctgtaatttgttagtctacgtgtaatacttcaaatgtgtgtccgtatatcctatgtgacccgctaaaactttttacccctggatctaaacacagccttagtaacacggggattttctccgagacttaaatcggattcgccatattttctcgatgaatttaaactggattttctccgagacggaaggatcagcagatcatacctttgccagctttctcgttcactgggataggagatggccagccgcagccgaagcccaaaagcgccatggattctctcttcgagcacatccgccgctccgcccttgcgtcgcctagcacccggaagtacagcaccgtagcaagccaaagccaggtaagaactgtacccatctccgtacgaatgccatgatcgcatcagaattcagaacacaccatcacctcatctgtttatcgctgatgtctgaaacctgcactgcagcagtgtgtttttgttgaatggcgattttatcaagtgatgagacgcaccatcgcattcgacggtgtacctggaatgtagaagcaacaggacagcgatttattcctcttattctgggattatctcacacttcaagcacaaatttctctgagaaaaatttgtttatctacattttattacagggagggaaagataattggagatttgctgagaagcagcgatggcggaatttgggtatttgctcaaagcttcagacaggtattacagagacaaatagatttaaattacattgctttgagagataacactaaacaatgtctgaagaaaaatcttttgagtgatgcctgatagtcacagcaatttttcacacaattccctgtttctaaatcaagggctagcagagatcgatagttatctgctgttgaaatatggaatcaggattacagtagatgatttatttggtcccttgcatcttcttgtatggtgtttagactggggggtagccatgctcaaatcatctgctcacagtcacttttcagtaattttgttcccttctttttcatccataccaattgcaatatcatgcgaatctatctattatatactaaaagtccattaaacttcctacaaacgctcctaaaccgccacgtgcccccctacaaacgctcctacgccgccacgtggcactctaataaattagaagaattaagcaaagcatctagccgttggttttcatttaatctggtggacccactatttttaaacgttagatatagcataaaaaatatcaattagatttattattatctttaaaaatccacacatgccctgtacgtgtacgtgcatgtacgttacatattttgtacgtgggccccactcccccttttcttttttctttttcactaacacatgagaaaaaacaaaattcatattccagcccatatggttcggagtatgtacttgcatgtagggcctcacgtccccacttttcttgtctttttcctttttttcactcacatgagataaaaaccacgttaataatttcaacccatagttgtacaaatataagttattttgagttcgtattgtactatacgcacgtcatcgaaatattcataaaatatctaaataaatgaataatatacattatataatctatctatctattatatactaaaagtccattaaactttctataaacactctcaaaccatcacgtggcgctctgatatattagagaaaatcataaaaattctaagaaaaaagaaaaacatctaccccttgattttacacttaaattggtgggtcctatattacacaccgttagatgaaattgatcttaaaacaaaccaagtactatagggtcccacctctcctccttctcccgcacatgtgtgggtatacgtatgtaccatggtatgtatgcttccttcccttcttttttttccttttttcttattttccccatttatataatagatatatatatatatatatatatatataaaatcataatttcaccaacaaagaatgctcacaggtaactaaattagctctacaatttttgaaaataaaatttacaccattatatgttaccattaaattaataatgttatatattttctacataaacatgtgtactcattattttgtactattattttcacataatacactattttaaaataaagtttacacaattatattgtgtacctatcaaataaacaattttaatctatattaactaatttatatgtgcacttaaaccgatggacccattatttaaatcatcggaactattttttattacattggactattattctcaaataatgcactaaagtctacatcattatattgtgtacccattaaattaaaaatttaaaatctataataactaatgtacacttataaagaaccggtggactcatcatttaaatcatctgatatattatttgctaataaataaagcgtccgaagttctctttttggcccgctacacaatgcacgtctgcacctttaccttttgcacgcgtgacaaagcatcgtgtctgaggcatctaaggtgattatgactgccgcagcactaacgttttgccacatataaattcatacatggagaagattaatttattaataacatgaaaagaaaattagaggtgtgatgcagcaagagcagaattaagcaatatgggttgcgttttttctaacacttagctctatttaagttgaaatcgagagttaattacagaataattataatgtattgtgttatgtcgtgtttggattttgtactatttgtagctctatttaagttggaatcgaaagttaattacataataattataatgtattgtgttatgtcatatttggattttgtactatttgttggtatacgtaaaagaaatcattatgttataatatgagcaaaatattaacgaatatcaatagaactcttacaaagacaagagtgctataaggaagtttaagaccctctttttttccttgattctatagttggattttcgtttgcacgctttccaagtttctaaacggtgtcatttttaaacaacattttaactttttagaagtcaattcattcatgtataccctcaaatagctatcacataaataagataattcatcaatttcagctgtcctaaaccctaagtagtatatatttttttcatgcgagtcatggtgatcattaaattagggatcaacggataatcaaagtcgtaagatgaatatgtacaaactactatcaacatctgtaaattggtgtcaaaattaattgctactaattagacatctaatggcttgctagccacataattaatttctctcgacatgtatataaacatgcacgaagctagaacaaatattaccatatgccccatacatatatattaagcggttaatattctaattacatgtgttaagtcctttaaaatttcttaaagtgctctcaagctgtcacgtggtgctctaataaattagaggaaatattagaaattctatggaaagaaaagcaaagtatccattacttgattttcggttaaatcggtacgcccaatattataaaccgttatattaaattgatcttagagcaaactaaatactgcaaggtcccacctctcatcccctggcataggtacgcacctacgtacatgggtacgtacgctttccatcccttttttcatttttccctttctttttctttctatgcatacactcccctcccccctttcctactatatcatgcgccttcatgagacaatttatcacaagaattttgagtatcttgctctcgtatttttcatttgtggccatacaacacgatatgtatatgaatggcctgtatgatatttaactagcaatagtttattatttactcgagaaaaaaatgattcaaaagtcgtaagtacttaattcatctcctactcaaagtttgtgaatggttttttaagatacattaagaaaaatagaacccttaaataatcataaaatgacattatccgagctttagtttgcccttaatctatgagacaaaatttttgaacaacaataatcttatctttcaataatataagtgcccacgcatgcgcgcgggccaccttcctagttgacttaattcacacacgagagatcaaattttctggcagtgaagtcctgatgttcttcagcagagcatacctatccattttcagtttcagatggagcatgtttttttcccctaaatacgctctattaatggaacctaaaatctataatggtggtggtgattggcagaactgcgactgacatgtgggccatggtataagtataagttatgagtgtttgacatgtcttcgctgtgcccctgcggcttagaggttcgcgcacaattgcttctggcctgcgaacaattcctggatttctgacatccgcggcgccctcaatgtcccaatcatctcccagtttctccttgtttaggatgcggtgcttcacattcagctttcgccgggtgtcggtgatcgtcttgtttagcgctggacgagtgaccaatgctactcggtgcgttcggcgtaccaggcgctcttctatggccagcactcttttgcatgtgctgatcttctctggcacgcgaagggtcctgttaaatgcaaattatttctctggtttgcatttcagcagcgttgttggacggctgatcacctccagaagcgtggcatcgattcagcagcgctgtcggacggctgatctcctccataagcgtggcatcgatagccactcggcttgccccttttgcgctcaggagcttgagacggcgaaccacatcctcttcgattgtgtgttcgcttgttaggtctggttatgggtgttgtcccctcctggctgggctgccctctccccgccccccctggtggcactggctccaggactggtggccatcttctagggcctgtttacctgaacgcctccgtaccggcttcgactccctgatccacctggtctcttggcaactgtggaaggaacggaactctagggtttttgactctgcactctcttcggtctcagtggttttagagtccatcctttcggaaggccggctatggtcgttagcgggcgttgcttcctttggggatttgttgggagtgtagcgtgactctgtcccctcccactgattgaagtagcattacccgtcgtacgtgtttttctttttcttccttgctttttgtctttgttttcttccacctctaggcataagctagtctggctgattgcgttgtgtaacaaaactcttttcttctaatatattgacgtgaattctttttgtgcgttcgtgaaaaagtgtttggctagttttttctgtatttttgtggagtagctgtacgtagtcttactcttttgctagtcttgcattactctataggacacagttctttaattctctattgatttgcttcttgctatcttgacttaaaaaactcacaaactttttagggttttattgtaatttaaaatgagataggcaaaacactttattgacgattacatattttataatcacatcaaaaggcatcttgttatcacgattggagtcatcagtctgtactgaaaactaatatgatattttacttttttttaagtcgaataagccaatattttttcaagagtaaagtccatcatcggtccctaaacttgtaccgctgtgtcatcccggtccctaaactcgcaaatcgaccgttcaggtcctcaaacttgttcgattgtgtcatcccggtccctaaacttacagatcactcgtttaggtcctccaacttgttcagttgtgtcaccccggtccctaaataagacggtctaaaaactttatatcaaaaaataattcataactttttcatgtaaactctaatgaagacaaactttatatcaaaattgtagccctagacgcgacctacaactttgtagttgaaaagtttttgaattaaaactgtttagggccccaaaatattattgtatgtttatagattttgaaattttaattttaaaattacattttgggacaaaaaatgacttaaaataaaaaaattaactacaaagttgtagatcgcgtcgagggctacaagtttgatataaagtttatcttcattagagttcacatgaaaaagttatgaattatttttaaatataaagtctttagaccgttctatttaacccagatgatattcaaatccaagtttagagatcggggtgacacaactgaacaagttggaggatctaaacgagtgatctgcaagtttagggatcgggatgacacggtcgaacaagtttgaggatctaaacggtcgatttgcgagtttagggaccgggaggaaacatcgatacaagtttagagaccggtgatggattttactcttttttcaacaagagcgtaatatttgttgctattttgaatagtacgtagcaacacgggggtatgctgaagtccagaaaatttttgatatatgatgaaccaggcactggaagcttctttaagacgctgggacctaaactgaagttggctcaatcagagtcatactctgaatcctaatccttaaatttatagtacctatcatcagttgctgcatgaatacttttaatttttttcacgaatgtgtaaaaatattgtacgtcagtatattagaagaaaagagtttatgttacacaaccgacatgaattcgttttagaaaaaaaaaatctttactcagataactttagttgtgaaacacaattctacatgcagtatctttattcgttgcacactcgaaatgttcaccttttattttctgtggctctaggtggctaacgtattgcaagatgttgcttttgccatactacatccatcccaaaatataataacttttagctatgaatctagacatacaattatttttatttatagctaaaaatacttaggtagtgtttggatccagggacttaactttagtctctatatttagacactaatttagagtattaaatatagactacttataaaactaattacataaataaaagctaattcgcgagacaaattttttaagcctaattaatctataattagagaatgtttactgtagcatcacataggctaattatggattaattagactcaatagattcgtctggcgaattagtccaaaattatggatgggttttattaatagtctacgtttaatatttataattagtgttcaaacattcgatgtgatagggacttaaagttttagtcccatctaaacatggccttatattttgaaagagagggagtacagttttggtacatactatcatgcattgctgaacccaaagctgtaggaaaaggtgacaacactggtcaaattagttttcagagacttcggtgacatctaccgtctggctctttgttgcagactgaagttgtcaatgaaaatcacaagtactccgtacttctggatgcttgtacaggctattgcaatcaaacagaggtactgcatgctagtcctcgtctctttctgagaaatgaacgtgaaaaggcactaatcttttttatgtaaacagaggtatcttgcattcgtatttcagtacagctatgggaagaagggggatgtgtaatccactaatcctgaaattctacctgcagaaattcatcgaaagaaaagtagtagttaacactcaagactattcgcaattttattggcctgctgattacataaaaaagattgagacctttcacacgccatgaggtatactactatctttttaaaaagatcctcaggagttaataatatcaggctatgaattagccatatccattggaaacttcttaaaccaggtcttctttctggatctccatatttttgcttgcgccgacatgtgggaagctaaaggcctagctaaacacaagctcttcctctaattagcagttcagcggcattgatggacgattgaccttctgttaaagcgcggaatcgacgaccatttggtttgccccttctatgctcaagagcttgagacggcgaactatatattacttgattgtgtgttctcttttcgccattgcgttgtgtattttgaattctggttttttctaatatattatcgtgtaaattttttgtgcattcgcgaaaaaatcaggtaaagatgatgcttgggttccggatgacttgtttcctaattttctcttgttcaaatggtcagttccgtatttctgatgcatgggctagctgtatgcattgtgcacatgtgcactatcatatccttctgatcgtgcatggtgctaacatttccctccgtgattgaagggaaatatttcctgtcatctttaaggcaacttgggaactggctcgccgaaattgacaggattttgtccgtgattgaaggatcggcaggacataccttcgccagcttcaagttcaatatggaatggccagccagccgttagtggaagatatggcagttgttcctcatattctgagtgtgtcccatacttcaagcacaagtgcacaagttatgtgaagaaaagcttagtcagtcagtttgcattttacagtgacagagagggcctgaattggagagtttctcaaagcctcatacgtagtgtaaatcgagtaaaggctaaacagtttggcattggcagtatcaggaaacgttaccgagagagaacacacggaggtgcagtagtttaacacaagacatggacaccagctatcacaagaggcgagacgattccggcagaaatgtccagaatccctcgtattctgcttggtgaaataaacaaagcatatatttttgctttttccttgtgatagatcgaggatgcagaccgcagatgcacccgttcgagacactacaaaacaacacgtccaatgcactagagtgtagagggtccagagaaggtcttatatagcattaatctacactgtcaagttgcttccatggtaaataacatactaatagtaaggtttgcttctccattctccaatgtttgagtacatccactgatccacccatttcccccaagaaaacaactcccctgcactgcaccactcgcattgcatgttggtcttctgaaacactcagatgtgggatttgttttctgcacccaaggtatgggtcgaaggcgttgtagttttttctatcctgttaactagtgttaactgttgtgtgcttccatagttgttttctgagagggtcaaattaacaagtactacatcttgctcaatttgcaacaaattaagcaagaggttcatggaggccctatattttgttctgtcagataaaccgatgtctatttgcttcatctgaatatgtttctcaaacgaaatgaaacctgtccccagtaatggctaattgctgccatcattccaaggatggatggtttcaatctcatcgaaacttgcggaagaaacgcttgcaccattagtccattatccatcagacactagctagtacactgctgctgctacaagttggtcacagccgaagacgatgctggagtgttgcttattgtatactactagctaaatgtataggcagggaaagcgggcgtgtttctgtgcaacatgtccgtgaatcttgtatttttctccggggtgcgccttgggtagcggagacagggaaagggagacggcattgctgccatgccatggaggtggagggaggtgaggtgcatgctggccacaagctggacgcaacgagaccatgtgagaaagctttggatggtagctactctgaatatgcgtgcaagccgagagggttcttcagctcactgcagaggagacgatgctagctgctgccccagtagccataccttagacctggtgcacgcacgcgacctcttttttctcgctgctcgtatacaatgtacaattatacggagtacaatgtatttttttcttcagatgtacacttatacagtgctatagtctacagtagatgtaccctagttctgtggctttgtgctgctatctggtctttagttttcgttgctgaatcttacaagtaaagttgttgcagtacatcacacggtgtcagtggcaaatgcacgtagtaatcccccaatctagctaggttggctgagtcagccccgcaccaaagctgatcagacgccgcacaaaaaaaaagcgctagaaaaatgtttcagttcatcgataaccggaaaagggaaaaagatattccgtcccatctgcgcaaagatcgtaaccacttctatgattccggactgtttagatccgctcgtatcaaatacttgacacatgtataaagtatcaaatataaaaaaaactaattatatagattgtatgtaaattgtgagatgaaatcttaattgcttcatgatttgataatatggtgctacagtaatcatttactaataataaactaattatgcttaataaactcatctcacattttatagacggaatttataatttattttatattaatctatattcaatacttcaaatgtaaatgtatatccctatacctgatgtgatacacctaaacttttaaccgaaatctaaacacagtctctatctcgattcccgccgtaatgtttccggctcctgctctccccacatcgcccgttttttcctttgttttctcaagctaaacccctgctatatattgccacccgaactcccgcatttttctcctcgctcccgcgtcccaccaccaccctcaaagcagaccacacactgtgtcgctgtcacacacacaccgggccgagctgagcctgagcttgttcggcgatggccagggcggcgcacggcggcggcggcatggggcttctcgcgcgggcggcgctcgtggcattcgtggcgcttgtgggcgtcggcggcggcgcgagggcccagctgcggcagaactactacggcagcacgtgccccaacgcggagtccaccgtccggtccgtcatctcgcagcacctccagcagagcttcgccgtcggccccggcaccctccgcctcttcttccacgactgcttcgtcagggtacgtcctctctctcggtctcggtctctcggcgttttgggtgttcatcttctcggcgtttgcgtttgcaggggtgtgacgcgtcggtgatgctgatggcgccgaacggcgacgacgagagccacagcggcgcggacgccacgctgtcgccggacgcggtggaggcgatcaacaaggccaaggcggcggtcgaggcgctccccggctgcgccggcaaggtctcctgcgcggacatcctcgccatggccgcccgcgacgtcgtctccctggtaacaataaacactactgtacacacaaatccccgtcctgtcgcgactcgtcacgtcctagtgtgcgttcaacaatactagtactacaatgcggtgtaccgccggctcgactgtagtgtagggcacgcccttgtcagtcgccagcaagcacggacccaccctgattggcaagctcaagcatcggcgtagtagtactagcgttcatactccccatcatcctgtgtgtggagtactcctagtacgttgcaattgcaagtgctaacgcttttaagcagagagggcagccgggggcccaccacgccggtgcgatgacaggtggggccgacggagctactgttgcatccagcgcgccagtaaccccttttttttgacaaactggaccatcgatcgatcgatctatccagccgtgagcccatggccatgagtcatggctgactccggccatgagacaccgcagacacgagccacgcatggtccatgtctccccggttggttccggtgctccacgtctccacagcctgacccgcacagtggctgcaggcagtagccgcaggcgctgtgctgggttcggtttagttcggtcgctctggctggctggcctttcgcagtttggccccctcctacgaaaaaaagaaagaaaaggggaaagtcgcttacggagacatgtgagccgtgtcggcctcggcttccgcgcgaggaaaccgccgcgcggcgcttgcgattgcgcatgcgcacggtcgtggtttgctggctcgcgcactgtggcgcattcgccgggtttgataggcgatatcgcgtagtggcggggcgcggggcgcccgagcatacgagcgtacgaggcgggtattctcctcctgtgtctccggctatccgctatcttttgagatggcaacagctttgagcgtactgcggctactgcctgcacagtattgctttgagcgtacgatgactctattgaacgagtattgctttttctgcggcatggatttctgcgaaagcgacgtctcgtagcccgtaggagtggtttctaaattgtaacctcggtccaactgggtaaatacttctcctgaactgtagtacgctgctcctgtccgtgttgcccgtgacgcttgccgtattacccttgcctaaaaacagtcccgtggctgggctcgtgggcgctgccagagcaaggctggaaattttcctcgttctcagcaagcaggcagacaaaatttccaccgggtagacatctagacatgacgttgtattaacagttctctcggagagccaagaaaaggttgctgaataatcacaagccatgcatatctacctgcattctgaaactgctaataatgaagtaacgattgccgttgaagcagagatgttagtgcgttgcattcgctaatttgttcacttactgacattgcatgatatgttgctttgtgttgttgtagaccggcgggccgagctactccgtggagctcggacggctggacggcaagacgttcaacagagccattgtcaagcacgtcctgcccggccctggcttcaatctggatcagctcaactccttgttcgccagcaatggcctaacgcagaccgacatgattgcgctttccggtaagcttcttccttcctgcctcaaaatttccattgacgtggagaaattttacatggttgatactagccgttctgaaaaagcatcaggttactgttttgtgaacgttgaggcgacaatagcatggttgccggttacccacagaaattaacaattcctcgttagggttgcattttttttattacaagtattagtagcaggttgatcgcagtgcaagcatctttttttcgtggcctctgcacttcacgtgagtgacatatcctctgtttgcaacagaagacaaagcagttcgctgttttatactggtttcatctgttcttttcgaaaacgaaaagaggctcgtttgtttttgtttgattataatgcaaagtagacaaaaaaacacaagcgtggagtagtagtacttgctttgcagggaatttcacatttagatgtaaaaaagaccggcagaaagcgatgaaatattctttgtagctactataaaaccgaagctgtttttaaaacacacgcatgtttctttcagaaaaaagaacaaagtgtactacggagtatttcctccattctaaattataagcattttcataatagtgctaagttaaacattttctattttgaccattaatagcaaaaataaaataaaatgataaatcatataaaattgatgttattagatttatcattaaacaaactatcgtaatatgtaagtctttttatttagatcatcttacttttatagatattattagttaaagtagcatatcaaagactatgtcaagattcaaaaatacttatattttaggatagattgaagtagtacattgtagaggatttttaaaagatttttctgttccttttgtgcgttccaatgggtgaaaaaattctaatgataatataagtttttcattaataatcatgtcaatgacaatgtttgtattttaatgagcggtttgttcttttataaacggtgtttttttcttgcgcgattttctcaaaccattcagaaatgacgcacttctttctaaaagtttttttagcatttttttgctttttatttacaacaaaaaccatatttttctccctttttttcattttcttttctcgtgtgttttttgccttttttttgacaattattttctcgcgcgttttttgcttgttttttcttcaaatgttcttttttttgcttttttccaatacatgagaatatattacggaataaaagccatgtagtaggtggcaaaaaaaaatcgatggatcctatccgactcaagcgtccatcgatttaacgttttttctgataattttcttagagtgatttttttaatagacgctgttttttttcttgcgcggttttctaaaaccattttttagaaatgtcgcgtttttctgacagttttttcctcgcatgttttttttaaaaaattaccaatgatggaaataatttttctcgcgtgtttttttattttttatggaagatggaaaacctttttagcgtatttttttgcgcttttttcttacttttttctcacgcgtgtttttgaaccgtttttattttctcgtgcattttctctttttaaatagttagattatattagagatagagaagagatatatattgattagaaatcggactttgtttcgtcatttccattttatttctagtgtgcatttttttattttatacgaaccaactttttattttttatgaactattttttttgccactttcttaggggatcgaacgaacggacttgtcagatgttttttcggttttttcgcctttataggaatcaaactttttttccctttttaaagaaatcgaatctagtgttttttcaccactttttttttttgccttttataggaatcagatttttttttcgttcggatctatggtttttttcgccacttatgggaaacagaacttttgttgtttttctttttatgcaactttctgcttttgttatctctcttttattattatttttaacaaaaacgacctcaaataccttattgtaagattatagggactcaaatgtaaatataaaaattatagggactcaaatgcaaaagtacaaaccaaaaattaaaataatataaaaatggaatgctctcgacctgtagattccgtttttgtaaacagatcttcaatccgtcacatcattttgtttcaccaagatgtgagagatatcacggtataaattgaaaccgagaggagtggtggctggtatctcggacttaaaaggagtggtgacttttatttttcagggggatcggatctatagtcggactttttttttcgtttctgagagggaatcagataggagttggattttttttaatttttcgctaattttttttgttttgacgcacgaaggaaacatatcttttttttaagttgtagagatagagattttttttcgcccttttttttggcacggaatcggattatttttttcgtttttttgtcgctcttctttttcacggagaattttttcagcctttttttttttgcatggaatcggattattttttcgccccctttttttatcggacaactacggtttttttctcactcgtctggtttttttccggtttttttgtcgcagattgtttcttttcgcctttttttttcggatagttacggttttttcgtccggttttttctcactcgttcggtttttttgggcggttttttgacagacaatggaagcccctcttatttttttttaagtagtagtaggcatatttgattaatcttaaaaccccttgctgggttggggcaagggaagaataaaaaagatcttagtactacatgagaactggggcgattttgtctgaatgtttttggtcctgtcagatcctaagcttagtttaaacaatctttgtgtctagatttggacacaagaggccctacccttgtgacaaaaccgaaaccaccacaaccactagcggtaacttttgaccgaaccagagccactcctgactctgcatatagtagtacagtaaaaaggttaaaacaactgtacaggcacagaccggaacaaacaatacttcctctacttactctgtttcacgatataaaactttctagcattactcatatttatttagatattaatgaatctaaatatatatatatatatatgtttagatttattaatatctatatgtatgtggttaatgctagaaagtcttatattgtgtaacggagggagtagttttttttctcactgaaatgattctgatattgacggtgcacacgcactgcaggggcgcacacgatcggggtgacgcactgcgacaagttcgtgcggcggatctacacgttcaagcagcggctggggtacaacccgccgatgaacctggacttcctgcggtcgatgcggcgggtgtgcccgatcaactacagcccgacggcgttcgcgatgctggacgtgtcgacgccgcgggcgttcgacaacgcctacttcaacaacctccgctacaacaagggcctcctcgcctccgaccagatcctcttcaccgaccgccgctcccgccccaccgtcaacctcttcgccgccaactccaccgccttcttcgacgccttcgtcgccgccatggccaagctcggcaggatcggcgtcaagaccggctccgacggcgagatccgccgcgtctgcaccgccgtcaactagcttgtttacgtagtacttgcatatcatcttctgctacttaaaaagtggagtacttagctgggtaggatggtgaaagaaaaacacgtagtagtagtactacgattaattaatttcggccgcagatgcagggtgttttttttcttttctttttatttttggtttctttttgttgtttatatgttttgtggtgggattttgtagccgattctttgagctgagacggaatggatgatagaatggtgctgatgggtgatgcattgttatgtccttgcctcctagtcttggtgttccagcttggtgtggtacacggtgatcgaccagaaaagcactcgtgacatctgagggtttggttttggtcttttggcagttgcagaagttgttgacatcgttctattgtacgcgaataccaccgaaaaagaacgttacatgtgatgtgagtggtattcaccgatggagagaatttggaattatcaatggatcaacgtacgtatagccatgctgcatatgctcacgctagatcgatggattcttctgcgagatgtcgtgatgggagatggaacacactagtagacgaaaggcatatgcaatgcaacagtacaaaacaggcccgtgccgacgggtcgaacatgttacatgtcacatgcgaaaggtacgggaacgtgccatgtccatgggttgggattgcatcgaaacatgacacgacatcagatacacccgcacggaataagttcacttcgtgaacctcaaaagtgatcaaaatctaatccgtgactctaaaccataaaactggatatctcgacccccaaactcttaaaaccggagcaatttgactccctgggcggtttttggatggcggttttgctgacgtgacgtctatgtggtggtattgactcggtcttctttccacatggcattgacgtggcgctcagttggcattagaaataaaaaaaaaagtgtgggacccatttgtcatccaccaaaagtgtaggtgggacccactaacacgtgaggcccacataaaatcatcctccccctctctatttctcttcccttcggcgagcggcggccgtgtgacggctgacgggggccagtggcggcggcagtggtgcgcgggatccgccaacggtggcggcgggagggcaaggcgggtgcaggcgtaggaggggaccctggtgacaatgtcgtcggcattgcggtagtcgtcggctttacgggcgtacgaggggcggtgggcgggcgaaatctcgggaggcgccgcctctcctccctctcttccggccctcgctcgccgccgtcgccgctccggccctcgcccgccaccaacgccgctccagcccttgtccgtcgttgccgccgcctcaccggcctcgcccgccactccagcgcagcaaagggggagaggaagggggagaggaagagagagagagaagggaaggaccggagatggacggagagcggcagaggcaggctcggccccttccaccccggcgacggcggcatcgagcgacgagttcccgacgatttctcttccccttcggcaggcggcggcgatggcagcggtaggcgcagctgccgccactccagctccagcccgtcgtcgtcgatggccgccgcatctaccgccctcgccagtcctcgcccgcccgctcgccgatggtcgccacatctaccaccctcgccggtcctcacccgcctgctcgccgatggtcgccgccgccgtccagcatgagcacgtcgatggccgctgcatctaccgcccttgtcgtctccgctgccgctctagctcccacccgacgatgccgccgccatccccattgccgctcccgtggtgaagagaggctaggggagagaatgagagaagggagatagagggaggaggaaggggatgagagaggatgacatgtgggatccacatgtcagtgggtccccatgtcagtgagccccgcatgtcatcctctgtgtgaatgataaatgaattatttttttaaattctaatgccacctaagtgccacgtcaacgtcacgtgtaaaggatacccggtcaataccgccacgtagatgccatgtcagcaaaaccgccatccaaaaccgttcaggtagtcaaattgcaccagttttaagagtttgagggtcaagatatctagttttgtggtttagggtcacggattatatttcgatcacttttgagggtcacgaggtgaacttattcccacccgcacctatcgcaaaaattcacagctcacatgccgagaccgtgggccgtggaggttctcgtctacaggctgtttgggccgcgggaaaacggacggtgcaatgtaactctcaaaaggcccaatttgagcttaggccatgtgtggcaggccacactacggcccagaaaacggcgttgttgcaggtagcgcgaggttcacaatcaaaacaatgatgaaaacgtgagcggttagtaaagataccaattaatcaccgacgtgagtacgtccgtgtatggtactgtacgtgacgatcccatgcacgaaatccctccacggattatacggcggcgagcccgatcgatccgcccccacccacccacgcaacgtccgtatctgcgcgcgtacgtaccgcctcctctccgcccggccacctacccggccgccgcgcagcgcgcgcgttggcttctcgccaagaacggattctggctgcggaaatacggattctcacgcggccgggtcgcggacgaggacgaggggacgtcgtcccgcgcgcgcggagtgcggccgcccgcggttgcgtccttcggaaacacaccacatcagcatgcataccgatcggcagaaatacgccgcgcatatgtacgtacgtgcgacgccgcctgcaggaggcgatcggcgcctcggtggcgggcggagttagtactgaaggccgtgtacactactgagcttctgatatgggaagcttctttcaaattaatctccagctctcccccaaatagtttagatcaccacttaggattgtgagaatatatagttttagaattcagaaaataaaaggatagaagatggggaaccatcttttttctgattttcactagttaattacttagaagttagaacagctgattcttacactctcactctcctcgatcacctggcctaagtttcttaagaagcatgaatgtgcaatcaattggcctaatttatatcggctaatcgatcaattaaccgatcgatcttgcgtacgtacggccatcgactttcttgatttctttccttcgcaaagcgtgaactagtattggattctagctagctagctactccatccgtcccaaaaaaaaaagacaaaccctgagtttccgtgttcaacgtttgactatccgtcttatataaatttttttataattagtattttaattgttgttagatgataaaacatgattaatactttatgtgtgacttgtctttttaattttttttaatattttttttaaataagacggacggtcaaatgttggacacgaaaacccagggtttatcttttttttttgggacggagagagtagctactacatgcatgatcatgccagctgtgtaccaaacagccgcaggttgggcggcctctttctgtgaaaatattgcatatttgcatgagcatgacaattaccgaccagacagcacccaacatgtccttcaattcaagtatagatagcttcagatcgaggctaaaccttgcctagctaagctctcacatgaaccaaccatgcattacagtgccttgcagagagctgcatatgctagctaaattgcaaacgcaagctacgtacgtacctgtacaaataactgcaacaccacgtacgctcctctaataattaatggtgccaaatgaatctgctagtaccagaatataaggtacaacatacataataggggtcttactgttgatctggcattcatatgcctagctctcgttgcactacttcataaatgaggccaagctagctgatcgatcatgcattaagcctcctggggttagttgtgtgcataagtcaactttcaacaaccgggtgcccgtaaccaaattagcttcgtcatcgatcctttgtaagttccacggttaggttgatgagccaaaacaatagccaattaatatgtaggttctaccttttcctaaaaaaagaaacagatgcagttggtaagttatatagagtgaataagaaaccggccgcacgagctgcttatatgcatttgtagctgcagatgggtcttaagttttaagtgcatcttagatgtagatgtcggggatgtatattctatcttccaaactctcaataattaagtacatattcacacaaaaattgacaaaatacatcaatgcgtttgataaaaggcaattatttatctagagaatatcaatttcactaattattttttaaaaaacacaaacgcctgcccctttaaatgcacacacgtataccatatccgtataaacaccttgaaatactaagtcatcatatcctaacattgacaaagtcactatagctgtctcattggcgatgcatacattgcctacaacttaaaaataattaaccataagtacgagcaccactgttaaatttaggatttaatcccgttgtatttatatccgaacataatatttgttctgttacccaaaacaaatatatagtacagcttaattagttgttttctaaaagcaagtacgagtaactatgtacgaaggacaaataaaaagggccatttcccccctaccctaattgcattttataattccgtttttggatgaaatggttgcatgcaacttaataaataatgttggaatggatgccggacaatgtcaattaaatagtaacgagcaaaggatatgcagtgctagatgcgctgtgtagctgacgctacctcatgaagtcatgatgcgtcaatgatcaagttttaagataagttacagtaccaggtctatcgttagtttacatagatgtatcatcataaatagtagctatggatgacgtcaaagagagcatgggcatatgcatgcatgtaccctggatcaatatttccatctatgtacatatatgaacgaccttagccgaggataattgatttgctagcagttacatgatcaaaaaatcctgatcaaaggatttattgttttgaacccgtgatataaaaacaacaatttaattgttgggagacaatattgcacttaaaactcatgtgcaatttaccttagagaaagtaaaggaaacacaatatcattaattatcgagtaaatttcagaaaactcatgtttaagagtcaaagttacataaagcccttgatattatgactggtggctcataactccagtcgctaggtaaatggttttaaagtttcacaaaacctcactcctatacatgttgagcacaaactcaattacttgaatttctaaaaagtagtgaagagtaaaactatcagtataacttcatatgaaatttttagttattaagtttttactaaagctgatagttttactcttcacaacttttattttaaaaaaagaaaatccaaatatgctgaaattaatcaaattatgaatgacggcgggtttatgaaacatttaaaccacaaaaccctatggttaaatgccaaaagtcataacacctgtggtattttacaattttgactataaaacgtggggcttttaaaacctcactccttttacatgtcgttgtaaatactaaattggaaagttttgtgcagaactggctagctttaggacatgtcgtagtcaatcctcgagtacaagtaagttcaaatagaaattcgaatttcctctaacaaagaacaaattcaatttaattcccgtatagtagcagttagaactaggaactttagccgatggtttggtgtaaatttaactggactatttctattatattgcttgtggttatttttttccattgggggatgtactggaaacatatgttgataataatcaattgtcgtaaattgatatgcataaccggataaggccagatctaaacattttcatcagattcttagaatcctataaagataactccagtgagtgtgcatataattagttctaaaaaaatgtagtatataattaatagagatgaccctgaagatcttatagtcttgatccgtgtgtgcatccatgcaacacatcaactatatataaacattttgaatgcacctttggaacaagttatgattaattgtaaaattcagggccatactggcaatggtgacgcctatgggtgccgctttccccttggggcgttgctgcatttccttccctctcccaatgggttctttaggtgaaaacccacgtcctggagatacaggacgggcgatggcggcacacttggcgtcgttccctccttggaggcgtcgttcagaagacccattacttaggggtgctgtgtgtttgttttgttctaacagtaggattagacgtagacatgtggtgtggctgtattttcttttttctggctatagtcttccagggatatagacttgtatttttttcctgctctatcaatagaaacgtcgcactattttgtacgggttgtttcaaaataaaattcagggccatacgattatgtgatttgatcatgtttggcttccactgtaaccatgcgtccaactaaattcagtgaatgcttttgataaatgataatataattaaaatacaatgggatatttgtcgtcatcagatcatggatgatgtatagtaaatatctcttctggcctaacttgtttattatatacgaccatgaacctttcggttatcgcatcccctgcgtacatgtgtatgtgccttgatgtgcgccctacgttcaattattgacattagatatatgggtatataagacaatttttatggaccatgatggacaatgcgattatatgttcaagataacaaagagaatcatgtcgcggaaaatagcaaagttaagcaaattgtgcgttaaccttgcaaagttaacaaattaagttgtcaaattcttacatgtacagctttctttccttttaatatatatgaaatttaaccgtggaggcttcccccactgtttttccggtaaacaaaaaattaacaattcgtcatgtatttagactatactaaaattttctcgctgatgaaaaaaaaggtagtggatagttgttttagagcgccctatctagttatatgtcgactataatattaaaaatataaatgtctatttatttcctgatcagggtatatccatatattacaaagatatgtagatcattttgtacatatatatgttagagtgatgcgtaattcaattgtataagacatacaattttattttggaaataaatacaaaaacaatagaaaataaattaaaactatatatatatagtcaaagaactacaatatctagccatgtgcaattgcacgaaaaattcaggtagttatgtagaaattcgtacaactttcatgtggtgcattcttcctagatgaaattaattgaccaactagcctcttgtggcaccaaactataaattacactaaatttgatgtaccggctaattaaccagcttctccaacgaggaaaactgccagtacacatgacaataacgcataagctatcattattatatccaaattacagtaattaatagagacaagatgaaaagagatgtctggacgtacacacacgtacgagggagagagagagagagagagagagagagagagagagagagagagagagagagagagagaaggagagatcgagatgattgataaatattaattatactagtgatcgaagtcgagatcaaacatcgcctgtccaagctgaaggatgttgctgtgttggtgatgctgctgatggaaggctaagcttggttcttgcacttgagctatatttgatgtgtcagtgctcgagacagctccttggctctgagggaataagcacgagccagacgacgaagggaaagggaagccatgctgctggtggctctgctgatgaatcccatgatgtgcttgctgctgctgctgctgcatcgatgccttacctttgggatctacagcttctttcaccacctctcccagatccatggcttggtcttgatctttggacatgtgtgcaccccccagtagctgtgtctcgaaaccgtctccaatgcctgcgttcttgctgctacttcctgcttctgtcaattatgaaggaaatggtgtagaatatcggttaattatctaggaattgaacagattaagaacccattcatgcatcatatcttaggactatctaggaaatggtgtagaatatgttatattcatgcattttcaggtggttgagatcatgaatgaaaatactgaataaagagagagagagagagagagagagagagagagagagatatcacgcactgtctttagtagctgccgatttattcgcctgcgcccttctcttttcaccagaatgctcgccgtcggacggcttcgacttcctccgccggcggttgtggtcggcgagtcgcttcctgcagctcttcttggcatcgtcgaactcatcaagaagatggaatctgaataattgaacaggttagaaaaggttaacatacagaaatgagagggatgcatgcaactacgaagagctgaagacgaatacacatgaaatactacggtacaacgataaaggatatggaagatgaagtactacttctacgattgagaagcttgttgcatgatcctgcatgcatatttcctacataaacgtgcacattagcgaagacaaaatgacaggttgctcaggccagatcaaacttcagttcagaagaaactactgatgaaaagaacattctggggaccaatatgtaagctaatgatgatcctgagcacgagaagcacatacacctaaactgttccatcccagagacagcttggagttttgcagctgactcatatggagtgtttccatatggtgtgccatactgcaaaaggttcctgttttcccttaaatgcattgctgagcttaacacgtgcatgcttaggaggcatcgaaggtagtttcttcttcagtttctcaatcaatccgagccgttcatctcagtgaggtaaatgttactgacggccggccacacattcagggtaaaaaaagaatgagagagagagaaagaacacgttgcttgcaaatgcaacttgtgctggtacgtacatatgtacgtgagcgggctgtacaaagtctttgctatacttgcaaagaaagtcgcattgtttctgactttgtgaggccaaaatacatgtacagacgtctcgaatactgttggaagtaaccactcaaacatgcgaaggagaagtcaagaaaaataaatgggaagggctagtttcaaggaacaataaccaaaggaggagaaaataagcaactctatctaggacaagatcaatatgtatttgtacagatattggttattcccccccaagtcccagcatgtgatagatagtgatcaggattcaatttaattaaacagaaatcaatattttgaaacacaattttctccaaagaaagatctttaatttgaaacacaaagaaagaaaaagatggcatatgaatctctagctcatcacctgggtaaacctagaaacatgcacgcatactatttgtaattttgttttgcaaagcgaatgaacgtttatgtgttcagaacagcgataattcaaaatttatatattgtgtccgaacagattaataactatagtacacgaattatcttaattagcctgcagtgtaggcaataatataaaatgggtgcaaaattttctcctcaccatagctaattgcgaaatcggctaaacgtatatatcaaatatgcagcaatagcttgctaaatgcatccaatttagctcaaatttctgagaacagattagggaattgttcatcaaaaaatactagaaatatcagtttaagcagttaagaatcagataattgtataggaagaaatctctctttcaaagaaatgtaaaggcaaggaaatctgggcaaatgtagagcaagcattgaactgctcatgggttcatgaggcaaggaaccggaagaactcaggaaaagaggccaaagatggtaccacacatccaattaaagttcaaagcaattgccgtcttcaatttcatctgactgttccaactaacgtaattactttgagggcaaacaggcggctaatgatgagctgaaattacttgtatgaaaaaaaaagaaaagcttaaatcctaggtagttaaattaggagatttattattaaagtttcacccttcgatatgatctcaatagtgagcagaatggaacttccagatcacttaattaatgcaactctctgatcctacaaatcatattctccaatcaaattaaacacgccgcaacaagatgtgtgtctcattaattaaaccaatcaatcggacaaagcaaattaaatcgggccagcatcctcttctgggaaatcgatgaacagtggatcggagaatagtgaattcgagcagcaaactaaacacgacgatgaacactgacctgctgcactgctggcagaatctctggtggaggccgccggcggtgacgacgacgggcgccttggagtggtgctcgcacaccttgtggcggcggtggtagcgcttggcgctggagaggtcggccttgcagccctcggcctggcaccgcggcgggtggtggccgtaggtgtagccgcctctcggcgggaagtaggtccggtagccgaggttgaggccgagctgggtggcggcgaaactggccatgttctcctcggcggagctgaccagcgtcgggaagtagtactccggcgcggcctgcggcggctgctggtagtacgactggaaggtgctcccggccgcc

SEQ ID NO: 17999 - DNA, 8437 bp, Oryza sativa
  unsure (1)..(8437): unsure at all n locations
ggtggcgttgtagccgaaatcatcgcaggagctcgcggcagcggcggatggaacgttcatcatcctcgcggcctgtctcctcctccctcctttatctatccctcactactcacgcagtcgcacacacacggaaaggactaggaatggaagagaggacgcggcaaggacaccaccatcatcctctccatcgatcgagctcgctctagctaacagggctactactcgatggatctcttatatcagcagcgcgcagagatggatcgcgcggcatatgccatggttttgccctttttcatctatctagggttcgggtggatggatggatggatcgagcaggagggcggctggatgtggagtgcgttgccggctagctatatctagcagcagctgcctgtctgcctctggcctctctcgctgatgctagggccagcaacaaaccaaaccagaagagggagagagaagagaagggcttgggttggggtggccgggagctatcttaattggagttggtgagggggtgatagctgctgctgctgctgcggcctctgctgctcccgctttatgcttggccaccgtttttccattgcttccatccgtatattaggcgtagtggtagtagtagtggttgtttcaacgtatggtacgtcactatagcatgtgtgcgccttgaacaatgcaacaggctgatcgatccatgatatatggatatcgaccggccagggttaggccttgcttagttgggggaaaatttttgggtttggttatcacatcggatatacggatacatatttgaagtattaaacgcagtctaataacaaagtaaattatagattctgccagaaaactaggagatgaatttattaagcctaattaatccgtcactagcaaaatttactgtagcaccatattatcaaatcatggcgcaattagatttaaaagattcgtctcgcaatttacacgcaaactgtgtaattggttttttccccacatttagtactccatgtatgtatccaaacatttgatgtgatgggtgaaaaattttttgttttgggaacttaaacaaggccttagtagcatactcgctttattccaaaataaaacaacataatatgaatataacatatcttattagtacgaacctaaacaaaatatctgacgcatatgtacatcataaatatgatcgcacgcgcgcaaatgcagtgcaggtatgtgcaactagtggcatgtagtagcttgtagcatgtgggggatggagaactgaagaaggttgtagctagaagggggggggggggggtgttgtgtggtgtacgtacatggcgcttgcgccgtttttgcgtacgctccgtgacgccgggggcgccggccgggccggacggttcccattcatgagatgtgatctcatggacaggtacgtacagaacggaggacctcatcacctcagctaggagtagcagcagcagcagctagctagctactcttccaatggatcatatcatccatggctaactgcagctgttgctggtggtggctccatcggagtgaggtggcatcgcatcgatcgatacatcgtcccccagatcatcgcaagagccctcccatttccacaaaggataattaatcttgatgatgatccagcgactgctactgtatttgcgtaaagaggtggacgcgtgtgtacgtacatgtgtactgcctacccgtcatgcgcgctcgcgctggctctacggattacggctctagctagtaattcctttttacagatgggtatgcaattaagtgtgtctttgcttcctgctcgatcgatctctagctgtaaatattaattaattagttgatcgatcgatcgatcgatcgatggatgagagagtatatatcgtgtcattatttgggcaattaatcgaaagtttgcgcgtcaaggcacttgcaaacatttagtgctgccaaaattgcttaggcgtgcagccttcacatgctagctagctagtcgacctctgttataattaattgacttggctaattggattttaagccctgaattcagaccaaaattggaggaaacactgtcgcaagaggtttttttttttggtgtttctttggatgtactgtatttttttcagaaaaaataatttaccgtatcttcagacaccaagaggttgagactattatattttaggatggatagagcaacttcccaaagaagcacaaaaaccttgtccaattaacatgtcatttggtcaaactaacatatattaatgtgttgtttgattaagtttttttataattcttatagctttcttcaagagactagaaataatctaatgatatttaaattatgatcaaactgtaatatacaacaagggtaattttactattattgagaaggtactgagaattttactatcactaagaagatattgagaggcatcatattttctagtataaaaattgataccttcagatactagatatctcgaggtactaaaatttttaaggtcaaatttaaatacttcaaaatattatttttaaggaccataaaatttctcatacaacaaaggaagcccaaaggtgagttcaatgatccatagactaagaatcaaatcttcatggttgcaattacgtgcataggtgctcttctaatctttatacctttaaacgtttcttatggtggtggcggtaagatagatttaccgccatcacccattgatacttgggccctataaagtgaaccccgtatagttagtacgataaaatttagtaaggttaaaaatttaacatcggccgttacgtttttttattaccgtgtgaaaccttacacattgatatattaattagcagaagaaagaaaaacttgtacaactacaaccagttgacctgatcgtggggttacacatagaaggtgaaaaaacagacacagttaacttagagaaaacaaccccaactagacagcagagtaaagagaaaaaccttgtggtaactagtaacacgtgagtttgtgcaagcggtgtggtgtgctcacatgcacgtcagcacgtgtctttcattttgcataagttgtactacacaacagggaaaaaacatatacagagtatctgcagacgctataatttcacaatgaagtcaaacttcattttaaataggagaaattggcgtgtgcgctttatctagcttcatgataacctgccacgagttcttcaatatttacatatttaattaagcaagctcaagctaggtttataattgtactttatgtaaactaaatatgaagcatatatttttttctatgtttttcaaaaaagattactaatacataattgcattccatggagaaataagcattctagccatgaaaaattttatggtcttaattaagaggtaccgatcgagatatatcaaatatcttaattactagcttaaatgttacacctcctatcacccaaggtaaaacgagtgacccaatgaaattggtggaagaaaatgtccattttacatttttaaacttcaccaatacatttaaccccctaaactatttttttcttattttacactggactaatattatttattccatgatagtatttctaatttttctcctccctatataagttgttttttccactaaaatttggtcgggtgtagatagatgtattaacttatgccttactagcatttattagaattttctctctctacctaggttagaagcacctaattaagattgatttaaacattgatattttaaagctcatgaaacaataataaaatttgaaaatattttaaactttgataacggcgctatctgtggctctacaaatttacagctcaacatataacttctacaaagagaaaaaaatagattatatccagtcaagtgaattccggcgtacccatgcatgggcgtttgttttttattctttttattacatctttttgaccggagtttaaaaaccgaattgttcataagtgccgtattatttcttgccgagttggaaacagttacaatctcgatcgacggaatcattgctggtcccgaccggctactctcgctggctcacatattccatgcccctactcatatacaatagcagactattagctagctacaaacacattttaatgagataaaagataagagagaagagcagcggactatagatctgtagctagctacagtatggactctaagacataatatgtgtatgacaggtgagaccatatactaatagtacagtaagcaattattgtatatatgaattggctattagattggctatagataaattggagctagtagtgggctatactatcaaacttactctaattaggccctcatcacgaagtaatttttccggccaagttggttaattaccacgtactgctccctttttacctcactgccctgtacagcacatatatatatgtaccgcatccttaaattctaacccgtcaactacatgtatgcgtgtcgcaattaattcttaagatcgtacgtacccaattaacttacgaccgattaaaatcgacgaggagaaaagaccaagtattacagtattattatattattttttgcttcccgttcgatcggggcgtgcgcgaacgcgtacgggcgcggcggcgaggacacggcgcgcgcgcgtgatctcggcggcgaggtttgctcactcgctgcacggcgccggccggcgcccggacgggtcgccgcgcgcgcgcgacgcgacacgccggccggttggggagacgggagacgacacgcacgcgcgcgcgcaggcatgtgtacgcgcagtcgcgcgcccgatcgatcggtcgtcgcctctcgtcggctcgagacgtacgtacgcgccggccggccggtggaatgcccggccggccgccgtcgtcgtctcgcgtgcacggacatgatcagcaagcaacgaaacggttattaattggctgtggtcctcatcggctggtctagttttattataaaccataacagcttaatacatacttcctccgtcccaaaatgaaaccatttttgaggttggcacgggtattaagaaagtaagtgagaatgattggaggaagtgtgtgattggttgaaaagaaaaagtaggtgaagaaaaatggttgtgattggttgagaggaggtaggtgaagaaatagcttcattttgggacaagacactatgctagaaatagctacattttgggacggagggagtagcgattaaaaaataatatgtaagtaaaacttttgtatatatgtttttagtgattgaaaagctaaagttgaaaaaaaaactatattgaaaaggaatcaaaatcaaatttaaaatcaagtattaaaatttaatttttggttttggcttataagccatagggtaaacgatgagaccctgtatctgtatcactatacatgcatggctgaattaatcagtcacacacacatgtatatatatattttccaattgttaatttcgcagtcatggaaatcgatatattcgtgtttcgcagtcatggagatctacctgatatataccccatatggacaaacaggcaagcatgcatatggtatagtggtacagtataatgagatatacgatctctggcttagctataagtaacggtggtcctgcgtgacctaatatacgctcatttatagcaacaggaagtttggctagtggcagaaggaaaaacaagctacacaattaatgcaagagaaagaataattttcactggaaattattggaggccgggttatatcacaacagaaatttgttgatcatcagggggcggtccctagcttttgcatgcaagaaacgggccccggttccccccacgtatagtaaattgtacgttgtattacatcccttgctattcgtcaaactattgaaaaatccataacaatttcagtcgaatctgctcaccatctatctttccaaaagagacatgatcccggagatggattctaatcttccgggtggacgnncacccgtntcttgcatgccgcctaantcatnatgaaaaaattctaaaaatatttataagataggttaatatataatatatcatctcacaaacatgcaagttcaaattcgacttttacaagttgtaacaaaaataacaaattaaactctaactagtatacatatattcacattcaaatttgttattttttttacaatttgtagaagtcgaatttgaactagcatgtttgtgagatgatatattacatattaacctatcatgtcgaaaatttttcataaccatttagatgacatacaagaaacgggtggacgtccacccgagtgtttaaaacagtttcccacatgatcccatcgtccttagcagtgaggccttctctgatgacggtgacggtgtgccatattagggttcgagatggaaaagtggttgagacagggggaagagagggttttccggtcataaagggatggtcggatgacagcggttcgcacgagatggtagttgcagttgggactgtagtgcgcgtcgcctcaatgttttgagaggaggatagtgcaccgatgtcggcgatagggggactctatcagagtggttaggaggcggcggatctaccgcctcacactgcttgagattgtggaggagaggcgaggcgaggcgaggaaattgatgtaggacttcaggaaggggacaatggtggagagactgggagtggcccatgggcctttctagggtcggtgcagcaccattgaggtggagggcaatggcacactggtttgagggagtggcggcaatactggccgggtcaataagagggagtggttagatatataaagtgttgtacgaatcttgaatagatcctaatcaatcaaaaacgttattactatttgaaagaaaaacatttgattggtaataacatggtaacatgtcccatgtaattttttgttgcgaaacatagtaaaaatggaggccccctcatatacacacacctcatttttcatgagcacttctgatagtttagagggatattttgagattgacaaagtcagtgcagacgtctcgtcgtcttgatgttaagtgatacgttacctacaactgcaaaaaaaaaagagctaaaaatttaagcacccgatttgaaattgggtggacaagttataaaaaaaactaactagctgagtacactctgaaactcacaaaattcaagtgatctacacggagcttgcccttgcattggggccgaccggctacacggtgagtttgagcagggtgtttcttttggcatgcaaatgacagagtgaggcccctacctgcaggatcagtgaaagattttactttctgaaaggcaactacaagtacacagaaaagcagagatcgtaagaaatgttgcatgcgtagctctcagcagagcattggcatatattgccttgaccctatgtcaatactaggaattctcttcagctagttaatgaactgaacaaatatatagctaggaaccctaattaaggggatcgaaaggtcccaaatgagattaaagatttagtcatcgaaccaccgaacatttatacacattacgtagctatcccatccactagctaggtaagaatctgtccccacactacattggattattgatctcatcacttgatcaaattaagattcttatagaaattagcagatactactactgtatatcttttgacaataagacaaatatccattccccactaaacgtaccgtcgtgataaagatttctagctactatacgtacgtacgactagctagatgtataccagctatcatggcagcatgcatgcatgcatgtatcacatccatgtatatattgtacgtacatgtaatttatgtatgtgtacgtcaaggaagcaagctagtatatacacgtacaaaaatattcatggctcaagctgtcgtcctggctctcgaacgaacagagagtgtggctggcaaggcaaggcaaggccaatgcaaagctagctagcagcagctagcatgcatatgttttttttttcagtgcatgcacagctgatctcagccggccacctatccaacttcactgtggcgacatcactcgcattgactcatgcacagtgcaaggatctcacacatagcagtgcacattaaaaagacaggccaaaatcagcttgtctgcatgcatacatatcggctctgtcaggtcgctatccatgtcttctgcgctccacatttgaacaatcctgcttcgctagattgcatgcgtgcgtgcatatatgcagtatatgctgctgtggtagctagcattcatatgcatatgcatatgcatgcaatgcatgtatgtatctcggcagtcatctcatctcagactccatcagctttaggtacagtgatgcatatatgtgtccatgtatacaacacataccagtatgtataattaaccatatctcggtgtgtatgatatcatcagagattcagaattcatcagggaa

SEQ ID NO: 18000 - DNA, 7914 bp, Oryza sativa
  unsure (1)..(7914): unsure at all n locations
agagagagagatcaggcctcgtgtcgtacgtcgtcgtcgtcgtcgccggctggagtagcatcgcattggatccgcacgcattcatgcacgcgcgaccgttcgatcgcccgcccccgtgcgtcgtcgtacgccatcgcgcgccgtaccatgcataatatgccaggccagccagcgtagtacgttacgacgatgcgagtacgagtgtgtgtgtgtgtgtgtgtgttcgtgcacgtaccgcgcgcactgcatggccgcgacgaacgacatgattctatggctagaagttaagtgaggagataaatggttattattatttttatatctgatcttgtagtatgtgtgtgtgccaggacacgcgcacggccgttgtcgtggttgtcgtcgatgtgatcgtgcacatagccgcgcgccggccaggcccaggaggaccagcagcacgcacggtacgtgtacgccgctttgacagtttgacagatttagggtgcgctcgttcccgcgggcaaccgcccccgctactagatcgtttttcgctcgcacgcttcccaaactattaaacggtgtgttttttaaaaaagtttatatataaaagttacttaaaaaatcatattgatctatttttgaaataaaaatagctaatacttaattaatcacgtactaatggtctgctccgtttttcgtaccggaagggattattaccgtcccttactctcgatcgaggccttaatttaagatcgatactgctccgtcccaaaatataagtattttttgacggagagtagataataagtccacggtttcgtaggaattccggtagctagctagtttaattcctgcaaggaaagaaattagtccctcctttttctaaatttctaaattactaactttgacatatagtagtttcttaataagaagtttacagaaaactatataaaacgctgatgaggtttttttcaacatttagtcataccatttaagagaaataagtgatcaaattgtcagttttatgcacgcctatacccaacgttccagagagagagagagataggatttgactaaattctttttttaaaaaaaaattgtgctttgactgttgtcgttaaatctcgtacaaacacatatgtagaccgttacgttgatcgttctttctgcaatagagtaatttcacataatacacttcgataagttcttttattgcagtgtcgctctttctacaatagagcaattttacaacacatacaactaaaagaaaacactttgtgaagctcttttgttgcaatatctagtaccaaagcatgggtgcacccaaaaacccggcaaccttaggtcatcggttcaattcatcgatnggctgctgttgttacttcctatttcacagtgtgcagtgatatttttaactggacacgtctatttatctaggttttattgtttttccaaaattacctgatttttcattaaaaaagaaaattgtctaattgttggctatgtggctactggatactatcatcaggctaatgaatttagattagagtacatataaaattagactctggttttttgcacccctgcctaccagctggtcagaaagccccctctctgagcagcgttcggtgcaatagcatatcgatctcaaactgcgagaataaagtacgccatatttgaccaggattcgatcgacacatcacacacgcaccgtttgcaatataaatatgcaaaagcaaagaacgacccgtatatgcacgagcacgaagcaaagcaacgtcgcgtcgaggtcgagccgccggaaccgccggccgtttggagcacaacatttggctttttggccagcaggaggacgcgcggtgcgtgtgggaggccggtacaaaagaagggggagaaaatgctgggacgcagcagtgcatgcagcgcaggcgcagcgggtgccagtgcaatgcatgtgtgcgcgaggcctggcgttcgactcgacacacgtcactttgttcgggccacaactgtggctcatgtcaccagacccgggattgtggaagagcctgcccctgccttgtgtggtccatggatagccaggatcttctgcgcttccggtctcgcgtggccggcgcgttggcggcggtacccaataggcttagtttttccacgattatgtgtttctggatgaattcggcggaaatgtgaaaacttatatatatgctttgggggcattaaatatcacaatgaattgatcgagatatgttttgtgatcttttgtaggtacatagccgaccattgtcagaacccattctcaaccttacgagtcgttgtcattttgaattaatcttaacactatacgctttgctaaactgatatagacgtgtaggctcatgtcacgtgctaatacctaacttaagttttcaaacaaaagatttcatattccttgtctatgtacaagactttgggcctgtttgagggagcttaaaattcgaagaagcagttgattggtagccagcttctgagaatctggaaaagctgggtttcccagcttctggctgctagttcattttctagattctacaattacagcttctcaaatctggaccaaaagctagactgttttggggagcttctgattttaggagtagctacagcaactagaagctcccccaaacagacgctttggatcttttctccatgcgcggtctaattcgaattccgcactagtactactcttactatgaatatggcagcataacataggcgacgcagacgatccgatgtagccgcaaactgccgtacaaagtggcagtggcatgaaagaccacgtgtgcttgtccatggcttgggctcggatgcaatactttggggtgaacagagttgctcagggtaaaaagcagctggtaatagtaactgaccagggcagacaagagcgccgggcccaccggtcagttaaataaccatcacttgttaattcttctatttttggcatgagtaccaaggcaaataggggaatagtcacattaaatagtgccttttcttaatcaactatttggtagcctgctgtacattcgatcttcctgcttgtggcgttgttgcctcctttttttttttcctttccttcaattctctgtgtttcttttcgtccacggtaaaaaggttaaagaacaatccttagcctgccacgacaatgtagtaatttcctataattaatgaactagagagccaagaattcattaccagtagtaatgtagtgcaccaattaaacaagaaaacaaagggcaatttcttccacatgatgtacaacatcgcattgattaatcgatttctcacttacataacttgtcaaaacatattgatttcaataagtgttaaaggacgtgaagattttccttgtagctgagagttgtttttcaagccggtcttgcacaattttcaaaacgaattaaatccgaataaatctgacctttcgccgcccatccttcttgatcgatctcctaccttttttttctttgttttttttccaatatacctctacgagattaattaattaagtgattcagggaaaacaatgaactgaatttttctctgcaaaaacagcatttacagagccataaattggatcgaatgagacaaactctatccaccaaaacctgattgggatcgctgtgccgtccacgtgcacgataatatactcaaagttgcattgagcattgagggtcaggcgtttgcaggtttcagaagcgcatgcatgcgttgcagctgctctgattcgaatgagcgaaaaggcagcacagcacaagaaaacccccttgagtccacaaatctcgaatcaatcggcgcaaacatatcgcccctctgatcaaccgatcaatctcgcctctgatgcagcttacattgctggtcctatcatcccaataattgtttcaattttcggcagcttttgtgcgatagatagatagatagatcgatatgtaggggaccgcgagcggctcgatcatatcatatcgatcggccgggtactgtcactcttttactccatttcactggtacagacacatgtgaactgatcaactgaacacaagtaaaattaaaatttaccaaggtttcaatcatgcagatggtgatatgggcaatatgtagatatattgttgaaattttgatcaccaaggacacgtcctgaaagtgagcagagcaggacgagacagtggtggatttatatgcagcaaccccacacgttttcgagaaactttcagagaaataggtgtttaactttaacaggtcattgtgatcagtgatcttacacccaaattaatacatcatacaagattttcatgtcattgaggccttatgctgcctgttattcctaattccttcccatgtagtactactggatcagtactccttgagtaatagctagtagcatgcacagcccggtcatgactcgatctggccctccatctatcacaatctctgacgcagcatttgcattggtcagtatctggactcctttttatgattatgtcccacttgtccacattgatcataccaggtcaccatcttcatttgcacctatagatcaccccctttataattaaatatcgggctagagagtacatagtatctattatcatcagggggacacaatccatatagttgcttcttcttccctgttcttttatgttgaatggctggtgaataatgtgtgataattatttaaatgaacaatgaatgaattatctattataaaattaaaaaaatgaatttaaatatatatatatatatatatataattttcttaaaaatcatatgttcaaaagtttagaaagcgtacgcataattaatccattcatatgttcatcagaaatgaacaacagtgccggacctactgggggctcggtgctcaaaccccctttcattcattgcgccatggcaataagcttcaatctagagctggaggatccacaagtcaacaagacataagttgtgaattaatcaccagcctcctactacagatgggtaattatccaattagtccatcttatttgggttcgacttggaggcaacccataatcccatatatgaaaactactgaattatactcctactcatttactctctgtccatatctttaaagtgggtccagtaaacctcttaatacttcagtactttatttttttttcttgtcgttactccctcctcctctttgttttttcccttcttactttggctgtgtttaattccacatcaaaattagtagtttgaagaaattgaaacaatatgacgaaaaagttaaaagtttgtttgtgtagaaaagttcgatgtgacggaaaaattagaagtttaaagaaaaaagttgaaatctaaacagggcctttctctcagcattaataaacgacatagtagtcttttatatctcttgcttaatctttttttgaccactagtggagaaaccctttgtactcccggttcgtaacccccctttagtcccggttatccaaccgggactacgaatccgggactaaagatcgctatctttagtcccgggtgaaataaccgggactaaagatacctatctttattcccggttggtgttaccaacagggactaaagagcgggtagcggcagtcccattaggtctccttttctttcttttttttcgttattttttagccagagttaatccctgtattttctcccaaatcgagtgggatgcatattcccaaatcaaaccccaaatcaaagtaacatcccaaaacattcacatcacaaatcttaagttacttgtacacacaaatcaaatacatcacaaatcttaaaaagattacacacaaaccaaatacatcacatattatacatatcagatccatacaacaaatcacaaaattatacatctcagtgaatcacaaattataaaaaaagaaaaaaagaatggatgccggtagcgccgcctgctgccgctcgctactcggcccgtgcgcggcctgcgtgcggccccgccgggcagggccccgcctgacacgtgcgggaagggaggagggggaggagagggccgggatgggaggagcaaggggaggaggagatcggatgggaagggaggagggggaggagagggtcgggatgggaggaggaaggggaggaggggaggaggagagggcgatggatctgaggagaggagaggtcggttgttgaggagattgaggccggttgtgggggagagaatagggaatagggattatatactacgcgtgagatataggagatctttagtcccggttaataataccaaccgggactaaagtggtgatctttagtcccggtttgtgacaccaaccggaactaaagatccctgcccctctaataagggactgacatgggatgatctttagttccggttggtattaccaatcggaactaaagatcgtagaatggctatggggttttaaactgggactaaaaatcatctttagtcccggttctttttataaccgggactattgtggttttagggcgactgagcagagatcagtttttcagtagtggactcgctaaaactacgctcttttagtgacggacggagtacttatcattctagcaaacctcacacaaaccaattgatatatggtagtttacattgttactctcattataagtacatcccattagtttttccaaagcaaataagctaataagagttgtgactgcattcgtgaagggtagagaggggaagttcacctctaaaattatgttggaaacttggaatgcaagaatgaaaaatattttgattaaaaaaaataaatgctaggatgataaataatatgaaacatatagagattgtcttcttttatttgggatacaggcataaacaattaatagaaagtttagtcgagtcaattcaacgagcttaattaattaactcaaaatgtactaaacataaatagtcgactcccaaatgatcttagatatgcggagtaggccagtaggggtttttttttcttgataattctcggtttctagtacttaaaaaagtgttataaaacgttggtgattgggatccatgggccggatcaaagatgatgagtgaatcagcttacaattggacatgaatgcgtagtaccaccttagctaccaaatgtcaagatctttagctgtcgtgtaccaagatagtagctacacacacatatgacatgccattggctcttaaatatcatgaataatgtagtgctcgtagttactaactagctagatcctcggcatatatatatctgtgagatggacttttatgtgaggtcgacgtcttaatcaaatgcatgtacgtggacgtacacacatgctgagactgtctcaatttgttatatatatatatatatatatatatatatatatatatatatagttgctagtcgttaagttgtagacaggaaattaacaatccatacatatgtagattggacgctgatatatacatcaaaattaaaatgctgcaattaattataggatcggagctatcgatcgaaccaaggaagaagcagacgacgacgcatgagatgcaacgacgcatgcatgcacgtagctgcgctgggctggctgcggggttgcacgatcgtggcaaaccatccctgcacacacacccagacccagcagcagcgtacgtacgcccttctctgccactgctggggccgggggcggtgacgatggagcccacgcagagagacacacaaaagccgcgtcccatcgcacatgcatgcaatgcaagcctcccaacagtagcaagtctcgtcgacccgagtggttgctttcatgcatgccaggacaaagctacccccaacgcaaaatctcgctgcaaaacacgcacgctactgctcccccgccggtcggtcgtgttatatccgcgcacggatgcgcccgcggttcaggccagcgcgcgacaaaaacccaccgagctacgct

SEQ ID NO: 18001 - DNA, 7639 bp, Oryza sativa
gggggagcgatcacgacgtttcccccgtaaaaacactggacattttgcagcgtacgtcgcgcgaccgagcgagcggtggcaacaggcgttggcgccgcatgccccgcatgtgatgtgtcgcgccgcgcgcgtcgtgtgtgaccgatcgatcgatcgatcgcgatgcccacgacgggaaaacgatcgatggatcagcgagctactcactccatccctaaatataaaaaattttaattgaatgtgttatattttaatacaataaatctaaacaagaattctctatcaaatttattgtaataagatatgtcacatctaaccaaattctctgacggagggagtagctaggaaaaggccggtagtgtatggctgctgctgtacgcggaacaaaacctagccgaaattatcctagctctcagctctacgacggcgacctttgcccatgccctatgcggagctagctaggccggccgacatgtatatgagcattttggacgactcgttgttataacagaaatgatcgatctagcttgtcatgcatgttcgatcgttgctgcagaggacgacggggacactcgtgctagctagctgtaagcatggatatacttgcttaccgtaccatcgttcaacagtgcgtgtgatgtgcactgcttcagtcctaaaatattattcagaggggtcagtgtctgcacgtcaatatatttacatgcattcatactgtgttttttcttaaaaaaaatgattcacaaaattaatcctaataagacaaaaatagtagctagataggagaactgaccaaaatttgcctattaattaggcaaattttgatacaaaatattgtgtctttatggttttagctataggacactgcacgtcatgactttttgggagaagacactatcaaaacatgaaaattcgctgtaggattccatacccattagaatattcttttcggttcaataatagaagagagaaaccatgtgaaagttctaaaatacctctagacctacgtgtcaggtctccatctcctttctctctttctctcagctctccttcgttttcggccaatgagcacacatcgcaaatggaggtagctctgccaacgagtgccaaggcaacgcagatccgtggcgcaggcagcaagacggggatttggtgcgcttcaggcaagcaccagggcctttgcgatagatgttctagggaggcaatgataaggacgttgggtaggacgacgttgttggcagcagggtccccagatagatctagtcatcacggcgaggttgacgctggtgtagagacccagtcgacaagctcctcagctagcagccgcggatccaatcggcgagcttgcatgagcgcggatctaggtggggagcttggatctggcacctgctagctttcaggctcccacctctccgctctcctctactcctcgtcagctgtcttgagccttcttctccagctcgcagatggaggtggctctgctagcgatcatcgaggcatcgagagagaaagtgatggagatctgacatgtgggtcaagtggggtatttcagaactttcacgcggtttctttctcctgttgaaccagaaatgaatatcctgatgagtacagtgtccaacagtaaattttcatattttgagagtgtattttccaaaagtcactttttgtggtgttctacaactaaagccgcgaagttacgatatcttgtagaaaaaaaggatatcatttaattaatgcaaaagtagtatatttagttggtagaaggtaagggatattgaagggataaaacttctcgattcatatataaagggcgtaggtaagagagtagaaattaattaatttaaaaataaattttaaattctgaaactcaaacttattttgcaatataatagagtaagtacatgcgcactgttcgatcgagaatctaaaaccttattggatgggggatcgctggcatgctagcttgctggcttatcttaattcgtttgttccaggcaattttcatgtgtatatattgacatattgtccatccaataagtgatctcaatcattgtgcctagacttgttttttttttaataaaatctgtagctgatagaacctcgtttccaagagctgtggtacgtaaggtgcatgcatggtgcacgcagagatcctcgaacctttttggtctttttgaaaggatacacacatatatacatcatactattaattgacgtatacaagatcgaatatgacgtgacgatcgattaacaaaaagaaggattgtgtgatattctactgctagctgacaccgacatctcccacactaattaaacagatcaatatatctacctagctagttgtgttcactgtgtaacataactgtcttagagtgataaccaatgagagagagaagatagtatacacaaactgcatgtctgcatgtatagtgcagactgtagaggtgggctagttcttggtgaaaagctggatagatataataatgggcttcagctcctggccggcccatgaatagtttgatgcccatgctagctagcttctttcttggatctagtctcctgcccatttatgagaggaaaccctgatcgatatatcctgcttgctttgccacagcaaaagggagcagtatatatgccagagttcattggatggcagcatggcaatgcactgcagcaaacatgtgtctctgcggcatttatgattggaaacatccttgcgtcggtcggaggatatcatcatcgatctacgtactagccggcagatgagaacgtcgatgaggatttcatctaacaacttttaactgtctgtacaagctagactccaaaaggagttacagtttctgcatcgaacggtatgaaatggatgcatgcgtacaaagccagggaaagatgtgcagacgttttctttctctggagtctggagaggaggagatattaaatttttattttttaatatttacagaaatattataccagcgaaaatatttacagaaatagaccctaccgctcaagtggagggcagcaaggtgacgtagcacacggcgccgtgtgcgcattttgtgctgagatccgtaagggggtgaaatgcaattttcgccgcatgcaaaatttgcatgaccgctcaacggcctccagcgcctggtcacacacatcaccctgccgccctccagggtctatttttgtaaatattttcgccagtattatattcctgtaaatattaaaaaataaaaatttaaaaatgaaaaaaaaaatcgagatacaggacaggaggtgtccattgcctttttcggcccatccagcctacaagccgatgagctacagagaggcgaagcgatgtaattgggctatattggcctaactcaaagtagcccatttcaactgctcacctgaaagtaggctgtctgatgtccatgtccagcccaccatgaattctgagaattattgcagactttttcttccccctgaagcttgagttgcaactaggaacattttcatgctgccctgaaggcttatcgaagaaataaaaatatgacaaactttcatatctatgtccttaacgatttgtcagtgctaaaaaataaattacagcaaaaacaccccaaattaactatttaaaattttaaactttggcaatggcttataaggccacgttgaaaatctgaccccaggcctccttactagccccgtttttcatttccatatttgctctcactctcctttcaagaatcaaaaggagaactgacaaatcaaaaggaaaaaaactggtacaggcataaaaaaaacaaaaggatgaaagtacttgatcaaaacaggaaaaccaaaacgtttagtaagcaaaaaaataaaagtaaaaaaatagtaatcaaaatttaaaattaaataacctgaaaaaaaagggaatttggacccaaaaaacacaaaatagtcgaacagtacggagggaggaaaatgaaaggaaaggcgaaaattttctgatgtggtcaccgtctcgggatttgtttatctccgacggcttcaaactgtgatcatgaagataatcaaaccatcttaattagtaggagtactaagttcaaccgcaaattactctggtaaactctgtgccgagtagtactactagtgactgtccaaactggtgccggttttaactaacaaagtcgccgtcccaacgttcgccgatgctgagtcagcggttctaattcatttgttcttcgcaacctgatctggacatgtccctgtcctccttccctgcactttggtgaagggaccaatcaaccaatctgacagcgttgctgatgctgtagtagcactagtactacacaactttttccatggaattagtaatcagcagctagcgaattaggcaaattagccgtcctatcctacactgattagtagagccacacaactttcagggcttttggctgctcatgcagagaagaaaaaaaaaaggagaataacagatgccaattgaactgaatcttatcttgtgcacggaccgggctcttgctgtcgcctcttttaagctcatccagtcacttcgtgcatccctagcgagaggccaacaccccaaccaaatcagtctggatcgtaataatgctaaatcgtatcacgcatttaggccgtccatgacaacaacaacaacgacgacgcttttgcagagaaaaggtgcacggtcgagctggttggctggctcacgagctccagtaaacaattcctaaaccatcacttttagcactatagtagcacagttactagtactgctgatactgtttgggtttgttgattttaatttcaccggatgttccaggagcaaacgacacttgggcgccgtaactgtcaccgtagctgctaaacacgttccaggacccccggaaaacgacgcgaacctgtaaagtcagtcgatcggtgatactgtgagatttaggcgtgcgtgcagtgacgggagagccgatcgatcgatggaagcaccggtcgccgttttctgccgtagcggcgagcgacggagagcgatcgctcggctcgctgcataaaacgcgaaggaaagggaacaatcttgctgccaatccatatatctatcttccgcgtgatgcgtggtgatttttacggggaagggaagggacatcagacaagcgcgtgcggccgccggtttgatttggagcagcggatgacgtacgggacgtccgcggctgcatgcgggaacagcgcgagaatcggccgcttttttttctccttctcgtggcagtggcggagatcgggacgggacccaagggcaagcggcgacgcgcactatgggtggcgcggaggcggagcaaaatgcgtgtcggttggatgggtcgcgggcgggatggcaacgtgacgggacgcgccacacgcaccccgcctcgtcgccgcggtgttttgctgggaattgcagcgctaaatcctctgctcggatgggtgggtggatgcggcgtttcacggaaccatcgtttcgtttatttgcctaaataaacaaagtggtatatttacaaacgaaaaataatttatgaataaaactttcatatacttgttcttagcgacttaaaatcaaaagctaaaactttaaaagcctcttaaaatcagctttaaatttaaaatttaaaatttggttgtaaacgaaatggtgaggcctcagccggcgccggcttggcgtacggacgcactgccaacaacatggagcatctttctttgggttgtggaaaggaaaaaagggtggcgatttttttgaaggggaattgtaggcgaagtacgaaccgaattccactatatcttcttttatggagtagtacacgatgatgataatgataaaacgatagagattccgttctctggcttatgctcatctgtggtgggtattggctacatctgcagacggttcggtcggctacccttttttccacaggaaagatatagcagtagtgaccagtgagtgctaggcatatttctttttccgatttttatagccagcgtactgtattcgcctcatctcctccacatggttaggactacggagtaggtattgtccgagtctgcagtgcagaatcctcccaatataattgacgagtcttggagtgtagaatctcctccaatataattgatgcacctcaaggcatctttgcttattgtatactacaccaatgaagcttctcctttacaacccatgtggatgccgctttatttgtggcttgaacatataacacctagccagttaatatccccctattcagagcctattatttcacttatacttattcgtatggcttattaataaataaaaaataatttataaataaaaattttatatttgtatccttagcaattcaaaaataagtactacaaaataaactatgataaaaaaaatcacaacatcaactttaaaattagatttcaaaaaataattttggtttataagcataagcctaacaatagggtagtcggtttctattaacacctaactatttactatttttcatattcacattatgttctcagctggagctgtgctacagggtttcttcaaattccttgtgtattcgatactacctttgtgtacaaaaaattgcatttctagcattaaaatttgccatgccgagtgcaatgctactccctccgtccctataaaatagcaacctagttttggatgagacacatcctaatactatgaatctggatagcctatattacaaatttggacatgtctcatgtttaaatttataatactagaatatattcaatctggtactagacgtagtatattataagatggagggagtagcttatagagagtatagtactagtaaggtggggagtacttgtaatccgagcaaccaattaattttataggagtactaatttcataaggtcgttgctagaattgtaatagtgtttctttttaggacagagaaaaaaaaagaaaacaatagggaaagagataagttatattaggttcctttggaacgtaagattgtacaggattttcacatgaattagttcaattcatgcaaaatttctttagaacttccaaaccaaaggaggctaattcttttgagttagtgagcatgcaccacaagaaacacattaggtttaggattcgaatcttagttttacttccgtcttaaaatataaaacacaatacacgatcttgtattgtgaaacaacggaaaaacaatatgattgtgtatgaaggaagtagaatacacaaactcgcaacacaccaattgatcagtcagtattcattcacgagaggaaggcattgcagagtaattaagaagtaattgaagcagacccatttgccaaagtgagaattaacgtggcagaaaatttttcatccattatttctccatcttgcattccgcaagaagaccgctagttagggggaaaagagtaaaaaaagaccaaaaacgatcacaacacgtcgtcgtactccaacacgtacgtacggtactccactagaacgtaaaacctctctagaagagggaaaccggaccatatatttggtagcactttacaactagggctgttcagatcagccatgtttttttgctttttgttcttccaatcattcatcgaaaatttcctttaaccagagcgccgtttgcaattcccgctccagcgctgatga

SEQ ID NO: 18002 - DNA, 7938 bp, Oryza sativa
tttatcagtgttggaagtgagcaatgtacctcgcgatctcagctcgtctcttggcttgctcagcgatctcagagagctcgcggtagctgctcttgtcgttgaagagcgtgttggaggcgacctccggtggctgaaggccgtgaagtgttctttgtgcggtggcccattgtgcctccctctcctccctaccgtaatccttcttggtggtgaatgcaatctgcaaatacaaggttcggatcatcagccagctgaaacaaaaaatggagcagacaaccatatatgtacatttctgacaactgaaagatctggatatgtaccttgttctcaaggaggttgtcccaggcccttccactcagcacaaagcggatgaagaacttgaagatgtcaagagggaagtagaacacaatgctgtaaagccagataacgccagcccagccccagccaatgcccttgatcctggcaaagccccagttggcatagacagcgaggaatgtcgcaacctacagaaacagtaaggttaggattaggcatgatttgccgtgacgttgttatgacgtagctcgattgttgagtagttactgtcttgtacataccagttgtgcaagcatgaatgcagtgaccaagagaagaccagggcgttcgatgaaggaccagctgcgagaacgggtgacgaagatgagggcctgactcacaatactgacttggaggtacagtgcagacatcatctcatgttcactgttcctgattgatctgacaccgaatttgtcctgaacaaaagcactttagtgagaacaaaacttcacgcaaaagcatacataatgagagagaagtgtagtggacagactacagatagggtaaggtgagagcataccgtgaaaaagtctgtcttgtgcatggcccagaagaaaataacggtcatcagagcaaggtagcttccaagcacaataccggtagcgaagatttccttcagcttccagctgtctggcaagggagaaggcttaactctgtccttcgagatcgtcatgatagtacctgcaaaaatattgcgtgagaactgatccttacactaggaatgtacatggagggaatagttatcagtaatttatctgggcaataggaatgcataccgtcattcaggatggcaatgataaggaccatgaagggtgagaagtcgtatttccagatcagagcaataagcaaaaatccaagctggaaaataaaattgatattagagtttggaaaatcgagaaaagagcttatattccatcttttatgtacgaaatggtacttaccactatacggatggtgatggaaactgcataaatctgatgtacacgagacaaaataatacaaagttagaatgcgatgtgatcatatgttttacagagaacacaagttatttgcaaaggaagaacttacggtatagttcttcatcctctggaagatgcatctgctagtgaggacagcgctgataatgacactaagacctggctcagtgagcacaatgtcggaagcacttcttgcagcatctgtagcatcagcaacagcaataccaatgtcggccttcttaagagcaggggcatcattgacaccatctccggtcataccgacgatgtgcttcttctcttgcaacctcttcacgatctcatatttgtgctctgcataacaagaaacacattgaggaatgcaaacattgaaagcaaacaagcaggtaagtctgcatcgatccaagccataccagggaagactccggcaaaaccatcagccttctcaatgagctcatccacgggaagtgcctcaagtgaagcgtccttgttttgtccgagcaatgcggatgaaggatacatgtttgtacccattccaagcctcctaccagtctccttaccaatagcaagctggtcacctgatgtacattaaaatccaaccattagctcttgcaaaattctattatactgctttctgtttttataatatttgtacataccagtgatcatcttaacattaacaccaagatggagagccttccggatagtttcagcactgtcgtgcctcgggggatcaaacaggggcagcagaccaacgaattgccatggtccaccagcagactccttcgacttctcaggtacttcctgcgacatcatattggtatgagaatatggttccctaatcactaaaaaggtgatagatcattcagtaaggcagccatcatacctgtcttgcaacagcaagagaacgaagcccacgctcagcatacttgtcaatcacagcatgcaccttcctctttacatcctccttgcagttgcacagggtcaggatctgtccaaatttcaaccaaaaaaatgtcagtcacgtattataagtaaagaaattagcaaaaaaaaaaaagtgaaacaagggtcaatctttctcacctgctcaggagcacccttgctggcacggtgccagttaccatcggcatcgatgtatgttagagcagtcctcttgtcaactgggttgaagggcaagaagtgcacttccctgataccggctcttgcctccttgggatcagcaagcataccaaccatggcagcatcgatggcatcttggttttctgtcctagatgcccttgcagccagcaacaaaacatggtccttgtcaacacctttagtgaacacttcaacgaggttcttgtcgacgctcaacttgttaagggtgagggttccggtcttgtcactgcacagaacatccatgccagccatctcctcgatggcagtcatcctcttggtgatagcaccctgctgggacaacttgtgggaaccaatggccatggtgaccgagagcacggtaggcatggcaattgggataccaccgatcaagaggaccaacaggttctcaatgccactgcggtaggcacggtgctggatcgggaacataacgatgatctcgatcacgataccaaccgcaatcgagcagatacagaagttcccgatcgcagtgagcaccgtctggaagtgaccaacttggttggtgctgtcaacaagatgcgccgccttgccgaagaaggtgtgcactccagtggcaatgaccacggcctcaatctcaccctgcttgcaggtcgagccagagaagacctcatcaccagggttcttggtcactggaagggactccccagtaagtgcagactggtcaatcttaaggggatcaccctcaaggagacgagcatcagcagggacgatgtcaccgagcttgatgctgataatgtcaccgggaaccaagattgctgcctcctgctcgccccatcggccatccctcagcacctggaataagcaaacaagtttggttaaaagaaaaattcaagattacgtaatcagtgttcactattattgcaacttattccaaagtgccaactgctacatgaccacatcctagtacctaacacatttcatttcggctgatttgagttgacaagttgcacgaaaaaagaaaaattccacgtgacaacgatgtgcgtgcgtgcgctgccacatttttctccccttatcctattaaataaaaatacaatgaaagggacgactagctaactgaggatgagctccgtagcagttaaagaattgtgatggtgaaataattcatgtccaagaggatacttcctgatatcatagacctatcaatctatcatacgtatgaaagacagaaacttgacttccagctccagagcagaaaaattagaccacgttgttttgctaacaatatccaaattagccgcaattgcagaacacctaggctattatttacgccaaatgaacagtactgtccaagaggtgggtccctatctttattttcttgcaataatggaatatatgcccacccatccactggacaattcagagctcagtttctaggcactctaattgaaagtgcccgtccgaaaagtacgcacatagagattcttccttccactactgtataatactattatgacaactagtcaatacaaaaatcaaagccttgtgtggtacaacggaataattaaggtcggtttccagttcaaagtgcattagttagtactcctatccagtgtttcttgagctcaccttggtcttgggtgcaaggttggccatgagagcagcagcggcgttgccggcgttgttctcttcgatgaaggagatggtggagttgataaccagcaggacaatgataccgacgaagtcctcccagtccggtggcttgccgccgccgttggccagcgcgatggccatgatggcggccatctccatgacccacgacagcgggttccacatgaaccccaagaacttgagtatcttgctctcctgcacaagcacacaaacaaaaagacgcaacaaagatgagcgattcgcgtcagaaatgaaagaaaaccacacgcaacaagagaatgcaaaaggctttgacaaagcatagcacgcaccttcttctcctcgagcttgttggggccgaacatctcgatacgccggttcccctcctcggaggagagcccctcgcgcgtacatttcagctgctcgaacacctcctcgatcggtatgttctcctgcaacaacaacaaaagccacaaccacactagtcagcaacaacagagtgagaaataagaactcgggttacccagttattcgagtaagacgtgacaattaagaatttatcagtcgggtctatgatatgcgagtacagcgataaatccttaattatcactatctcgttattcgacctataattagattcgcgtgttgaacaatttacagccttatcaaaaaactattactattggtggatgggcccgacctgtcattgacagataaaatatctcccaggtggtgcgtgtgggcccacgccgtcagcgcctaccagccaagcggtcaggatctactaggaacacacggaggaggaagagtccaaggggcaacaggggggttgcagtgcccggccaatgattggagaaagtacggccgtcagatggagatcagacggctcagcggcagtcagaggaggcgcgcgtacttcccgtggcccccctcgtgtcgtccttgagatgcgtgccgggaagatgcggtttcgttttctcgtcgcgtgagccgaagggaacaaaaccagcccaaaattaaactgatttttaatctatttttattttttttaaaaaaaagataaagcgagcagcggctggtatacgttgtgctcttggattgggctgtccgcttggtcaacaaaaaagaacaaaaaaaaaacaaagcaaaccaaaaaaaaggccgcagctcagctaggcacgcacggattccactgtgtgtttagcttgcctttatggtggttagccactaatctccgctgcgtgattagctcgcgcccgtgctcaagtgacttttgactttacgtacatgcaaattcgtatgaagctcatgaataattttaattttacgtgtgaagctgaaaaatagttttatggagtaggagtacttgcgaagctgaagaactatttgagtatatttgttcactgcttctttgtataaatgaagaactaaaaaaaaaggaaagtagaggcaagagtaatactaataactggaggtgggcatttaattacgcgtagatctgagattcaattttttttatactatagtttggtggagaagtgaccatagtggtatagtgtactcctacatgacagattaaacacgcatgtgagcaggatctttcaaaaagtttcatttcaaccaaaaaaaaggaggagccggagacagatgaacaaattgatgatggtgagaggaacagcagcaaaacagtacagaggagcgaacagggtgagagagaagaagaataagagaagaacatggcaggcggccatggacaactggccccttctgttatgaaaagccgcgttgagaaagagagcgtgacgtgaaggccgccgccgacgacgaacgatccgtgctcatctttacatggaaaattttccttttcatttattaagcgtatcagaaatctactcagctccagctagccggtatcattaattttcaattctcagactatttctatcgccagtcaaaaatggtaagaactaaagctagagctaaagcctaagcaacccaacacgcgagagggaggaagcgaggaagaagaagtagtaggtagctggtggcggcgagtgattttctcaccagatcaacggcctcattcttgatctcctcgagcccacccatggctgacgcgacgccggcgtcgtcggcgaacacaccaggcgcgaccactagagaggaatcggctcaccgcgagaccccaactctaccccgtccgtcttccacctccggcgcggcggtggtggtattagtagtggagaggagagggaggaagggggaggaggatgggtgcgctctatatagcgcctccccgcttcatacccgcactgggccccacctcgccgcgcggggcccccctctctgttcgcgtgcccccgttaacttctgggactctggctggctgggtcgtggggcccacgtgtcggtgggccgtgggcgtaggggggaggtggagatttgactcttggagggggaggggaaagggaggctgtgggacccgggcccacggagctgtggatgtcagccacttggggtggtgtgtggtggtgggccccacgccgcatcacgggagagataacgggttttcgggctttgggtgtgtacagtgtgtgtgtggttttttaactccgtggggaaccgtccgtgttgtgcctggagtgagtagagtagtgagattcattttacaagctggaccgtccgatggatgtggatcgtgcggctcacggacgaacgaagctagctgatctcgatggtggattaaattacaaacacagtatgaacgtacacctacccatataaacacgcgcgtacactcatatctgtagaagactaaatcgaaatattttaagacttagagcaggtataatagcagactattatccagctacaaacatattttaataaaataaaatatgagagataagagctacgggctacatatatgtagtcagctgcagtacggaatctaagacaaaatgtatgtatgatgggtggagccatatactaatagtatagtaagcaattattatatgacgaattgactattagattggccagagatgaattggagctaatagtgggctatactattaaactcgctcttacaaagtatccatgtgataaaatttggctttaatatgaactaacgctaaatttgttgttcctgttcaatttacaatggccggctctagaagtactatcttattttcgcccaaatggcacctgcgtaccgttcgatagaagtattatctacaagacatgattgtatctgtgtagttgctggatttaaaagaaattaaatagttcatcagggatgttccagtgcaggcctagctgcctcagttcagctatttcccatctgttccactaaacctttttttcttgggggtttacatataaaattgcaagtgtcaaactgaaccctgctgctctcaaagaggtaagagccgaccaagcgttgtactaccatcccctagcattattctaatcccctgcacataatgggcaaataattcacttgaataaagccggtttcaacgagcaatttgcaggtgacggaagcatcacctagctgctagcagcatccactttttttatatgaaaaatacataaaataaaaaaaacttatataggggcagatagaagagaaagtctccttggcatgcaaattagtaaaatcttttgtggacaataattcaggacagaacagggtcggcgatgaatgcaacttgagatctaaaaaaagcgacccttcttcccttctatcgcacacccccgttcattcaccttatcctcacggttattcacgacaaaattccgttccatacgcgtgcgaggccgtacaaaaacggggaagatt

SEQ ID NO: 18003 - DNA, 5491 bp, Oryza sativa
tgccttcttgagcggatttctgtgcaatgtattttatatttttttggtttttggaatggagtatactacttagagtaggtacaatagcatgctataaaccagatataaacatattttaagcagataaaagaaaagagagaaaagcagcgggctacagatctgtagtcagctgcagcacggacaaacataatgtgtgtatgacaggtgggaccatgtattaatagtgtagtaagcaaatattgtatgaattgactattacattggctatagataatttggagctagtagtggactatactattaaacttgctcttagtaccactgtaatgtgcatggttgattggctggagcagttgaagcagccaaaattaatcttcgtaatggtcgaaatggcacccaaaacaacggcccgtttccttctttggaagatgagatggacttcttgtgttctttggggtaaatataactgacagtttgaaatggtcattattgtgccctttctttgtacctacaactcatgtgagaatattgcattgttttctattcgttgaaactggtggggacagtttgatatgccattttttgaagtttgagtatggacctattgattgttttgtggatttttttttgtctaggtacgaaatgaagccattttagacttttcaaagtcaacaaaagactacttaattattttgtataattcaaaaggaaatgcatgactgtaaaatttattgttataagtttttcatatgtaaaaaatttatgtctcaaacaataaatatgatcgatgttatctggtaataataaataattactacctccgtcccataaaaattgcatttctagctaatttaggacaaaatagtaggattggaaaatgacaacaataatctaatttaatgaacccactgcatgcacacattccatatatataaatgattaaaaggaagtttgagagaattaacccatataattagcatacttaataaaattgcaagcattagcagcccaaattatgtgggatgaaaggaaacttatacatatgaatcaattggttgggtcccacatggctagaaatacaatttttgtgggacaaagccttagagctagaaatgcaatttttatgggacggagggagtatatggacaaacaatttctaacatcagtacccaacactttcccctgttttatcaaggaacacttcaattacaaatgtcagcgtctgattggatgacctcaaaggtcaagcctcccaaacagtggctacacaaagccctctcctcgtccgaacagccgcctttggttttggtcaaattaaggaaacgcatgggctcaaaaactcctaattgtgatgcaataatgactaattaaatccatgacactgcttggaaattcagccagcactagctcaaatttttagttactactattaatttgacaatgtgcaattactccattattgtactacgattgtaactgacattaaacaaaaaaggcatttcacatgttatgcctaacattttggagtcaataatgtcaagatagatgcatgtggatactcttcttttatcttgagaggagactcattgtggtcaccctatcatgctgcttttgaacgttcgccagcgtttgctgctaatgcatgacaattgttcaatccatttcccttttgatatgatcagatcatgggtgacaggcacaggatggtacaagaaaaagttattctcatcaaagagctaaaaaggatggggacaatgcatctcaatgaagagttcaagtaaatgcatgctattttcttctcttttattttttcccttttttttttgagaagggtgttgttttcatgcgcatgctggtaatgcttgtccttctcactgatagatgataggcatatatatagtggtcctatccaatgacacacctgttggatctagctagattgtgcttgaatggggattccattaatccaaatcgatcagttgtgaagtttacattgatcttactgtacacggttcagattaattttgttgacaggggatctcagttagttcaggatgcaggtcgtttgcagtgttgcatgtgcagtactgatcattgacacgtggacctcatagcccctcggatccacgtatcaatgagcagtactgcatgtactgcaggggatctcaattagttcggttggcattgctaaggcacggagcactgttacggggcttgcagctgcaagctgcgcagcgtcatcaaggttagtcgagcaacaacataattgatttctcaaatgtaaatatattagtatggtgtacaagtttttgttcatgtggaatttttttgttgcaaaacatgaactctgaaatcagaagtgcaaaatagtgcttaccagtaactagatttttccttgaacaacatatatagtcatatttgtaatgcgggaatcacgggtccaaaattaagcagtgaaaaaattggactttatgtaaagaacaaaatgttctctgataccaaaccaaataatttttttgcaaaaactagcaaacaacattctattcaaccaccgtgtgcgcttgggcttactattgtgggagcaaaaatgattgatctatgtcgcttctactcattagtctactagctccacgacgcaagtcagagcaagacatcatccatgtctctccaattgcaatactaaacacaattattacccaaattacccaccccaaaagagaactgaatatgcaagtgtcaccgttacgagaatcatgcacaattatgtattcaacacatctacttaaattattggtctacatttaaaaaaaaaacttcaaactgcatcatcattcagcccatgatccaaatcaacgttacaaaaaaaaaacatatttaaactggaattatgcgtgaggtcaactgatttttatagccactcgttccatttcttccttgctttcccttttaataattgtgcataattgatgtcttctttattattatttttttatttacagatggagcctcacctagttcctcctcctcatgcaactgcagctgtgtagtatcacgaaaagggagacatggcgatgaggaagagccaaccctgagaaaactcaggaggcaaagtggaattgctcctctgtatcctttcaaagattcagagtttcagttagctcttctctctttttagtttttcttttcccttcaaagtcttcaaaaagacccaagaggtgaaaggtccgttcttgtttcccttctgtcctttggatggtagctaatgaacatggatggacaggtcaatctcaccgtcccttgttagaaatggacgccattaattagtttgaagccttgaagattcaggtcatcaggtctctggcaaattggcaacctcgaacaagcttcatgacatcttcctaagttgagtgattggacagaaagtttgtgcactactactaaaattcttgcttccttttgttggattgccaatttgccatttcccccagaatcacattctgcagtttctgacggttcatcatggttgcaatgaacctatccgtgtaattcttctcttcttttttttttgtgatgttacatgagcgactttaatggtggaatttatttgtttgataccgtagcctttatgctgtgttaagataggcattagtataaggttatcagcttaatgaaagcttgttttatacgtgcaaattagatgtgtgtggttagtgactgtaaaattagccgtgcgccatatcggtcaattttgttgggaagaaagctacaagtcgaatcaagtctacaaaacctgcgatccttttcgtctcatctttttatgtttatttttatttttttgcctttctgctgatcttgtttgtgtggacttgctctttctgaaaatcatactactgctatttaatggatatggccacgtgcccaaaattcagttcggtaacacagttgcagcaagatgtaaaaggagtttaagccgtactatagtagtatttaactataggcctcgtgctaagatgcatggacattttaaaatgactcttatggtgacagaaattatctgatgcaccaggagatgtggttcaatgaaaaaaaacgtaaaaaaaagttttcgtaaaaattctaagtgccttatgtagagattgggtatgttctcagtgtagttgtaccaccttgatataatcgaccaagttaaatatataaaagcttctattataaaaggaatatatctaaacacctgagcaatgtaatttgttcttttcatactcgtgcatgtggaagaatttgctagcttggtgtggtcacaatttggcggtctttggcacatgcagcttagtccatggcattatgtcatcctaagatccattcgtctaaaacaagaagatgtggtgtgctgaaagtttcaccttttctaattccattccaaaagtaactagttttccttgtcaaaaataaattcaaaagcgggtcattagtgagacgaaacaggctatggaaaaataggaaaatctttgtgcatgtcatcctttctgaaagacttgataaaaaagattaaaaaaagatgacttgatgcattgaaaagcagattggaccggagaaaaaaattagaagaaaaaatgggatgagaaaaaaaattcatgatcctactttgaaactattttttaaaaaacaatagaggttttattgattcagccgattatatcaaggtgatacaaccgtaatgagaatacttccaaaatctgtataactaggatgcacacagctacaaccgcacgctagttttcatcaaaacaaaaatatattacgagaaatctgtagactagatcgccacatatactcctaggtaaaacgctcctactggcatgttattgcaacagttttgtaatcccaacctctaaagaatatcctaggaagagagctagagtgaagtattaggaaaataacctacaaaagaggggggatatttttctttaaaaaccacatcatttttaaccataatgattaaaacataacaaccgctactaacaaaacatattgctctgaaaatctgactgaaagctgaaagatcataaagataagctagtcgtctgtgataggcttatcaggagaactgcactttgatgctgtaatttttggctgtatccatggcctagctaggagtagtttctttcactcatgaacaatatagaccggaattttcaaatgggcactatattgcccttcacatttctccaataaatctatgtctacatgcgcacctaacattaaatcacgtcactttttgtaagatggagaaatgggatgtgatatgccatcattcatgaaggggagccgtcagacatagagaaaccggaccctctgatcaaatatatctagtaattaattagttggttgttgttgttcatgtagcggcggctaattaatcttctcggcaacatttgggcaattaatcatccaatttgaatattctgaacgaattaaggatcgggagtttcag

SEQ ID NO: 18004 - DNA, 1655 bp, Oryza sativa
gagtattaaatatagataaattaaaaaactaattacacagttaggggaaaaatcatgagacgaatcttttgagcataattagcccataattagctataaatgttacggtaaccaacatttgctaataacggattaattaggtttaaaagattcgtctcgcggtttctaaacgagttatgaaattagttttttcattcgtgtccgaaaaccccttctgacatccggtcaaacatccgatgtgacaacaaaaattttcttttcgtgaactaaaccggccctatttgatgctcctgatctcctcttgcgtgtaatgtgtgcagccgatgagactgtagtcccgggtcaactagggcaaatgcaaggcaaatgcaatggctccattttcttcataggccatgtccatatgcagatgtcacaacgtacacacccacttggagctctgatggtttggtccacatgcaagttgcctggatcgagcatctcgtcttttgtccctcaaatcttgcaatgatttaatgccctcctcgctctttccaatgcctatcaatgaggcctatgaaatcactcgactagaactattcccattctcatccatccatccatcctactacaggttcttccaggtaactgatgagaaagctgcatatttttagctacggctgtgtttagctcaactcaaagtttggattttggttgaaattgtagatgatgtgactgaaaagttatttgtgtatgatagattgatctgatggaaaaggactgaagtttgaatctaaacacagcctacagaaaaatctcttgctatagtacggagagatattgaattttatattaaaaatatacaccctccgtcctattttaagtgcaaccataagtttccacgcccaactttaattatctgtcttatttgaaaaatttttataattagtatttttattgttatgggatgataaagtatgaatagtactttactcgtgacttatatttttatttttttaaaaaaaattaaataagatggacgatcaaagttagacacgtaaagccatagctgcacttaagatgggacggagggagcagtacctttcgatactttcataagaacagtaaagctattgtgacccaagtatggatggaagaaatggcagcagcagcaatctgcaggcagcatgttttgcatgagcaattcaggatatatgtgtaggattggaggaccatttttcctcttgccctttttttctgctgtgatgccggattggttggtgtgccatgttagagtaacatgccccctaattaggtggttgtccagtccagacacgccattaactgattaacagaaatctcagcgaatcgtccacatcctgcaaccgtacacacacacctcctagctcttgtctgaattccaattcgttagcatcatccttcccctcatggtccatctgtaccaaacatggccaattaggggatcaaatcgtgcaaaaacttgaattaaactgtggttagatatttcagagtagaccctctgatgattatccgggctaaccaatggattacggccatgtaagacagtgacatgtacgtactaattattaatttttcttcttcaatggcgacttgcgtgaggatgacagaatttgttcaagggtttggcagtctgc

SEQ ID NO: 18005 - DNA, 3277 bp, Oryza sativa
ttacatctccggcttttgtcataagacatacaaccataagtttaatagatgattatattaagtttacatattttgaaatatgtacaacatgattatattgtgctgtaaaagtatcatttcaaaagatgtatacatcacagtctcacgtgtagtacttcacgttaaaaatgtcttattacctctacaattattatagattatctccattctttcttttttattaaagaaggtaggagacgttaaaaaaaggtacaatggaaagtatagttacattaacaacatgttttttagatagttttttttaaagtaagataattatatctgcataatgatccggctggacgaaggtatggggattttctaattagcaccacaaggtggggcttgctggtctaggttcgagcatagcttctcttaataaatttcgatatgagagctcctcctattatatccatcattcttataatggtccgggttttgatagaaaggtatgcagtataaactttttttttggagagtgacaatctggttttcaaaaaaaaagggggaagaagctagtttagtgcatcatgatgtaaatagtagattaatcaccgaactggggatttataaattaggaatcatgatatgcttttcaaaacaggagcattatatctggtttgacttcaacatagctctcttgtccagttgccctatggaccaatcaaacagctaatttaacccatctgtcctaaaacaatctcaattattagtacttccttcccctaaaggtccatttcctacggtcggtactcgacagttacaatccagttttttctgctctacaaacagttttatgtactatactatgagctattctatatttatactactgtagatgagatgaaatgagctctaaatgtgcaagaggctccacttgtcaattgtttatgtactttgaagtataattgacattctaaatatttggtatgacttcggatgcacttttatcgacagatcaatattaatttcacatatatgcacctctatgtgtaaaaaaaacacatatttgcagagcaagtgccacaagaatgattagtacctaaacaaaaatgtctctgtgcaagatcattgcaatttgcaaatgcatatgcaataatactaggatagggttgacctgccaggctgacacaactacaacagctatgttcatcatctcatctcatgcttcaggccagccacataataatttgagctccacatgggcacctcgtgagttcgttgtacaagcagcagcagcaaaggggaatcttatattatggtaaagctaaaagggagagaaaaaatatagtgggatcttgggctaagaagactagatacattattacagataatttaactagatatgttgttgtctgaacctgtctctttttttactaattacgtgtcggagatgtttgacacaaggataatttaagcatagtatgatattgctggataagactcgggattaggaaagtaattcccaaaggttaaagttccaacttccaactccaggtcaagtattaggtacaaaccaaaggtgtgaataaaaaagcattgcacaccatcatctctgttcagaaacaatgcgatctgtcatcagccgacatgaatcaagtgcgagtacggcaatttgatgagatcgtgctagccgatatttttgtctttgagcagaaaaagaagatatcaagattggttaatgcaggcattcactttgtgaatgtgaaataaacagctcaagagtttgatttgttaattcatatcgactctgaacctaattaatcattggctgctatagatgcagtacggcagcatcaaaatttattgctttctgatcgtgcagtttgaataagccacctgtggcattactgcagcctgcttcgttttgacaatccatccgtgttccttaaattcttccattcagaggagtgtatcttgtcatatcatcttcagtgtacgattgattgccttaatcgtagtcctgaattctgcaagctgcagcctattagaacgcgagttcagttgtacaaaaacaatcttgctctgaagaaacaatctcttgtgtattctgcagagagtccagaaaacaggtaactctcgtacagaacgtcacagcattatgtaggagtattatgtaagtacgagcataatgattcagagtgcatctccttgtcaccttgaggaaggcctgaaatatctgaaagctgctacactgaatgcaggagccaactcatcgtaattaatcaaacaagtccacatgatctcagcactaaacaaatggcaaccaaacacgaacaggagtcttagctaagcatgaatactttgtgaaacaaccgttgtcatctaccagctccaaatggcattgtaatctcatctcttgtgctccatttgaaaaatcgtggcaaaggatatacattaatgtgctaatggcatgatgtgtcgcaagtagagctatctgctgagtacatggcgcttacattgtcgccggcgcaaccaatgcaaaactattgctcattcatgatgcattcgccggcttggcttacatctatcttaaaaatggaagctaaagatgggcgtcgacctcatctaggtgctagtgcttggctagtttcccaaatgtttttcttcaggaactttgccgtgacaaagaaaaaggatcgatattttcagaagccctgatggtacagggagtagtcttggtcaaatttgaaggattatactaccgtggatggatctttgcctcttaatctgaactgtagatgatgtatttggtgtggaaatcatgctcaacgatgtcaggaattcctcggccacggttgaattttttcaaggaaatgcctgcattggtacgtggataaacaattgcgatgattgataagtagacaatttgtcgtgcgactgacgctgcttctgctgtttttctcttttccttgctttgaaacgattggcaataatgtccccggctttgaatcatttttactgttgcacaggttcagaaaggtggaagcagcagcatccaatggtgggtctcgagcctaccattcttgaactgaaaacaacactaacaacagtagatcagacttgctacccttgacctaccaacatatcaaaaagagatacagagagcaaaaggtgcagaagacctgatgaattgacgacgttgttgaccgccgtggaatagacgtcgtcgcgtgcgcagaagcggaagcatatcttgatgactatgatatgatggaatgcaacaagtaaccaaaca

SEQ ID NO: 18006 - DNA, 3178 bp, Oryza sativa
catcaagaagaagaaaacacgtatagtttcatttttgtttagatgaaaagaacagtaatttgctgaaagtactaaaacccatggaaaatcaaaatagtagtggtggcctcgtctctctgtgggccacggcctcattactgagcgccaagcccagaaagcccagttggagcacttccaggcctcatcacaagcccagtaacccacttccaggcctccaaccgggaccgacggaccgtggagcgctttcaacaggctgggcccgaaaattctgcggttttcgcggaacaggctttgcggccttgctggcttcggctgacgactgaaaggccgaaattttgtgaagatcatggaagaggccatttcaccaacgggcctcttcgagctgggccacgaagccacgtctgttcctaactcatgtacatatgactcagttgtacaactcatgtacaactagaggcatacgatcatagatcattcaaaaagagtatgttcatgtgtattgcagtcgtttgtaactgttgattaaattcaatcgaacataagtcgaaccgttggatcatatacatagcaatttccctttgctgcacgcaaatgaaaatggtgactaaaattcccatcagcggagcatatattgtttctgtaagggcccctttctgtaaaggtgatgtccttttctggactgttccaattcaaatagtatataaaatttgaaattgaagcatcaaatcaccactattaattaaattgataaatatgaaaatttcaactcagccgtgaatcgtttgataaacatgatatcatttccgaccgtttcccaccgtacatgaacccgaagacgaaagtaccctctaacaattgtattcccatggtttccactgcattttcgatacatctataaggctgcgtttgaaagtagagattggaaactttaccttccgacgtgtaaaaaaattattagtacatgattaattaagcattagctaaaataaacttaaaagataggttaatatgatttttaaaatcaatttttctatatatattttttaaaacccacacagagtatagtaattcaaaaaacgtgcttaagaaaaaagagggagagagtaagttgaaaagaggtactccatccatcccaaaatataagaatttttggactctgacgcggtctccaagatgctactttgactaacaatatctataaaagtaagatgctttaaataaaaagagttgtatattatgatagtttgttcaatgataaatctagtaacattaattttacatgattgatttttttattttttttattaatagttaaagttaataatgtttaacttgccattatgctaaaaatatttatattttgggacggagggagtaccgctttaactgtcgacctgcttgctgctcactggtactcctatctcttttaccatgctaacaaaacattctgggcacaaactgtaaatctactatttttcaaaggaaaaaaaattctgtctggtagtaaaatctagtaacagacggtaagatggtttggaaatgggaacctgcatgccaacctggtcagataatggacgatgatgtcgcacacaccgctagcttagggatagataatactagtatcataataagatcagtgatgttgacgattgcatggctgcagctcggcagatgctaggatatcgatcgatgtgtacaaatgcagttggctacacaacaatcgggggaggacgctccctgacgcaggaggatgacctgagactcttgactttgtgagatgagaaagaaatgtcagaccagccgaccgaccgatacaacattcgtcctccgtcccaaaaaaaaaaaagacaaatattgagttttcgtgtccaactttgactgtccgtcttatataattttttttataattcgtattttcattgttgttagatgataaaacatgattaatattttatgcgtgacttatctttttaatttttttaaataagacggacggttaaatgttagacacggaaatcagggtttgtttttttttgacggagggagtatgggcacgtacagagaaacgcagcggcagcagcagcccgtcgtgccgtcgctattcctcgaaagcgtacgtggaaagcggcatatatatgatacgagtgttgccgccccgcagtcccatgtacgtccgcttttaatttggcctcaccgaacgaacctgaccgaataccgatcggtcggtcaatttcaattgcaatctctcgctgctcggcgatcgatcatggtgttgggagtttccaaacacaagtagccttcttccatcgatcgacggtttttgctgtccgtttcttcctgcaccgcgtactgcatttgacatggaagcagcaaacaaacaacggacattgcattctgtagccatagtaggacgcggtggtgggttagggagccgaccgatcgagcaccggccgccggagcgtatctctgctgcggacccagcactgcagaatcctgacgcggacgcgcgatgcactgcaccgcaatgcaccatgattgacaatttgacatcgatcggtagaatcgcagccgcgatcgactgatcgagatgaggaaactaacaacaagatgaacgtggcggcgaccctactcctcccccgaacgccggacaacataggcgcggagaccggagacggacgagccgcgcgacaccacgttcccctgcctctggctgcctggccgattgaactctgacgacgatgaagcattgccgatccacaggctggacctacgtcaatgtgcatacgtaccctgttcaccctgagacgtggctacgatgaagcattgaatcaggggggcattcaggcccatcagggctgtgcccctgtccaacggcgacatcgacaagatgtgattctcgatcgaccacagcatctatgtaccgtactacgacattcacgcgtgttattaattggttgccggattaaggccgtgtttagttaacccttaacttttcaactttccatcacatcacatcacatccaaaactttgctacacatataaacccccaactttctttttcaaactagtaacttttctcaaacttttaacctttttcaggaactaaacacagcctaagccacaactgctttacgggaacggcacatacagtcaaactgatcgacaagtggatagcat

SEQ ID NO: 18007 - DNA, 2609 bp, Oryza sativa
ctcacaacaactcctttcatagagtggcaaatctataccttgtatgctactctatgtgcgagtcactgcaattttataaaggatgtgtaacatactaagttttgtgataggatgtcgttatggaatgggattacttatggtgttgacatcatcctgcgcttctactttctcctcacaagtccagcgccatccaatcaatcccagcctgatgccttgagcaaggccaccatcgctggctgcagcaacaactgggcaacgccgtcaataggatgaaggaattgaggaaagaaagggagaagcgagaggaggcgccaatggccggtggctcgccaactagtcaggtggggataatgcgcccagctctctacacctttatactagataccaatagggatgaaaacggagcggatacggacggataatgctcataccatattcgtttttatattttttgccggatacagaaacgaatacggatagctcgaatacggaaacaaatacggactatcttgaatacgaataagaatcgaatatgattggacacgaatacggaaacaaatttttctcggaacacgaaaaccaatttaacttctaatagaaacaaatatcaacatatataattagctcattttatataaaatgtagtattatttataaatatttttaaaattttaaataatattaataatgtggactagtgttaagagatgaactactattaaaatctaaaaaggtatattgaaggtcatagagttataaagaaattgggtatgtcttgtggcttctgcggatatccgaatagcactgttcaccggatatccgaattattatctgtatccgacggaaatcttgataccatattcgtattcgtatccgatagaaaatatccgtattcgtatccgtatccgaactatccgagaattatccgatccgagatgtatccgtattcgtttttatctggagcggacggaaactatccgctccgtttttcatccctagataccaagggtagcaaacctgatacccgtaggtatcgtacctagcacctttgggtaccggctagtacctaagttccatacctcatatatgcaggtaccagacccactggtgctaagcctgatacatgtgggtatcatacttgatactcatgggtgctaaccaagaataatgtgtcatacgacatacctgcacacaacactgacaagcagcaaaacgggttggcaaggagcatgatggctataccaccacattgatagccaatcaaagctccagatatggtcatttcgaagaaggaaggggtgaggcccttgtctaccatcatcgtgggggagaacaccacatcccgtccccatgggctccgagaacttgatcgccacccatggccatcaggaatcccaacttccaccaccaccatctccacatccatacgacggtggggttgatagtacctccacctccagatcctcgaccaaatccatgaaaccacaccccctctctcgccgtgtccgtacctaggtaccaggtacctcaccgatgggaagcggggggctacgtcaggaacatggagccacaacaggaagtagagagtaggaagatgagctagggccagcgaagggcaggaggaggagtggcgagccatttttggctggcatatgggctaggaataggaggaggatggggaagacacgaggaggaggaggagggcattggatatgtggcgttggcagagagtgcattgggcgtgggtctttaagtatgtcgtcccctgaagggaactgtcctacaatatttcataagaaataaaatcacatgccctttagatcttgaaattcatttccatatatgatagttttctataaaaggaattcactaacttgtaggcatcatctttcttcatcaaccacatgcaactactcctatttattagataaacataaagatccgtgcattgataacattttcatcttctctcgtaacatggtgattgcatccgcgacgatactcgatttgtttcaagctagtatggtgaggctgcaaggaggattagtgatatttccttggttttgagggatatcatgagaaaagaggttatggtggagatggggaggaggtggggattcaacgttagggaattcttagtggttagataaatttggcaacaatatagttgttggagaggtggaagacggttatgtgtcggaggttcgatgagaaagtagaagatgacggtgatggatctagaagctgcaaccacctgagaggaggaaaattgtcacaccccgaagttctcctcccaagcctaaaatttaatttataaatgaccctaagaaaatgccggtgcaaatcaagagaaaaccctaaggaagtgatacaaataataatcgaatctgacatgtggaatttttcttgagttctacatgtcgaagttcactaacaggatttttagtggaattttcagagccctagaaataattttgaccaattaaaattgagcacaagcaatatttaaatccctggaaattcctttcttcctttttcttttttttctttttccttttcccttagtgggccgccggcccacttcctctcctctctcctcgcgccttgct

SEQ ID NO: 18008 - DNA, 509 bp, Oryza sativa
gttttactctgatcagaggtgtacaactatacccacaagacacagccccacgacacgtttccgtgcgccgacatgccaccacgacataccggaaagaggccgtaacaggacccttcgcataaccccttctaactaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtggcactaatccaacagtaccattagaaccaacagtctaaacattaataggat

SEQ ID NO: 18009 - DNA, 412 bp, Oryza sativa
gcagtgtgtgtatgactggtgggaccaggtattaatagtgtagtatgcaactattgatgaatgagctattagattggctatagatgaattggagttagtagttggctatactttgctcttagcctcattcaggctgtgtttagatccaaagtttggatccaatcttcagtccttttccattacatcaacctgtcatactcacacaacttttcagtcacatcatctccaatttcaataaaaattcaaactttgcgctgaactaaacacagcctcagtcgttgattaagaaagagaaaaacatgaccggagattaaaattctgttccgccgcgtttgccctcgtcaactaatcttcaaaccctagtgacatcgttcgagaaagaacccaaaagagtaaacccggctacgggggt

SEQ ID NO: 18010 - DNA, 666 bp, Oryza sativa
atccacatgtattccggtggatggactatatccaggttcgaaataaaactttatttattttgtactatcatactttgttagtatcttttttcatactacctccgtgccataatataagcacatctagcatttgaaatttgttccaaaatataagcacgtctagagtactaattcactcaccaaccaccctaatttatgaggggcatcatagtcttttctgcttaaccttagtctttgctagaaaacctagatttgcttatattttggaatggaagtagtagtttgttgctatatgttgtcaacatgaagtacatgtgcccttcattctggataaaataaccaaacgcatatagtttttttaccgtttctcttgacagtcccctatgttgctttctgtggtataccagcactgaggtgaatgcacataccatgttttttttccttgtttgttgcctggtcttattaccagtttgttcatactttataccttaataatcagacccatattaccattttattttacatcttatgtgagtacttactgattgacgcagaacatcgttgattttggcacaacagtacaaaaggttaacttgaccaaatctgtcttcgatccaccttctgtaagtaaagatcctttcccaatgtgggctagaagtattacat

SEQ ID NO: 18011 - DNA, 7940 bp, Oryza sativa
atcttccctttcccaggttgcttcctcttccgaatgatgactccactgaactcggcaaaacctggtgaccttgtttctggttctcctttcgctggtgtcaagtatgcgaaccggcttctccacataggtcaggtcctcctggatatcgatgtgttccgaatcagcctgttcctcaggtacccttaagcacttctttagttgggaaacgtggaacacgtcatggatgccgatcatgttggatggaagttctagctgataagcaacttctccccttcgttccaaaattttgtatggtcccacgaagcgtggtgccagcttgcctttcgtctgaaaacggtgtactcctcggagcggagtgacacgaaggtacacataatcccctgcttcgaaagtaagctctcttcggcggttatcagcataactcttctgccgagactgggcaattcttagcctttctctgatggttctgactttctcctctgcttcagttaatacttccgtcccaaacaattggcgttctccagtttgatcccagaagagcggagtgcggcatttccgtccgtacaacgcttcaaacggtgccatttgcaaactggcttgataactgttgttgtaagagaattccgcataaggcagacttttatcccatgctccaccaaaatcgagcgcacacgctcgcagcatatcttccaagatctgattgaccctttcggtctgaccatcagtttgcggatgataagccgtgctgaaattcaaacgagtccccaattcttcttgcagtttctgccaaaattttgaagtgaactgactcccccgatcagatactatcttcttaggtaccccatgcagacacatgatccttgctaagtacagctctgccaaccttttccccgtataggtagtgtgtactggaatgaaatgagcaactttggtgagtcgatccacgaccacccagattgaatcgtgccccgacgatgtcctgggcaaacctgttatgaaatccattccgatttcttcccatttccattccgggatctgaaggggttgtagcagtcctgcgggcctctgatgttctgctttgactcgctgacaaacatcgcagagtgcgacgaattcggctatctctcttctcatgctgacccaccagaatttctctttgaggtcctggtacattttagtactgccgggatgaattgaatactgagtttgatgagcttctgttagtatgagatccttcagttctttgtcgtcaggcacacacaatctctctcccaaccagattgtgccatgctcatcctcatggaaatctcgagcttttccaaccctcatattctttttcagctcagctatttcaggatcatttacttgagctgctctgacttgatccacgagtgtaggccgtgcctctagggcagctacgaacccgtgttccacgatgcccaaatttaggtgctcaagatcttgctgcaatttgtcacacatgccttcggtacatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcatgtggacgcaactgtcgcgaagcatatgcgaccactctgccttcttgcatcaacacacatcccaatccttggcgagatgcatcacagtatacctggaagtcttttgtctgatctggcagaattagaactggtgcagagactaacttcttcttgagttcttcaaaactttggttgcactcagccgaccacttgaatttttcatctttctttagcaactgtgtcatgggcctggcaatcttggagaaattttcgatgaaccgacggtaatagcccgcaagtccaagaaaactccggatttgagaaactgtctttggtggggtccacttggtaactgattccacatttgatggatccactgccacgccttgagcagaaatgacgtgacccagaaatttgacctccgataaccagaagtcacacttgctaaacttggcatataactggtgctccttcaatttctcgagtaccagacgaagatgttgctcatgttgtttttcagacttggaatagataagtatgtcgtcaatgaacaccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactggtgatagcctgatcgcaggtctatcttggagaacaccttagctccttttagctgatcaaacaggtcatcaattcttggcaacggatatttgttcttgattgtgacctcattaagggcccgataatcaacgcacatcctcttagtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacactggagaacggaaggtgatcttctcccctttgtcgttggttagggtgatggtgcggcttgcgcagtcaatcactcccttgtttctggtcaaccaatccattccgagaatgacatctaggtctttagattcgagaaggatgaggttggatagaaacggggatcttttgatctctatagtcaccgaggggcagtagtgtgctgtcctcatatcatttccaggggtatgaacctgcatcggtattttaagttccactaccgataatccatgcatcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtctagtgcgattcagcttcggacacttaccagcaaagtggccgtgcttgccacagttgaagcagggtcctggctttcctacagcccccttcttgggttgttctgactgaactgacacagctggcggatctgactgagctggtgccattagtgggggtggagtcgagttgtggttgtgctgcttactgttgttgtgactgccaccgttgtagtcgttgttgaagttactcgggtgatagggacggtgctgacagacgatcagggtggaaggcccacctagctgtcccgtcatgaagcgaggcttctgattgttcccctgaggaaagctgatctgagctgcctttctttttcggtccattttgttgcgttgctcttcctggcggatagccttgtccacaagcttctcaaagtcctcatagactccggagattagctggttggtcaattcatcgtcgagcccaaacaaaaacttctcctgcttctcagcatcggtgcgcacgtcctcaggagcgtagcgcgcgaggcggttgaactcgtgcaggtactctgtaaccgttctggttccttgttgcaatgcacggaactctctcttctgttgtgccataatcccttcaggaatctgtgccttcctgaagctttgacaaaactctgcccaagtaacctccgttgcatctagacgggtcgccacgtagttatcccaccaggcagaagcgggaccttgcaactggtgtgtagcaaaagcaactttctctcggtcgttgcattgcaataggttcagcttcttctcaatagcacggagccagtcattggcctccattgggttggtggtgcttgagaaagtgggtggctggatacgaagaaagtctaacagtttggacacgtgtgatggtggaggaccaaactgctggttctgttgcgcctgctgcaacatctgatggtaatgttgctgcatctgttgcatcatcattgtcatcatttgagtgactgttgggttttcgggcggtggagatgatctgctgccagatgcaccactgacatgagctccatcggtctgctcttcgctgccactggcgtcgttggagtcacggggatcattccttgtcttcatcatctggacgaggataggtagaaataagagaaaggaagaaaacagatggcttggaagctaatctttcttataaaattaagtgccattatcttaatcttgattaaaacactgaaaaaagaggcacgcaactcctaataaaagcagccataccactgacacatgatatcgaccgccgactaacccacaagcaacaaacctaagcacagaaactagcaagcaaacaaaactaagaagacgataaagctatgggtggcgactctgaagcttggagcggcgcttgcgatcgaacaacaggtctgacatctaaggtaggcaagggataggaatcaacgcatgctcaaaaccaaattaaatgaagccacaaatgactcaaacaactagccaagcatgatgatttttatgcatagaacattttttttttatgaacccggataaagatacccatgcaacaaactaatcaatgaatcaatgcacaaaatagatgcatagctataatgatacgcataaaatctccccatcgtacctagacacgacttagcgcatatcacctaataaattcccgactcactatcaaataaattccggataaaatttttctaaaaccctagaccgagcaaattttaaggatccgacccgaatgaacgaccaagatttttcccacaaaccaaagaggcaaaaccccaaatttttcccgaaacaaatccaagtgcaaaaagcatatgcagatgaaaaggtttaagagagctcttaggttttccagttggcttgtcctacggtcaaggtcggctctgataccaacttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcatccttgacggcagcgacgaaaccaacctcttcgagacatcttcaactgagaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaagcagcagttgaaagcagtaaaacagttgtagtaattaagcaatattaaccaatctctgtccaacgttacaccacgttgcaacaggcccaaaccaccacctgaactcaccagttcattaagcttaactaggggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaatcgccatgggcacgtctagcaaaaccatgcacccacagcccaccatgtaatgtactttaattaaccaacaccattacggtggcactaaatcaaagctattgccaataatcaaagtctatgctttaatgtgatccccttttgtgcactagttgaactaagcatggctaagcatctcctaaaccaacatctagtcattttaatacccaagttatcaatggcgtaagggaaacaacataaagctgagtaataggacccgtcccacatgatattgtaaaacaatgcaatatttaatagaaatgcgggacatttgtaaattgggtacaatatgatcaattgcaatgtatgacttgccttgctctcgcactgatgaggccacagcaacgtcttcgagaaactacggatcgacgaaacggccgaaatctacgcgacaaacaaagcacacaagcaaaacatgctataagactactgaaacagagaacaaaaccatttttaatggattctacacatttttatgaatttactgagacttgaatggacttaatcggagctcggatgaattagttatgatttttagaagattctctgtgtttttactattaaagaaaaagccttaatcgatttattgcgcaatattgccccagggctgacgtcagcaaggggtggggcggcgccgacatgcgggacccacgggtcagtgactcaaagagagagagaggcggctggcaagcggggcccaccgggcagtgacacaagggggagaaggatggggcggcggcgccacgtggcggccggatcgacggccccgatctacccaagggtagatcggacggcggcggcggcggcagcccccgggctcggatcggcatcaaagccgatcggccgacccgggctagcggcggcggcgcgtgcgcgtcacgtcgccggcgacggcatccggcggcggaggcgacgcgaaagcggcggcagcggacggcggcaacgacccaaagcgacggcgagcgcgggcggcggcgacgcacggggaagcggggaaggaggggagaggaggtgcctcaccgagggtggccggcgcggaggaagatgatggcgaacggcgacggcaagccacgggaggcgacggcgaccggcggacgagctccggcgtgccctaaggaaggagaagagaggggttagagagagggagatagaccacggcgaccggaatccatggccgaaggcggcggtagaggttaaacccaccggagcgcgaggagacgggtgttccggcggcgaacctcgacggggaaggggcggccgaggtagatcttgaccccgcgaacccgacggcgacgacggcgcggcgcggcggcgaccctagcggcggctagcggcggccgaagtagcaaaaacggcggcggcgggtggttgcacggcgcgggagcgatggggagcacgggagagtgcggcgaaatggggaaaaagcgagagaggacgacggcgatgcttaaaaagggggagagagagccggacgtggccgggaacggcgggattcgccggccgacgcgggggagtggggaggagagagaggcgggattcgaatttcgaatcccggccatcttgggcgcgggcgcaagtgggagagagaggggaaagggcgcgggaaacgcggcgcacgcacgggcgtggaccacgtgggccgagga

SEQ ID NO: 18012 - DNA, 5860 bp, Oryza sativa
atatacaaaaatcctccaagcctcatttgacttttatctttgcacattttaattgttggaggctttcacattgaattttaattattcttttgcacaatttcgaggatagattttagagtcgatttgggacgcgacaatggacgttgcttcggggttcgctgctggaagccgagcagcaccttaactagcaaggaggtgttcacctaggccaagagcaataaccggcgactgctccatgtcggcgacattggcagaataagaaagtaacgaaatgacactccaatttgcatctgcatactctccttcaccttcatgcgtgaagccccaaattcattttgcaaatcaaattaacatgcaatctccaatattacctgatctaaattgatgggctgcacatgtcctacatttggacatcatgctccatgtggtttgccgcagaggatagggtgaagtccgccggtgatggaggttgtttcctatttttcttttactcgtcatttgtatgacatgaacgagaatgttttttgcatttttttcgtgctttctagatgacgaataactgctactgcgcaacatcgagatcgtctctataccacgcagctacatccttccatcattccatcatctactaccgcacgcactagcacaaaaaggctttttccgctgccggccggcaacactgccagaaacctaaggccagtgaaaaaataaattttcactagtggtccaccaactgctagcgaaaattgacttccacaggcagcaaagttaggacagctgctagagaaaaggtgattttcactaatggtggctagtgagagccgccaatgaaaatgattttaggataaaaaaataaaaatcaagatccccaattactatccaaaatccataattctccgacccacaatcactgtcctaaatcccccaaatccacaataaccacaatcacaatcacaatcatcacaaccacaataatcacaatcacagtaatcacaaccatagaaaatctaggtccaaaatagttttgagaaattccaaatcattgtcccaatccccaatcacaatcccaaatcgttgtcccaaatccccaaccacaatcacacttcctagatgagcagctgcttgtcgttctcctcacagtagccgaggaagccgatgaggtgcttgtggtggaacagcgagaggaaggccagctccggaacgccgtctcctcctggaacttgctggagcatggttcttggtcattgtcgcccgccgcccacgcccctccatcgcctggatccgcggcacgtgacatcgcccgctgaagtccatgccctgatccgcagcctccagacctgggagtggggaggcggttggaggagcccggcggcggtggatccgtgcctccgcggctcggcggcggcagatccgtgctcccaatggactggcggcggcagatccatcctccccacggctcggcggtggcggatctgtcctccccgcgtcctggtggtggtggatccatcctccttcggccctacggtgtcctccatgaggcccagcggcccgtccgactatgcaagccgcgcggtggagaacaccggtggagtcgccggtggagggggaggagaagggtgcggaggagagacgaggacaaagagaggaggagtgggaggcagtgtatctagaggaggagtgggtggcggtggggctgcctttgtaatgtgcggtatgatttccgctagcagtgcactttagtagccgccagggaacattgaattttcgttggcgaacatcgaattgttcctggcggtcctctttaccaaccaccaacgaaaatagagattttcacaggcagctggtaaagaggaccactaccaaaaatccaattttcgttggtggttccttaagtgggccgccaacgaaaatagttatacttttgctggcggccctcttaacccagccgtagcgaagatctgttttcgctggcggtccgtagcccccctaccccttgtaatatttttgctgacggtttacacgtataactgctagagaaaaaaaaaaggtggtgccatgaaaaattaattttgtagtagtgacgccacctggttaccctctccgctaccagtcacaagacataggtcagcctctccatccttatagcaagatccaggaaagcctcaaggatcccagattcacaatggatttattttttagtaaaattacaacgaggcatcccccattacttttaatacattaaaacaaaaaagaaagttataaaatgtataaaatatacaagtacaacagtcccataaatattacagagcttgtaaccaggtagaaactgtcatttttttcttttctagtttaattcacctgtaagtgattttatcactcgtgtgtgattgagccattaatttttttcattcgtacgaccatttcgtgatacaaattaacaatacttttagtatcagtttttattcttatactatgtattgaacacatcagtaaataaattgcaggctacgagatcacgggctatatcaagaggaaggtggtggttgttttactcacagaccatgaagtctgaacaatatttataacactggtaaatgaactactagcgttgtaagctggtagtaattcttttacgaccatctaggaatggtgtcgtacgatgtaggggcattcgtgcaagtaaatttgttacttttgaagggggcatttatgcgagtaaatttgtttcttttgaatgtgcagatatgggaagccgggagtaaatggaaagctctatagagtaaattcgttactttttgaaacgtggggagactctagaaaaataaaaaaacttagaaagaaaaactagacagtaaatattttactaaaatgtgaaaacagaaaaactggagagaacgaacgaaaaagggaaaaatatggatggttaatattttaccgggctctttgatgaaaacgaatgaggtggaaaagagaaaaaagaaacacggaaggtggggtggtaaaaaacgaaaaaagcagacggaagaaaggtggggtggtaaaaaaggaaaatcggaaggagggagcgttgtgtggcgctcaaagtaatattccgcgtggagcgcgcgtattagcgccaccgtatagtttaagtcttaatatttatgtttgtacacccatcatgaaaaatacttccgaaatacataatacatatgtttctaaattacccaaaatttctaaaattgatgaccaaagatagaaatgtttgacttaacaaaaagctagattgacaagcaatttgagcaatttgaaacagaggttgtagtgtggttagttcggacagatacagagaagttgttccacagaattaatgcaaataaatgcaattctgaatcgcctacaaaatgataaggaaattaaataattctaatccaaagagaacattcaaaagtttggcaatcaactcttccaaaaacgcctatcactatgtgctggaattaactttttgttgatttcatagaattttggaagccatacttatttgtaataattagttatagttctttttagttctcaaaaaatgttttggtttttaaggaaaccaataatattcagatttccttatatcagttaacacatgcttcgctagtatcatttaggttttagcatgtagaacaatacctggagatacccaaatgccatgctccctaagtaagcgaaaccataaagcaacctcatgaaggctagagctagtgaattcacttcctttgatgtcacttattgcacttcctatttcttcttggaaaaggtgatctattccaagacgatggactgcatctattaaattcatcttctccaatatatcattgcaggtcccaaacagtatgcggacatctctttttagcttttcggccatctccatcatccatccctctgatctctgcttatttggcagcatgaatttgatttgttatgattgagtgaaagaaaaaatacactgaaatgaacagttaataaggtcaattaaatgatttccaattaatataattaatttgtgcaattcgtggcatgacaaatgttttgcaaaaagcagaacaaagataactagaataaaaaacaaaattaatgaaacacaattgatccgtacttgggacatgagaactatatatgtcactttaaaaaaagacaaataaaaaacataagcattaattatgagattttacatttgaaaattgcaccaatcttgatgaatatataatgagaacacttaggtatcaaaattatctgggatatcaaaggtgtatagtttaattatcagagttattagaatcaaacatataccgcacgaaaaataaaatatgtatatatatgcctggaggggcttgggctcgtagttgataaagaaatccccccacgcagagggctcaaagctagacgctagctcattcccggatcgaatcccatgtccacttgcatgtcgcagaacattgctttgccggaagtaaccttttgctcggacaccatccgaacgagcaagaagcccagccggcggatggctaaccctaatatgcacaggaggaccattacacaagagagggagagggatggagcttgcagacatagtgccctttcagcgaccgagaaattaagtagctagaagctttgtgtatacgtactattaatctaatattataagataggatatctgtgaaaactagctagctttgcatcttctgtgtgatatggttgctttaatttaactagctatagctgctttatataggactaagcacgtgtatcttccaaaacaatcacataactctgtacctctgtacggtaattgggagattttgagagacgaagagctgcaccgcctgcacgctacctcaatctctgctggtccgggtccatgcgagagcaattatatgcacttgtgtactgtaggagaatgaccggacaaaaattctgatgcctgccaaactgatgtgtggatcagcaactttcgcctaaggcctggtttaggctgtgtttagttgatggcaaagtttggattttggttgaaattggagatgatgtgactgaaaagttgtgtgtgtatgacaggttaatgtgatggaaaatgactgatgtttggatctaaacacagccttagtttcaaagttttttttcaaactttcaacttttccatcacatcagaactttcctacacacataaattttgaacttttccaccacattgttccaatttaatccaaacttttaattttggtgtgaactaaacacaccctaactcgttgatgcatctgcaacaggccaacagtaacgtatataacagtatgtagggtcagtttatcctaatcgccgtttaatttaggggtatttgtgttcttatctctacttatacttttaagttgtaattatgattttattcccacttattagggttttttattttgtccatactttttcgaagtgaagtttcagtttacccctattctgccaattcatattaatggtgttaagtttgtaaaaaaaatgatatgcatacccttacatattattgaatatttgtgttttagtcctgttttgatatcaaggaatttggcattgcctctatttatagatggccaaaaggcaagtggcctaatggcccgacccatgtcatggggttttgtcccggaccaggcacggcacaacccgaccgttgtttttaggtgatgtttcacataattcaaacctggtctattttaacaaacttatgcagaatgtgggatttgaactcacgatctctcatctcagcactcacatgtacgtgttaccatcccacctattgcacacatctttttaatctaaccttggagacatctttagtatgagttgg

SEQ ID NO: 18013 - DNA, 5243 bp, Oryza sativa
gttcccaactgatactatagatggtaacctaaacaggaactaaagatgtttttgggacttagacttttttaaccagtactaaaaataaatttagtaccggttctaaatctaaccgaggtatttgttttttgagtaccacgataaaagatcggttgtatttaacacaacttgcataaacatttgcttcatgcgaacaaaggaagtcaactacaagagaagaacgacacaagattggacattggagttggcggcttcgtcggcatgccaatggcacatggtggatggatgcatgcatgggtgcaagcaaccaatcaataagctaacaataagctaacaataagaatttggaaatgagttggacatgggtaggtgatacacatggggttagaatggtcatttttttgtttcataaatattttttctttaatttaactcaatagtttcatgcccacctaacagccatctgaactaggggtaaacggtagtttcatttcaaaataacaacaacaaattgacaaaccctaaaaaagagggaaaaatcacaattgtatatgaaagtgagggtgaaaacacaattgctacactaatatatatataccctttagacggtggacaacttatctacaccggtgtttgtttgaaccacatccaactaagggttgggtggaaatcgctgattaattcgcgcaatagcacgcctgtgtgaaaataaaattgatttttcaaaggcggctctcttgaacagccataaaaatgaatattcagtttctttattattttgccacaaaaataaaggaaacagatatttcaactctacctagttctgtagctctcggcgttttagacaataacatagtttcaagaaatatgcttgactatcaattttttattataatatgtgtacaaaataagtaaatatctatgtttattaaaatattttttagactaatcttgacgtcgtgtttaagtgtcttcaagttaaatatttttatggttattaggttagtaaaattttaattatttaagtccaacgttattcaacgttaagaatcgtgaaatcggaacgactggtatgtatacatggtcgcatgattattgcagtgctagcaggatgacatcgatggtacctttgggtggatgtctgagctatatggccatacgaaatgtctgagctgtcgatacttgggcggcgtgtctcgtggcgataaaccataccacacaattacacaaagcaaataggtccaagttacatacgccatccagctaactgttgtgttgacgactactgcagacatcactactgtacagcagaatctccgtagtgaccaaaacacccgaaagaaacttacaaaaaaaaaaaaaaggaacacccgcaaaacacccaagaaacatgcgcctagctcggtaatcatcatccggccggaacttgttcttcgacgaaacactgaaacgtctaggaaattccaatcattgtcagagttaaagcactgctctcatgctctgaacgtgccaaaatgcacttcctgctaacatagatatttcatccgttttaaactagaaaaaaaatcaatactactccccaaaactattctgttggttaacttaacccctaaactatttcttttactcattttacaaccttaactgttagaagaggtgaacttgtcaccgggctaagatacatgggtttatatttgggttaattggatcataccactacaattttatctattttgaaaaataccattactattcaactatttgaagtgatgccattacaatcttacatatatttgagataagccactacttacctctttggtgaacttacaagattttctggaccaaaatatcctcatcttgttccttaatctccttcctctcccttcatctggagcgtatgtaccgatcaacgtggtgccagtgaatggctgagctgatgatggcatgaacaagcgccaggaggttgacgtgaagcggcaacatcatcgagcaggacctagaagcacttcagagcaggagcgggagctgagtccgactggcgatgaggaagaaaagaggcaccttcgccggtcaagcccgccgccgtcggattctccaagccagtgctcgcatgtgccgccgctgccactcccaaatctgtggggcctaggtttcagcccgtcacactcgaggatgccacagccacccgccagatccacctagcctagtcctccaccggtcccgcccgatgccacgtggccgatgccgccgccgtccgattcgccagtcacgcccgatgccgccgccgtccgattcgccggtcacgcccgtcaccaccgccggacaaggcgagctgaggcctcgcccgcatccacctagcccgggccacagctaccacagcatttcttattgttatgaaagagtaaagcaacttcaaaagttaaatgtttcattggctgatggacagattaaacacaaagtatatgttggataataagcatggtggccgtccaaactgtgacctgaattgtgtgctatgcacaatccaatctttgaaaatttgtttcacttctttttttcattgccccttcatgaggagttgctggaatgctataggtatttcttgggacatttctttgcatctggagaacaagatagtggatgctagacatcgatatcaaggccattgttttattgaaaaattcttgtttggggcatggaatatttgaaagcaaataaatgattttatttttgataataagtctccttctttgtcttcttggatacagctctttaagggtgatcttctccttttgctttttaggttaaatgagagagacaaaatgtagtcatgagatggatcagttgttgtaatttctttttttatttttcctttatttctttcattaataaatgtttatttaatagtgggggacctcccctattgtttttctttaaaaaaagatacacatgaaaatttttgcaaaaaaagttgaacattaataatgatattaccaatggatctacaaaattctagcagaaaatacgggtcatgtaaagagaacaaacaagactttagttggtaaaatcagtcaaaaatattacaatagaggtttaagtggataatgaaatagtttgagggtgtaaaacatactttttttttctttaaaatatgaggacttctccacgtactctcttatcctaatgacctaatcaatcacaatagggatgggtgtttggtttttattgttttctcggttctgttaacttgatttcttcattgttacaaaacaaaccttaaaaaacataacccaataaaaaacatcaacttaaagcggctcagatttttcaggcatcagatttacggaatgacgagatcaattggcggcttcgcacttggccacccgtggacagactaggtgttactaaattgtacatgtgattcgtagtcgaccgacccccacaagagcaactccttgccaccacatatgggctccacttcactatcgtctctctatcgactacaaggatcctactaccttttgccacccacagcaatattgtagttaaacagtaggttatatgcattcttgaggattatttgcaattttaccctagccagagaaacaagggtatgcctccaaacactaacttgtgtcacctatcttaaaacagatataacttttacatatggacatggaattgggtaaaaaattaatctacgcacatctatagaaaaagtatataggattatctgcacttcatctggtttgccaaaaaaattttactaaatttggcatggaagattgagttatcgagcttcgaagttctagcacaaattttaaaggacgctcccaaaattctacagttgcatctttcgtcagcttgagttgcttcttcatattgtgcttctactttcatgcctgtggttgagaagaaaatgaaaataaataaaagaagtgaataaaaaggtgataaaggaggtgtaatattgtttttcctcgagctgctttgagagactttgtgagagaactgtcctaagtggtttgttttttattctcactgattaggcttgggaacgtgtctcaactagtgattgcatacacatactttgagatatttactcaacattactatgtgttactgaattgtattctaccaaaaacaaatttgttctcccaaactccacatacatacttctgattagcatagcttcggccgttacagtcgctagatcgcaccctcaaggtatcacgtccaccggttgtactatccttagaattgttggtaagacacttgtaagagtttaataagacacttccattagctagtctccactgcaatccttgttctagcagctgataggaataatctcttgagtttttgttttctgttcgtagttttcgttaaaaaagtaaagcggagatagcagcccgaagaatttcaacgagtgtgttagtcatgctcagatgtagggtgcaatagaccaagtgattaaaaggctgaaagacatacatgcgaaaatggacatcaggaactccattgagcgcatggataaacggttgtccgctgcccgacagaattgaggatcgtgagggtcgtcttactgatggacttgacgatattgagggtagtctacaatctgtttgagccaacatcatgaccgagatgaagacatcatgtatgttgaaaacggagaaatttaccagcaggcaacatgagatggatgactagtatgatggattatactaattttaaggattggaattatgggttttaatcccctcttctataccattatcatttaatgggtatacatgagtatgagtatgtgcatagcagttacaagcctgttcacacaatatagcaaccgtgtgaacgcaggcatgcatggttgaagaaatgggaagcatgggtaagaaatgcacagatgattgggaccagctttaggttttccctaagcctcctgccatttccccatgtcacttttgtcgtcttaaaagggaagaaaataaagttctgcatgttttggatttagatttggcccacctgacgggatcaacttcaaacaaacctagctaccgatccaagagattgcttgggggccttcttggaatgtttatgaagtctaccgatccaactcatggctgcatgatatcaagtcgcatacctcttccggtccaaatatagggccttgggcgttgagatggagttttgtttggccatctagtctatgttatgcatgactttacaccacacct

SEQ ID NO: 18014 - DNA, 15498 bp, Oryza sativa
tgacgataggctgatcagaaacctccaaacattaatgtcttcatgcctgcaaataaaatttatcggaatattgagcaccgattcacattaagtggtattagagcacaggatgcctgataagtatacatgtatcctttactttgctgctccctccattttttttattataaggtgtattttgtatgttatgaccaggctttgactaaaaatgctttactaatatattatttatctgataaaaaacataatcacaaggaggtcttttgtataaaagaaacactttatatatttttaagagataatctactctatgcattgaatttatctccgttcaacaatttgctactgacattgtctttttctataatataccaatgattttgtcaattgttctataatatgtcatttcagtagggctttttaaaaaaaatactcaaagtaccttagtgacatataaggtcaacaataggtttatctcaatacaagtttaaagaaaaatgattttttttatgtgacttccttacactactatataagtttcaagttttttagtatttttatttgtcaaaacaaatacttccgtgtactgtaggagagaaattgcttacacaaaagataataatacaaaaagaaaatcttatgtagcatacgaaagatgatctacattaaaatcaacaatataaaaaagtattttacataacatataacgaattagttatattttttaaaagtagaaatgcaaatcttgaaacttatatacaaacttccgtgtagtgtaaggaggccaaataaaaaatcatatttttttgaaagttctaataagataaatcaattgttaatgttgtatgtccataagggtattttgtgtatttttgaaaataaaggcccaaccatttgggtattgtagaacaattgatgaagtcattgatatattatatatggagagaatgttagtggcaaattgttgaactaggacaaactcgatggcataaaagaaaactcgacagcccactgtttacacccaaatttggcacctaggattaaaataggaaaaattgccagaatttggaagtctaccggtttcctccgagtgggtcggtctgaccgccgtgtgttgggtggtcagaccgctgattgagggccggtcagaccggcggtgtgtggccggtctgaccggcaggtccgagtctgactgtgtttcgtcgggtctcgaggtttccttgctcgggaaggcatgtttcaggtttcctttagtttctaccccgagttggagtgaggagggcctatagagggcaagaccaacccctatataagggacatggcatgttcattgtaaaaaactaatctacaatcaatcaatcgaatcgtttttcatattgcctttagttttctcttagtttgtccatctttgtcggtttgcgccgtaaaccgtccgccgccactgcgagagtgcgacatctctttgtaggtttgtcctgaaaaccttccgttttgcccacgagacgggtagttatctagaaatcggctccgctagccggtttagttatcaaaacccatctaggtttagctctttgctagatcgaggtggttggcgactcaaggatcactgcaaggcttaaggtgctgcgatcgtcgttgtcaacttgtcacaaaaagttgctaacacgatttttggcgactccgctggggaggagatccgtttagcgtcaactcaacttcgacttcgccaagacgaagccgccatccaagacggaggtggagccatctaatgtgatacctatcacattggatgattttgaaggggaagaccgcaagtctatggaggagtacctcaaggagatcacacaggaggcgctgatgagggcatgcactaggactcgtcaaggcgtgatcatcaagcccgggccacgtcctaagctcgctcccgatttggtaagcattgaagaggtaacacaatctatccaacaacaagtagcatctacaatagattcatctatgactgtttttaaagataagttagatgcaacttttgagggtaaatttgatgagtttttaagatttaaattcggccctcttatggccgattacatgtcaaaagataaagcctctaccactgctaaccaacctcctatagaccaaacgggtagcggaaccgatggagcggcgcacacggccggtccgaccagacctgatggccggtcagaccgcgacttcaccgtcggtccgaccgggactcaagccggtccgactgctcctctgcatgccgatcagactgggccctgggccggtcagaccggcgcgattataccggtacaggggatagatccaacgactaatgctagttatttgtatcatcttagaacatttgatcctcctgtatctactgctgcaaatagtccccaagttcccccgcatgttcctaatgcttataatgatgttgctagggggtatcctcccgatactagacaaggccaatataatcatattgcgccacaaacacaacctatttggccaccaaatccaccgccaaatcagcataggcctgataatatggaggatatatttagtgagattattagggataaattcgggattgaaactaggaatcgtgctagggtttacaaaaagccatatcctgactattatgataatgtgacgtttcctcgtaattatagagttcccgaatttaccaagtttagtgctaaagatggtaggaccacatgggagcatgttggtcaatttttagtataatgtggtgaggctaatagtgatacttttaaattgcgcttgttttctttatctttctccggtactacttttacatggtctttacgggcaaattctattcatacttgggctcaattagaagaaaaatttcatgattatttctatactggagaaactgagcttaggttatgtgatttaacatcggttaagcaaaaatataatgagcctgtcattgattatattaagagatttagggatgttagaaaccgatgttatagcttgaatataacaaaaagcctaatgttaatgtgattgattaccctgaggctagtgatagtgaggaggaaggtgatcatgatatatatgttgctgaatggtcatggactaacaaaaataagccttttgttaactctaacctaatgccaactcctctcaaagatcggcaaagtgaggttaaatatagttttgatgtaaccaaatgtgataatatttttgattatcttttacaagagaaacaaattagattacctaaaggccatgtcataccatctcaagaagaattgaaacgtcgagcttattgtaaatggcatgattctcattctcattatactaatgattgcaatgtgtttcgacgacaggttcaatcggccatagatgaaggacttgatcatgatccttttccggtgaatacaattaatttcaattataagaaggtgttgattcggccggagcaagctgaatctagtaagagaaaaggggtggttattggcgaaccaaggccaaagatgatagtgccaaagaagccggaggttggcgtttggaaggagaataagagtagagctttgacttctaaagcccctaggaagaccaaggtgacttttgatatgcttttggagaaatatgagaagcaaggtggtgagaaaattcgcaacaaaggtaaaagaccaagatcacctcctagggagcgatttggtcattcaccaagacggtcgcattcacctccatatcatcatccacaagacatgtcatgtggttcttatccaatgttcagtcatatgcctccaatacaactcaaccaagggtggggaggaccgaggaggccaattcatgcgcgtttgtcttcaccaaacaacggccggttttatggtaagaatcaggctaacgaagaaaaaagggaaggaaagcacatcaaggtggaggcaaggacttcggaagtaatcactatcaaagtggggtctcatggcgtgccaataccttctggagatgaagttggggagtcctcaaacaaaaaatccgaagtcggtaccaactcatcgtagtcggccggtcagaccaggccttctggccggtctgaccgcagccatgcggccggtctgactgccgacccgacggcggttcgaccgacgcttccggccggtctgaccgcggaccacatgtcggtctgaccggcgcatctgatcggtctgaccgggctccagcgccggtttgatatgaggtttgcaaagggcgatgtgagggcttcatcgtcttcgaacaagaccaatagaggacattatttacctcctggaacagagctgattcctaagtggatgcctaaggatttgacggctactcagaagagaaggttgcaacgtcttcgggctcaagaactaagagagaaaaaggctgaagagcaaggagataaaaggttcatagagttgcgaccaccaccggtgtggaggcataaatccatagaaaaggaaaaaccggttgttgtagaggagaaggaggaacaatcggttgataaaggtgaatcgtctccaaaagaagacgtggatatcaacatggccatgttgatgggaagccggtttctaggatgctagtggatggaggtgccgccatgaatgtcgcgtcccaaatcgactctaaaatacatcctcaaaattatgcatagaataattaaaatccatgtgaaagcctccagcaattaaaatgtgcaaatttaaaagtcaaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaagtccttttcccccccccccttccccctcttgggccggctcggcccagctccctccctctctctcctctcccccgcggcccatcggccttcccccgcgcgcgcgccgctgacgggcgggcccgcccgccaccctcgctgacgggtggggcccacccgtcatcccctacctcgcgccgcacccgccgcctcgcccgtgccctagcgccgccgccgccgcggattccgccgcatcccgccgtccccgcgcgcaataaagagggggaaatcactccccgtgattccctccctcttcccccccccacttttccctctctctctccctcggattcgtttggaaactcccccgcgaacttcgccggcgcatcaatggcggccggatcttccgcggccgattccccctcatccggccgctctctccccctcccaacactatttaaacgttccccgtgcctccctcctccgtttccgccactcgccgctctttctccccgtcggaatcgagctcgcgccgtcgccctctttctccgccgtcgccgccgagctccggttcgccgccgccgtcgccccggacctcctcccgcttcggcatcgcctccttcggcttcgcccgccgatcaccggaacgccgccgtcctcgtcgacccgagccgcgccgccgccttcctccgctccggtcgccatttccgtcgtcgccgtcgacccggggtgagccgtggaccgccgtttcacttcccccttccctcccctctctcgggcgccgctccgccgcgctggtggtcgccgccggcgaccatcggggcgcgggcgcgtcgcctcccgtcggctgtgccggcgaggccgccttcgggcgcgccccgcggctgccatgtggggcccggccgtcagccgcccgcgccctcgtgtgcggctgacgcgtgggacccacggcgccggccggcgtaagccgcgtgcacccggtccatcgtggaccgtgaggctgccgcatgggccccactcccgtggacccggtccgcgcgcccctcccctcggctgacgcaataaatccgattttaaattaaaatttaaatgaagaaattcgcaaatattcatttaaagagcatataaccttcaaatggccataacttgaccatttgaactcggaattggaccgttcaagtctctgatttctccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagccaacgtttgggaaagcgagcaaggcaagtcacatcatctttgaacatattgaatcccagtttgtaaaattatgttgatttaaattattgcattatcgctctatttaaattcccgcgttatcactgttttatttagccatgcctatttacctttgttatgaccttattattattgctattgttattatttccttgttcaccctagattaaacaaaaccccaactagtggacactctactcatggtaccactagtatgattataggtagatgcttcgctttttaattaggtaacattaggtggttttacaactctagactttgggaatattcatatcacctggacaccatggaatggtttggttattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacattctccagggcaaatgaaggctacacgagctgtggcccggtagtcgagatgtcatggcacagggccggagtcctgctgctaggggctcagtcctacctgcctgtcccgggggttccggccgtaggtgggattgtgtcacgcccggaaattcactagtaatttccgaactcatttgtgcataaaatcctcgtccaggaatcagccgaggtacacaaactgacaatttaatatacaaatccatcataataataacgttacacacttgcaaaagaaaagaaaacacagcggaattaacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgaacagatctaactccaaaccaggagctaatcaaattattaccagtttaagcatcttttacaatgatgagaggtgtgagactaatcacgaaaaacattgttcaactcgcccataaccgcgggcacggctattcgaatagttttactctggccagaggtgtaccactgtacccacaagacacagcctcaacatcatgtctaccatgcgtcgcgatactggaaagtacccgaatagaggctatgacaataccctctgcataacacaactcaccacagtgcaccattcctggatcataatcacccccttataaaacaaggcatggactccccagcgacccccgtgggcttatctccgcacttctcagtctggtgccccgcaatgaaccatgctatacaaaaggtaaagccgttgcccacgctggcttgtggttggcacggttaatgttccacaatagtagctcgcgaaccggtccttaattgccatgagcacgactctcaaaaccatgtgctcacaacccaccattatcaagttttagttggcaagtaattaattaatcaatcacgattgaccatcgtgaactatcattaagccatcattaaataatagtgagtcataagttatcccaatagtgtgctaatgtttctaagcatggctaagcaattatatctaacatctagttgaaccaatatatataaagctcaactagtccaattataatcacccaaggtatcaaggaataaagtaatcgagaacaaaagggccataacaaagaataggttaattccacccaatgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgtgaaccttcgcaacgacggaaacgacaagctaacacgcaaaacgaagaaaaagactaataaaaaccaaataaacaatacataaaaagtaaacaaacatgtagatcatatttttagatgaattatgagacttgaacggcctcattctgacttcaaatgaatttattaagaattttacaagattaaatctaattaaagcccatttaaaaagaattaaataaatttaattcaatttatggacaattttaatatgtagatctttattttatacaacttttgcaacttgaaccacattaaactgagttaagatgaattagttatgaatttttaaagattaaatcggattaaaacctttatatggattttaattgaattatgacgcaataatgaattatttttgaaaaggaaaagaaggattattgcgtcagcggctagggtttcggtggaccgggcgcacgggcgacggttcacgggaacggacggccgagatcaaccctatccaaaacggacggctgagatcgatcggtccacgaccggctcacgggaaaagggacgatgacgccagcgatgacgtcaccgacagcggcggcggctcggcggagcggacagctcgggcggcgcacgctcgccggcgaacggcggcacttcggcacaaacggagggcaccagcacgtagaggacgacgcggcgaactcaccggtgaccaaaacggcggcggaagaccaacggacggcggcggcgacgaggaggaagcggcgaagctcttcgggtcgacgacggcgacggcgctccgacggtcttcggcggcggcgaagcggtggacggggacggcgacgacttggcgaacccgatggtggcgacggcgaccgacgtcggcgactgcaacggcggcgcggcgcggctgaaccgacggcaacgacggcggcgactagggctacgcggaggcggcgctagacgcgacggcaggctaaggcaaaggaggcgacgggtagaggggagctcgggggtccttatataggtgcaaggaggcggcggcaaaggcccacggcggccggcgacgagaaggaaagctcgcggcttgaaggaaagaggccgatccgaatcgaactctattccacgaacttccaaaacgatttagccgatgtttccaaaggagaaaaggtagaggagatcccggagattgtttcccctcaatcaattcggccggagaaggaaaggagcggcggatttggaaggaaacggcgacggcggcgcgctagggtttcgggcggcagcggcggctcgaggaagacgaacctgacaggtgggacccacctgtcagcgacaccgagagagagaagagcggcggctcggcggactgggccggctgggccgagggaaagagagagaagggttttgggccggctttcggcccaaagccaaaagaagacttttttaaaacctttttcaattaaattatttcttaaatgcaattccatttattaaaaatacttccttagctcaaataaatcccagaaaaatctaggaattatagaattaagcaaagtatttaatgaaattttatatggcccctttttatattgagatttagcaaattaaaattagatcttctcttttaggcttttaaaatcatttctaataattccttttaaacaacaatttataagttaaggatttttaaacaagaaaagctcttaacaattatacttagatcattaatgatcaaataattactgaactgttctttgtattatttaagaattgagctctgaaaaatccgagaaaatttcagagagttgacttaaccatggagaatttaacaaaaattaaatccatccatgctttagatttagaaaattttatttcccacattttacttcacttgaaaattaaagatcatttaatataaattctattaataatttattaaataatttataaatcctgaaacgaaaatcaggatgtgacagattgggtcggtactcttgtctatggctaggatgggttggaaactatgtcacgtcttccgtctgtatatcgtggtggtatgtggcacgtggttacacgtgaggaagatgtgtcttgtgggtaaagatgtacacctctgatcagagtacaacctattcgaatagccgcgccctcggttatgggcaagccgagcaatgtacccaagttagtgttttaaattcttaaaacctgctaaacaactaaaatgtggaatggttggcctgggttggcttgggacgagctaggacccagggtcgggttgccagttcggtctgaatcatcgtaggccttgggttaaggcaggttcgtgtgggttcacggccttgataaataatattgtatagtattagattcgtgtttgcaaaatagccctgagcaactaaatgtctttaaatgctgtttactgcaaccctaaccctttatagtataactcccttgtactcccttgcatttattctgcatttgtgggtgtgtcttgttgagtacggtggttgtactcagtcttgctcaattttccccaaccccagaagaggagttcctggaggatgaaggcttcggtgtctagctcatgcctgccgtcaagtgcctgtggtcgtcgccctagtcttccgctgtttctcgtttgtctctgtgtgtgctgggccttcgctgcccatgtaataaattaactatttacgcttccgcttgttaaactctgaattgtatcaacttttggtgtaccttacctcctgggacaaggattaatgcacgcacgtaaggaacgcccgttgggttatttccggtcgtgacaagttggtatcagagcccccttgaccctaggacgagccgtagatcccaagccttagcaatattttcaaaaataaaaatccttttgttatttgtgaaaactgtctagtctctctctgtcttgctgcttcatttatcgccaaaatctgacctttaaaatgttgcttttctttttgtttttgtttgtagaaggccggcagcgtcacccgtcgtggtttggacatgactggtttcgtcttggagctgcggggcatgtgcgtggtcctagggtatccacatggagtggactaccaggccaggccgcttccggagcaggagggtgatgacgcagagccccacgctggttgggaggttactgcagtgatcctctctggctctcccgagcggacttcgctggcagtcaccgcgggtggggattccttccccgccgcttgccagagcgccgctctcctcgccatcggcactcttcaccagcgctacccggacgagttgtacaattggcactaccgttaccacccttgctgtggatgagcccgctactactctcaccttccgggatgctagctcgaaggatgacgctaccatcatgcacctggcgcgcatggtggaggcgtacgacgcggctcgtatcgacttccatcagatggtgcgccgtgggatggtcgagaacaacatgaagatccaggagctgcgtcaggagaacctgcagctcaagaaggacctagacgcggtggaggcgcagctgcatcagctcaagatcgcccagggagaggtctgccgccccaagcgccgccgcgtctgccgcagccagaagatcaccgcccgcaagagcacctccaggcccgagcttgttcgtcagtccctggcgtggacttgcttcgtggagacccctcgtgccgagcctgcgcccgtggttccccaggagggggaagcctccggcgttggtagcacggaggatgcgctgttgctcaccttccgccctggcccgtcgcagcggtagacgagcagttagtaggcttgcgcgtgtgttctttctcgtttgtcttcttgttgggttgtgtggggcacggttatgccggtgtgtggtgtaactgtgtcggagcctgtctttattttatttgcttaagcaacttgaactttaatgaacccatttaatagcagtaataaattcaagaattatggtagtcgtgggtggttagctttaattgtcagctctctctgtttgctggttctgtgtggggttttcagatggtgacgaccaggagaaatgctgccaccagtgatggcaaccaacccgaaggcagcaaccacaacaaccatggcagcccacctccacctcctcctccgcctccaccaccaccaccaccaccagataccaacgccattctcacccaaatcctcgcccagcaggccaacatgatgactgctttcctccaccacctccaaaatccgccacaacataatgctccacccccacctccccaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcagggacccgcatctctatggtgggaccatttccaggctacgcagccagagggacagcctattacttgggctcgcttcaccgccgctttccggagaacccatgtgcccgccggagtcgtggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccgtggactatccggatttccaatgtctggtggacaagagcatccgcttggaagccaagcacaaggaactggagtcgcacaagcgccgcttggcgaatttccgtaatcaacagggtgctaaccaaagggtccgctacaccaatccctatccagggggatcctcctcgcagcagcaacaacagcagcagcaacctcgctccgcgccccgccctcaattcatggtgcgcgtcccacagccgcagcaacagcagagtcagcaagggactcgtgcgccccgtcctcctacgccaactgtgcagcctggtcaaggccgcagggacgttcaaggtccgcagcgtctgtgcttcaactgcttcgagcccgggcactttgcggacaaatgcccaaaaccgcggcgtcagcaaggccaagtgcctccccgctccaacaacggtggtaaggatgtcattcggggtcgtgtgaaccacgtgacggccgaggacgtgctgacaactccagatgtcatcgttggtacgttcctcattcattccatccctgctaccattttgttcgactctggagcttcccactcgtttatatctgtgccattcgtgggaagaaatcagttgggggtagaaaggcttaggaaccctctgctcatcaccacccctggaggggttatgacagcaaagtattatagtcctgccgtccctatagaaattcaggggattccttttccctcggatttgattctgctagacaccaagaacttggatgtgatccttgggatgaattggttggctcaattccaaggagtagtggattgcgcgagacgcactgtcactctgtaccgaggtccggaacaaccggttgttttctttgcacccccaacctctgtcaggagttcagaactgcatcagataggactgtcagaaatccccatcgtcagggagttcggagatgtgtttccggaagaactacctggtatgccgcccaagcgagagattgagttccgaatagatcttgctccaggaaccattcctctgtacaagcgaccctaccgtatggcagcaaatgaactggccgaagttaagaaacagttggaagagttgacagaaaaggggtatatacgtccgagcacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctctaagatcgatcttcgttccggatatcaccaattacgtattcgtgaagaagatattccgaagaccgcattcaccacgcgatacggactgtatgaattcacggtgatgtcattcggtttaaccaatgcacctgccttcttcatgaacttaatgaacaaagtgttcatggaatacttggataagtttgttgtggttttcattgatgacattctgatatactcacaatcggaggaagaccatcagcaccatctccgcctggtgttgggaaagttgcgggaacatcaattgtatgccaaacttagcaagtgtgagttctggttgtccgaagtcaaattcttagggcacgtgatatctgctaaaggtgttgctgtggaccccgaaacagtgaccgctgtcactgattggaagcaatccaaaacagtcactcaagttcgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaactctcaaagaaaagctggttgcctcgccagtgttaatcttgccggatactcgcaaggatttcatggtgtattgtgacgcttcgcgccaaggattggggtgcgtgctcatgcaggacggtcatgtggtggcctatgcctcacgccagctacggccccatgaaggcaactaccctacccatgacttggagttagccgcggtggttcatgctctaaaaatctggcggcactacctcattgggaatcgctgtgaaatatatactgatcataagagtttgaaatacatcttcactcagtcggacctgaatcttcggcagaggagatggttagaactcatcaaggattatgatgtgggaattcactatcatcctggtaaggccaacgtggtcgctgacgctctaagtcgaaagagccattgcaacactcttaacatctgtggcattccacccgaacttaatcaacagatggcagcccggaacctaagcatagttagtcgtggattcttggctgcgttggaagccaagcctaccttgctcgatcaaatccgcgaggctcagaagaatgatccggacatgcatggact

SEQ ID NO: 18015 - DNA, 1387 bp, Oryza sativa
agtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcatatcacccgcagacagatgggcagaccgagcgtctaaatcagatcctagaagatatgcttcgcgcatgtgtcctagatttcgggaagacctgggataagagtctcccctatgccgagttctcctacaataacagctatcaagccagcatacaaatggcaccttatgaagcgttgtatgggcgcaagtgccggacaccgctattgtgggaccaagttggggaaagccaagtgttcgggactgatatcctgagagaagctgaagcgaaggtcagaaccattcgggataatctaaaggtggcacagtcccggcagaaaagttatgcagataaccgtcgccgtgacctggaattcgcagtgggtgattttgtgtatcttcgggtcacgccattgcgaggtgtacacaggtttcagacaaaagggaagctcgcacctcggttcgtgggtcctttccgtatcattgctcggcacggagaagtcgcttaccagctggagctgcccgcctccttgggcaacgtgcatgatgtgttccatgtgtcgcaactcaagaaatgtctccgagtgccatccgagcaggccgactcagagcaaattgaagttcgcgaagacttgacctacgtggaaaggccagtaaaaatcctggacaccatggagcgcaggaccaggaaccgggtaatccgtttttgcaaggtccaatggagcaaccacgccgaagaagaagctacttgggagcgtgaagacgagctgaaggcagcccatcccgatctcttcgccagtccttccgaatctcggggtcgagattccgtttaaggggggtaggtttgtcgcttcccaaatcgactctaaaatacatcctcaaaattatgcatagaataattaaaatccatgtgaaagcctccagcaattaaaatgtgcaaatttaaaagtcaaataaggcttggaggatttttgtatatttcctaaaagcctaaaatgcgtaaataaattttagtggaattttcagagcacaaataataattaagaagaaataaacaaagttaaaatggttttataaaaagaaaaaccctaaaagtccttttcccccccccttcc

SEQ ID NO: 18016 - DNA, 30803 bp, Oryza sativa
cgagctgggacccagggtcgggttgccagttcggtctgaatcatcgtaggccttgggttaaggcaggttcgtgtgggttcacggccttgataaataatattgtatagtattagattcgtgtttgcaaaatagccctgagcaactaaatgtctttaaatgctgtttactgcaaccctaaccctttatagtataactcccttgtactcccttgcatttattctgcatttgtgggtgtgtcttgttgagtacggtggttgtactcagtcttgctcaattttccccaaccccagaagaggagttcctggaggatgaaggcttcggtgtctagctcgtgcctgccgtcaagtgcctgtggtcgtcgccctagtcttccgctgtttctcgtttgtctctgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaatgaacttgatgccgtattcattattcaagaagttggggcgtgaggatgatgagttgaagaagactaacatgattctcaatggcttcaatggcgaaccaacggaggcaaagggtatcttttcggcggagctcaccgtgggaaacaagacgctaccaaccgctttcttcatcgtcgatgtgcaaggtaactacaatgttattttgggtcgttgttggatccatgccaattgttgtgtgccttctaccttgcatcaatgtttaattcaatgggacggtgatgatgttgaaattgttcaagcggatacatcggccgaggttgcaatggccgatgctacttttgagtggcgtcatgggaatattcaatgcttatcggggagggatctttctagttatgattttattagtatctccgatggcaaatttgtacctatctctgtaaagccggctagtgtagcacggctaagccatataaatttgtataatgagtaacgaggctaatttagagtggttacaaaagagggtgcaagaatatcggtctacaaagaacgatattggtgaaaccgttgaagattttgatgaagtagagaagctagggaaatggtttacatcggccaatcctttggaagaagtagacataggtgatggaatgaaaccaaggccgacttttgtaaacaaaaatatgagagccgattataaggttaagataatcgagctacttaaagaatatgttgattgctttgcatgggaatatcatgagatgccgggtcttagccgtgagctcattgagcatcggcttccaattaaaccgggttctaggccttataagcaaccacctcgtcattttaatcctttgctatatgaccgagtcaaagagaagattgatcccggtggttatgcggagtgggtctctagcatagtcccggtggagaagaaggggagtggtaagattagagtttgcatagattttagagatttaaataaagccaccccaaaagatgagtatcctatgcctatagccgacatgatgattaatgatgcctcgggtcataaggtgattagctttctagatggtaatgccggctacaatcaaatctttatggcggaagaggatatgtacaaaacggcttttaggtgcccgggatttgttggtttgtttgagtgggttgtcatgacttttgggttgaagaacgccggtgcaacatatcaaagggcaatgaatttgatctttcatgatttgctaggtattatcttagagatctacattgatgatattgttgtcaaatcggatggtatggaaggacacatagctgatttgaggttagcttttgagaggatgcgccggtatggtttaaagatgaacccacttaaatgtgcttttgatgtgtcggcaggaaagttcttaggattcatggtgcatgagagaggagttgagattgatcctaataagatagaaaagattcgtgatttcaaagcgccgacatgcaagaaggaggtccaaaagttgctaagtaaggtgaattatttgagaaggtttatttctaacctagcgggtaaaatcgatgcttttgttcctatacttcgcttgaaaaaataagccgattttacttgggggggcaaaacaacaaggggcgtttgaagagttgaagagatatttgtctactccacccgttgtgtgagtgcctaaagccgaaaagcctcttcggttatatattgcctccgaagacaaagtcattggtgccgttttaacgcaagaggaagatggcaaggaatatatcattacatatttgagccgccgtcttttagatgccgaaacgatgtatgtttttatagagagactttgtctatgcttatattatgcttgtaccaaattgaggcattatttgttatctagtacatgcataattgcttgtcaagccgatgttattaaacacatgttgcaaaggccaattctaagtgggagaattggcaagtgggcatatgttttgatagattatgatttggcttatgaaccattgaaatctatgaaaggccaaattgtatgtgattttatggtggatcatcatgtagatatcgcttatgagggagaggttttcttagttgaagttataccttggaagatttattttgatggttcttcttgcaaagaaggtcaaggtataggggtagttttgtttttacctaatggcatgtgttatgaagcattggttcgtttggagtattattgtacaaataatcatgccgaatataatgctttattattcggctaacaagttatggagatggttggagctaagtacgtggaggcttttggtgattcggaattggtggtgcaacaagtcgctggagtttataaatgcttggacggatcactaaataggtacctcgattcatgtttggatattattgccaattttgataattttgctattagacatattgctaggcgtgataattctagagcaaatgacttggcacaacaagcatctggctataatgtgaagaagagaatatttctagtattggaagagtcggagcttgattttaaacctttgtgcgaaattggcaaaactggggaccaggggtggtctaaccggcattgcgtggccggtttgactggtgaccaggggcggtctgaccggctacatgccgccggtctgaccggcatccccgagcggtctgaccggccctgtgtggccggtctgaccggttctgggcagagcgctggggggcacgtttcaatcaatttagaggttgaattaattgtaaatttggacatttgtacccaggaagagaaagaagattggagaattcctttgatttgatatttgaaagatcctacacttaaggttgattggaaaatttggcggcaagcgttctatcgggacccaaaactaacaacttggatccgactaagattaatgtatcaatccctggatcagtaaaaaatgatacatacaatataactggttcttcgttgcatacgttaaagtcttacaatactatgggttttacaataataggtactcacctatctaattaatacacagcggaagtttctatacattctgactagtgaggtataacctttagggattttctaagttatcggggtcttcgtagtaatagtcataagggtcctcctcttgacctagatctgaaaaaggggttataagagcaaggatgagtattcacaatactcagtaagttatcacggaaatatgttgtgcattgacatataatagggttctttgcaaaaagcagtattggacaatctggaaaaatcatagcaagagtttataaaacatataaactttaggtttctaaccagggtaccatatgagtcccggtactcaactccatgagtacggctattcgaatagtttcaaagatattctactgcagcagatgtacgctttacctgcagtccacgacttgctgataatcatcgactttagtcatggcccagtattaagtcattaacaattatggcacctgttccatgaacttatatcctcatatgctctgaacgtaatgttaacagcagcaagaggagttgtggcgttcccgagatatttaaggggaactgaccgtatgacaccacgtcatctcgatcagggtttagaaatataccatatagtttatactcgagtatcacaaaccatttacctgtacatggtaatggttaaagttgcccttcgcggctatagttgcctcctgcgcgaggacttaaaaataagaaccactatacagaggtgccatattgccaattaacctaataactaggtctgtccccattatagaaactgcggtcgtacccgttcgttcgacataagtaccttgtaaaacttatatcgattgagacaatactagccacccggaaatcatccaaatcttacgtattgttccaacctaagtatagggtattttaaccagattgtaagcaaaataagcaatactaaattatctgggtttctatgattaatttatgcatagaaaatagaatattgaatagaaggctataaataaataatttgtaaaatataggcttaaatgatcaacaggtatatggttacttgccttgctcgatgtcctgagattgattgatattatctagagtgtcagaggaatcctcaagacctagggttagacaaataaaatccaaattcaaaaaggagttttaaataaaatctaaaaataagaaaaatagagaaaataaaataaaatgtaaaaatagcaaaaagggtccaaaagatagagaatgattttagaagaatattggtccaagtttcattgaaattggatctatattttaaaagatatgggcttctaaagtttgaaaatcaaataaatgtgaaatggcactgtgtgcgggtcccacctgttagtctctctctctctcttctcttcttctaccttcggccattccccaagtcaggctggcggcactagggtttaggattgcggcggcaatagagggagaaagtggttgcggccgaggaggggagggagctagggatctccggcgacggcgagcggcggcggaggagttaatttgatgcatggacggcttagcggctagggcggcggtggcacggttaggccgagatggcgatcaaggtgataagagttagacatggctaggggaggggttccagagcatctatgaggtatttagagggattccggggcagcttgccaacctttggcaaggtgcgaaacatagttgccgacgagcgcctccataggcggcggccgtgctcacgtcggcagctcagagggcggcatgtttgtgcaaaaggattgctaaaatggaatctaggtagtatgtagatggttgaaacggaagaactcaccgaggttggttgaaacgacggattgcggccggaaaaacttcgcggcggcgaagaacagagcagcgtgggggcggcaatgctcggcttggtgtggcgaggtaaaactcgacgtagagctttggttagggcttattatgctagaacatggtaggatataggtgttctaagggttatttagggcggaggatggatggagaggggttgagtcgatcgcgcacaaggtgttcgaccgacgagcgagggtggttgattagatggattggtgaagcagagctttggggttgtggggctatggttgttgatgatcgatgatggacagggaagggattggggtcctatttatagggctaggaggaccggatgagctcgggcaccgtcatcgccatggatgaactcgggttttggatgaggcaaaggtggcagaagctgagagagggcgggcaagatcgatttgagtggcgggaggccacgttcgaatacttaccggcgaaggattgacttgaccgcggttggaatcggctggcgacgtgttgacgccaatccgagcacgacgcgcggcggcggcgagggtgaaaacggccgacttggggtgaatggtttgaattgtgagaggggataccaccgtctatctccaatccaaccgtgcggcaagaattggcgcgattcaccccgggtagaagcgaaatcgcactcggcggcggcttggatgggagcgcacggcgtcgagcgacgatttcgtgcagcggcggtcatcccggctttgtcgtcgtcaagattggtgcagcagcggtgagctgagggcatcggacgggtgatggcgcgccaaggcggtcgggcatgcgcaggcggctccgaggccgacgcgcggcgacatggcgcgcggctaagtcggatgcccgggcggcgcgaaggggaggaagaggcaaagaaagccacggttttgagtgggttgtggtcccctaggaccaaatctaaactttgtgcaagattggaagaagttgggttgctctaattgggctaggcattctgtcgagcaccttgggtgcaatgaacagtgaatttccagaatttttgaatatttccctagaaaagatttgaattcaaactaggagtttggaagggtttcactagggtttagagtatagcaaaactccactaataataggataggctaaagaaataatctatggtttgaatttgagagattttgctcaaattcactagggtttaaaataaagggaataagttagagtaaattggaagggttctaataatacttgaaccaatttttaaataaacatcaaatagatttttgaaccaaacaaatttaatcaaaagccagcatgatgcagtcaaattttagtttaaaatttgaggatgttacacgttcaaatacactttgtttggtggagagttatatcgctgaaatatagattgtgtcttgttaaagtgcttagatgaagatcaatctaaagtggctatgggagaggtacatgaaggaatttgtggaactcatcaatcggcccacaagatgaattggttgcttaggagagtggggttctattggccgaggatgattgatgattgcttcaaatattataggggatgcgaagcttgtcaacggttcggcaatgttcaattggcgcccgccgccgtgttgaatcctataatgaaaccatggccgttccgatgtagggctttggatttcattggtcaaatttgtccttcgtcatcaaaggggcataggtccgtgctagttgctacggaatacttcaccaagtgggccgaagctgtgcctttgaagaacatgactcatacggaggtaattgactttattttgaagcatattattcatagattcggtatttcgcaaacattaactatggaccaaggtgcttcttttatgtctaaggaagtgaagagttttaccgaatcttatggtattaaattgttgagttcttctccttactacgctcaggctaatggacaagccgagtcgagtaataagacattgttgaagttagtgaaaaagaagattgaggaacacccaaagaggtggcatgaggtgctttccgaagcattatgggcgcataggatatctaaacatggtgccactaaagtgactccttttgagttggtttatggtcgagaagtcattttaccggtggaggtaaatcttggttctcttcattatatcaagcaagatgatttgtcaagtgaagattacaagacgtttatgggagataaccttgatgaagtcattgacaagcgcttgaaggcattgaaagagatagagaatgagaagaaaagggtggccaaggcgtacaatataagggtgaaagcaaagttgtttcaagttggagatttggtttgacagacaattttgcctttgggtactcgatccaaggagttcggtaagtggtctcttagttgggagggtccttatcgagtatgcggcattgttcgaggaaacgcatattttttggagacacttcaaggggagcgttttcagcgagcaatcaacgggaaatacttgaagaattacttcccgagcgtttggcaagacgcttaggagatactatggccagtaattggattatcgtcctaagaccaaaacatgttctatgcttttagattcacgttgttcatcgaaaaggcaggggggcatgtgtttacaccaaaatttggcaccaagaattaaaataggaaaaattgccagaatttggaaatctaccggtttcctccgagtgggctggtctgaccgccgtgtgttgggcggtcagaccgccagttgagggccggtctgaccggcaggtccgagcccgactgtgtttcgtcgggtctcgaggtttccttgctcgggaaggcatgtttcgggtttcctttagtttctaccccgagttggacgtggaggagggcctgtagagggcaagaccaacccctatataagggacatggctggttcattgaaaaaaaccaatctacaatcaatcaatcgaatcgtttttcatattgcttttagttttctcttagtttgtccatctttgtcggtttgtgccgtaaaccgttcgccgccgctgcaagagtgcgacatctctttgtaggtttgtcctgaaaacctaacgttttacccacgagacgggtaattatctagaaatcggctccgctagccggtttagttatggttggcgactctaggatcaccgcaaggcttaaggtgctgcgatcgtcattgtcaacttgtcacaaatagttgccaacacccacaagcattttgtatagaagaagaccttttcatgcaagtcgaaaaaatccccgaaccccaaccccacccatacagtgacaccgtaacttgtgtgagaatgaccaacgacatgtactgggccttagacctgtgctttggcatgggacaggggattttttttaaccccagcctaaaattcactcccactgagagtcaaacctaggacctgacgagtgttactagagccacctaaccaactcagctagagcctgttcgcaatggcataaaatagtttccctctatttttaaacagagagagtagtaatttatctacctaaccagaaaatagccataaaaagattatatccattaccaagccaacttgagttgttgcatcgttccattagtctactgagcagaattttaagttgaattgttgtgtcaagttccggtcttgattttagtttgagttgcacgtttgtcattgttttgatctagtgtttgtgttactatgacgagtctgttcttttacatgaattaggttctagttgtgtatcctgtccattgttgctgggccatgaagaatcgaacttattcgtatcgaagtttctgaatactggaaatctcttacctccttcatcccgaaataaaataacttctagaattgaaaatttgtcccaaatgtaacttattctcttctcaagcaatcgcatgcgtcgacctcttaatttctccatctactttctcttatcaaccaatcacaatattcctccaattaattttagttactttttaatacctgtgttcaacccaaaagcttcttatatttttggatcgaagtagtatttctttctgccataaaccattttctcattgttggattgatgtccatatggcctttcattgtacacctcatcaaacattcatttgacaagcatgatgtaattctgtacccaacaactgttgctgacacttattcactcagaatactaataatacgccacattaattcacctttcaaaaattataggaggaaagcttttattttcagacaagaaaccagagtaagtaattatgttattttctccaattcacaccaacgtataatattgtcactgcaaaccaagggtcaatcacctgcagcaattcaactttcaattctcaccttcccaccagactagctttggtgatcgttggtgatgaccgtgcgagagggttggtctccctctgcctactaaactcagggttactagatcctgcatagctactagtggtgtagctactgctcccaccatccctgagctgccactcggtgatatagctcggcttcgtgaccacctcagccacatcaacatctccgatgagcattgccacaacccttgacattggcggccgctggtgcggtgagccctgcgtacaaaggagagcaatacagatgactctgaaagcttccttctcatcaaattccttaagacatggatcgactacgcgcagagcttgccccatttcatacaaaccccaggcctatatacaaacataggttcagtgagcagaagacaataaacacgaacgaactaatgttttctgggatggaaagatcattgatcagcttacccactccaagagatatatcttgctttcctcaagggagttgtttgtattcgatcgaccagcaacagtctccaacataagtactccaaatgcaaaaacatcggccttctctgacaaatgacctctcattgcatactcaggagctaggtagccccttgacaaagataagataaattaatagtagcaatcatattgatattgcggttttaagaagagaaatggttaaatgttcttacattgtgcccgcaattcttgtgctcacatgagttttcttctcatcatatagtttggcaagtccaaagtcagagatctttggggtgaggtcagtgtcaagtaggacattgctggctttgatgtccctatgcacaatgcggacacttgactcctcatgaagatatgttaggcctcttgctatgcctaaaatgatatcaaatcgcattgcccaatctagttttaagatactatgtcctgtgcaagcagaaataactcagttgttggcaaaatacaaaaaaaaacaaattgtcttgtcttagtgaagcaaaattgtattagtgaaatcaaccaagcataatgtcatatgctggaaatttgcatcattgaactcaccaaatattgctcgatccaggcttccattttcaaggtactcataaactaacaagggtgttttactatcaatgcagcacccatgcaatttaacaagattccggtgttgcacagcagagattgttgctacctctgtcacaaattggcttttgccttgatgagatgtttcagaaagttgtttcactgctataactcttccatcaggtagtttaccctgccaaatgaagaaacctattacatgtatattttgaacatgcacataaagattaccaaaattctggtcttaatagaaaatgaaataaatactcgtctctttttgcacattattagtaacagataatagaaaaccttatacactggcccatatccgccttccccaatgatgttttgataactgaaattgtcggtagctagcttgagttcagtgttactgaagacatcgggttgtccagcaaggttgtacagttctgcttgtttttcatggtcagatgagaaagagtaaatcatctaaatagttttagactgaattactataaaaataattaataccttcttgctgttctgctattgttcttctcttctttaccaacaaaaatattccaaataaggatactactcctaacactaatgcaccaattgttattccagcaattgcacctgctttacttctcctttttggtacaccatttcgaactgttggagtaaaatctgtataaaaaaatgatcttattagattccatataatccttgttgaagataacataatggttgcgcttacttggtgtgacacttaatgctgagatcatcggcccatagtaaccttgagtaggtacacaacaagttcccttaccagcccaaaagagatgaatctcaaggaaatttttggacactcttgcagtataacttctgttgactgcagtaaaagattttccacccgccatcttccttatatcaaaattcttttcttttagatcaccctaggcaaattgcaactggttcagataaagaataaaaaaattcagtaaacaagccagtcaatttttacctggacatatatgtcaaaaactctccttcctaagcttagccacgtctgcgagtctggataagcaaactcggcaaattgaagcagaacagtgtaatttccattctcgagtccaaggccataatacctcaccgacgacgccgacatccttgcagtttcaaataatcttgaatcaaggacattctgaattttctgtggactatttattatgttcactccatctgtagccagaaagtagttcccgacattgcttacaccccatcttgtgtcactagtaacataatatgatgcagccccaaggtttgcagcatctggttcgtaaatagttccatctaagcctctagtcgttctattattgccgcagtcaaccgcaaaggaatagtctggaattaagatttgtaaaatcaatcattcaaatttccatgctcatggtaactactactgtagatgaagagaaagaaatatacattctgcagatccacggaaacaaggggtgtcttgctggaggcagtttagtcctgaaggtaaagtgctgtggacaattttaattaaaaaaataaaagttgtgagtaacattcttttgatggttaacctcttgcagaattataactaaatgtcataagtacctgtggcctatggtaccaagttcaaagttgtttgccaccaaatttctagtacaaaataaaagattagaatatctaattctactattcttcaatccaaacttcagaatttcatactcacaattggaagttgttctgggtagcccaagaaggcaagcctccggtgagttggttgtaggaaaaatcgctacaaacagtccacggtcagtacatatgaaattagtacattgtattatgaaaataatttgacctatggtgctattttggtctttttgacatacatcgctttcaaggatgggcttatagcatctggaagacttcctgtaaagctgttgttcccaagaaacctgatatggtacaagatgatggaacataatgatgagctcagcttttatttgtgtaaacttaattaaggcaatgaaaacattcttacagaaattcaagatttgtcatattcagaatggtttgaggaatttggcctgtgatattgttaaaactcaagtccctgtgattcatgacagattttttacatcaagagatgcttcacaatctgaagaaatgattaaaagcacaataaatcatgtagcaatgctaagagtgaaaactcacagcagggttaaaactccaaacttcgaaaaatctactggtgcaagattgccagatatcttgcagttccttaatattctgtgacaaaaagatcaaatttcagtaacttgaaactttgtgaatactataagctctatgtgtaaaagcatcacatacaggttgctcaaagatgtgaggttactgataaaggccaatgaagagctcccatttacaatatcaccaatccgtctgctcatttgtatattttacaaatcagttatctagcttgaccttgtcaggctctcagccatcatcgaatcaatgatacccaaaacaatgtacttacaagttggttaacttggttagattagctaaacttggtgggatcggtccttcaaaagaatttccttggaaagccctacaagctcacactttcagaaaagtacagacatgcgaagctcattctaatagagaaaagtaagctccatgtatgagcatttttaagtcaaagttgtttgtatcaacatggcatgcagattactctaattccatgcagactggaaggtgaaaaattctattgtttgagttcagatggaaaaacacatgcagaaactttatgttgacaattccatttgtctctgaataagatacactgagtggtatgtcaacaagtttatataattaatcttacatatcttccaacttaggcatgatccccaaataatcaggtattttccctgtaaaatcgttatctgatgacctcctgcatccgcatccaaatgttagacatttagcatgaaaacatgacgaacatatataatgtctaaggctatggtattgaccgtacaagatcttcaggttctgaagttttgagaatgttgaagggaacggaccactgaatccacaactatcgatgtacctgttattgaaagattgaagtgttatcctgtacaacaatatatctgcccataacaaaatttagttattcataaatagcaattggatattagaaatggtgcatcttacatctgctgaagattggtcatattgcccagttctttaggaagttgaccgctaaaattgttaaagctaatgcccctgaatcaaaacgaatatttcatgacaataaattagctatattcctctaatagctggaaaggggctcagtttaacctgatgagccatctgacctacataataaattttcaagccttcctcaggtcaattttccttgaacatgtgaagtacaacttgaaacttacaggctaagatatgccgacaggactaacatatagacttctgaatttacagtaaatttattgtcgagaaaaaatgtgattaatcgtttctagtataattattttagttcaggcagtcgcaaaattatatttgaagattgatctgccatgaaaaacaagtccttacagcgagaggagattggtgaggtttccaagttcctttggaagcggtccagacagtgcattgaaaggaaaagccctttaaatgatgaaaaatagttaacacaaaacaccaatctatagatgctacatgaatttgagaaattgacgtatagctcctacaaatatttcatgaaagtaaactttccaaagaatgatggcacggcaccagtcaagtaattatagcccaggttcctgcaacaacaccaagaaacatcatgtcagttagctaacacaaaaatcttgcattcccgactactatttgctggttttcaccaggatgtcgacagttgagtattcaaaacaaggagttgaatttatatttcctgcaaaattaacattgattatcaggattaagatgataaggcatagataccatacaggtccagcatataggtgaaattctgcagctccaaaggtatttcgccaacaacgctcaaatttgttaccctcctacaaaaacaagaaagtaatcaatgttgataagtaaatgaaataattctattttttcccttggattgttgagaactattcactttttaccctaactcccaaatcatttggtttgcccaaagaacgtacaaaatcaggccgattcacccaaaaaaaaatagaatacccggttttcatccggcataccaaatttgggacggactggtgtggtttcagagaaaaccaaaagaagtgaaatttggatgggcttgtccatagttggatgtatgcagccaaagttacaatcgggagtatttaaaccccacgcctcacaatctctatctctatctctatctctacaattataaaagtttaaggtgtttttgcctgaaaattttgtgcgttgtccgatttgtttccattgtcgtatcagctcagttcggcacaattcagccgaagttcactcgctcggactgacaatgaagattgaatcgagctgtaaagaaaaggattattttcatgctttattagtgcaaatttaatgagagaatccattatatgccattgattttgtcgcacatctatgatttgccactgactttatcacgttctacaatatgccatcgactttttcttaacttctacgatttaccatcgtcgtccggttagtctctattagtactgtacaaatttgtcaaaatgaccaaaatatccctgtggcaaaactttcaaaatttggataaaaattctgaaatatcatattttatgtttttggccaaaatttggatgtttacaatcttatgtttataatatgatattttgataattttatccaaattttggaagtttttgtcctaggggtattttggtcatttggaaaaaaaatgtacagtgctaacagaggctaaccagacggtgatggtaaattgtagaagttaagcaaaaatcgatggcatattatagaacatgacaaagtcagagacaaatcgtaaacatgtgacaaagtcagtggcatataatggatcctctcaaatttaattgggttgtagaaagctggctgaactaacatatatgggctgtaaacttgaggggaaggaataagtctattttacctatctcctgttttgcctatgatcaaatggcatctctcaacccagaaccgggtataatgcttccctcaacttaaaaaaccggtgcaaattagctccattagtggtttagacaatggtttatgctaagtcggcagaaaaaacttttcaaaataatagtgggacctatatgtcttcccctctctatctgacacatatgtacaaattaaattggctctacccgttgcaacgcacaggtaccttttctagtatagaaaaaacaagaaaaatgctagaggactgaaaagaaagctagaatactaagcttcaaatcttaaaaaatatgtccttgctttaaaccaccgctgacaccaccactcgcgacaccggcacaactgaaacttaggcgtggcttgtaggctcgagaataccaatgcccacctaggccgcacctgccaacggcaccactgcacggctcccaatgcccatgtgccaccttggccactgataggcattatgtggttgccatccatcattgccattcggccaaatctagcccatgggattcactatccctattatgagccgaccgttgcactacatccaacacatgggttcctttagcactcctgcgtgtggccacgacagcatcatcagctcatcacccttcatgccgctcaagccatgctcattgtccctcaactctggtgttgctcactttcagtcaaaaaaaaaaaactctggtgttgctcactgtccctcatctctggctcagaccgccaaaagaggcgaggaagacctcaccgcagccatcctagctatcgctcgccctccggtggcctgctcaggcagcagcgaggtggaggcggggggtagcaagtggctagggtttagatgagagaggacagtgatgcgaaaaaacgatactgcggccattactatggagagatgatcatttcactgttgtatatacatagaaagtactactccctcggtccaacaaaaaaaaaacaatttttgcgatttaaaattgagtgaagtacacaggtgatctctaaactagtgtaagtgcgccatctaggtccctgaacatccaaaatttatttttgggtctcgaacttctaatgggtgttatcaaggtctaaatgggctccaatccacttcatgcgtggatgtgacatgccaaggtggcacctacatgtcaacaggacccacatgtcattcacatagaagatattaaaattaaaaaaacatatttttcttctctctcccccctatcttcctctaatttcatgtaagatccagaaggagaaagggaggagaaaatatacttttctatgtgactaatatgtgggtcacactaacacgtatatgtcaccgtggcattccacgtcaacgcacggagcgacttggagcccgcttggacctatatgacacccacgacacgttcagggatccgagaatgcattttgatagtttatagacctagatgatacacccgcactaatttagggactgtcggcatacttcactccgactataatgtccactaatcaatgtcagatataacttttagagtaaagtgtattgcccgtccttaaacttgttcgtctatgtcatctaggtccctaaactgtcaaaattcatttttaggtcctcgaacttattaaaatgtgtcattatggtctcaaattaccacgaccctccgagatcctacatggcgcttatgtggcatgtcacatggacactaatgtgacataacacattaatattccggtcccaaaattttttcttcttctatttccttccctttgtgtttcccttctccttttttccacaccaaaaggaaggaagaacagaagaaaaagaaaaaggggagaaaaaagataaagaaaatgagtcaactcccatgtggcatttcacatgagcgtctattgataatgtgggaccgcaacggcacactttgacaagtttgaagtcctgaaaatatattttgagagatcggaaaatgacacggacgacaagtttaggtatcgacagtcgtgaagagaggattcttagtgcatttgaagcacaagtaatttgaaatagaggcaagcccccacgtcactcctagggcaggggcgacacgggaggcgcccccagccggtgcgccaccatccctgcctatctccctcctcgacctcaccgcccctcgagcaggctaccagaaactacgtggccgccaggatggcggcggcggggccatcccttccccccgaggtcgcggcatcgaagcccacgaccccgaccagatccagggcaatgtgacgacggcgaggcacgatgccgctggccagatctggcatcctcctgtctagatccggcggtggtggcggcgaggcgccaaggcacggctgcgtggaggcagcagtgtagatgtcggtggcagcgtggacgtggaggcggcaaggaggctactagatccagcccctcagcccggatccagcctcccaggcgcagggagccgatcctcgagctagtggcggcggggaggcggtggggcgcggcagtgtggaggtggtggacatcggaggtggtggggcagacatttggaggcggaaaggcgcgatgctgcaccatcgatggtgggctcacccgtgcaacaccgtcggtgggaggaaggcggagatggcggcggggataggagaaccctactgggagcgtccggtggtggcagttagtaggcatggtggcgctaggagatgcacccgatgaggtggggctgtgggagtctaacgtggcgagagcagaggcagtgaaaggccaccaagggctatggaggtcggtgcaaacggcgtcatggtgcgagcatggcatggctggtgtgcagtggcggtgtggctgccgtggtgagaggatggaagcaatgatgatgatacctagcggcccattgcgaaaacaatggtagcttggtggaggtggtgacaatggtagtgctatgagaagaacgttgaagcctgcggcaagcatctttccaggcgtttgtgcttttgctgcggtggcttgctgccataagatggccatgctggacaagctagtacgggaagagatgatccattcttcactctcattctctcctccaacccaaccacgtggatgcagttgaagtgcgccggagtttgagactctctttgatgaccggccagcagcgaggtgccggcgtagttgctatgtgtcgaaggggattggttggtggttctgctgaatctgatatgcactctttagtgcgggagagtaggaactatgggcgaaggcctagccttcgggccggcaacggcgacgcctacggaccccgcttttcccttggggcattgctatgtttcctcttctctcccaatgggttattttggtgaaaactaagtcctgattctttagaatgggcggtggcggcgctcttagcgtcgttttctccttggaggcgtcatttagaagacacattccttagggttgttgtgtgcttgtttcgattttagcattaggagatgtagatatgtggtgtggttgtctttttctttttcctaactattgtctcgcaggactatggacttgtgattttttttttctgctgtatcaatagaaacgtcgtgctatcttgtgcggggttgtttaaagaaaaaagaaatagaggaaacacagtagtacaatataaacaaattggatcaaaagcagtggttggaatggaccatattttatggtaggaagcagttgcaagcaacacatgtagagttaattagctgaactagatgacactagatcaaaaaacaagcagtcactaacagtctgacacttgaccacatatatttgaaccatcaaatatatagatcaaatatttaaacgaactctttacaaagggcacttcattgaactcatagtgcacagcacacctgaccaaagagagaagacgtggaagcgtatacttacagtctggtaatgtggcagagggtgttgttgctgaaagtgcagtcgcacttgatgaatggattgatgttggggtagttatcccagtcgcttttgtcagaggcgagaccgctgcagggctcgccgcttatgttccactccgacgacgccttcttgccccatcttcccagtatcgtgttcagggccgccgctggcatggttaaactcagcgttactgtttaattagtgttcatgtatatatgtccatgcagaactataaaatgaatcaagttccctctagttctttttctgaggcaagctagaggcctgcaatcgatggaggaaaaccaagatcaagacgacgatttgcacatggtatgagatgatctttcggacaaatcagatccatattgactcagcctttggtatatatgtagaaattgagccaaacaaacttacagagtctttattacaaaacaaaaaaaaaatgatacatcaaaaaatctggtaagatcgatgtagtagtacaacttaccctcgagtggatcagtttttggtggttgcggagcctgagcagctgcgatcctccatgtccatgagcacacaagcaccacccacacgagaccgctcatcctgctgcaccaacgccgcatctctctcatcgctcgctcgctcgctcatacgcactgtggaaacaacgacgttgggtagttgcttggcttgttaataaatatagagatagatcatagatgtcgcttcaaacaatagaaaaaaatgggagtaagtacatgcataaaatataataagatttcgtttgtcaaaataaacattagtagatctgtcagcaaaaatataattagaaaaaaaaggtacagcactagaatatatgcaccggacgaacgtgtcaacatcgcaggcaaaaaaaaaaagaaaaaaacacggtactatagcgtgagatatattatttaacggaggagtatgtagatgtttgcttatgactttttaatacattatatgaatcatattagcattttcaacccaaaacaaaaacattattaaaatacattttatgctatatttaatgaaactagtttggtgttgtacatgttaccatatggtcaaacttaaataagtttgacttgaaaaaattaaattgtcttaaaatataaaacaaagtgtaaaaatttgttttcttaattacaaatattgtgtcgttttaatcatcttttttatatacatatccttcgattttcttccctctcataatcatcttgtacttcattttttgttttatactccaatcatatatatacatatatatagtcttaatagtttcaagtggccctcattgtcaacctagagttgtcatcgtcgctagctgcaaccgcactgttgttttgacagccgtgcgaaggaaaaacctgccgtcgaccaaattgcggaaggaacaacgatcgatctctgctgcggtagttgagtcgtgctaccatacgtatgtcaatgctatagattggtaacatgatggtttacgaagaaaaaaaaatccaaattactcccctatctatagcgatagttcacaaatatcttaaacaacaaaactacacattttaaaccttaaactcttaaaactagatgaattatactactagaaaaagcatttttcccgacgtgggggggctcatttttgcaggcgccgcttaagtggtccacctacgaaaatagacttgaatataaatagacttgcggatgctaatttttttctaagtctcacacctctcctcccctccacacctctcctcctctcccctccccttacctctcttcaccggcctctcccctcccctcacctctactctacccggccgccggccggaggcggcggtggcggcgggcggtgatggcggagggctgcagcggcgaggcgaggcggcgcagccgaggagggcgacggaggagggcagcgcggcccggcccctccctcccagatctggccggaggggggcggggggagcgcggcggccggcggctcccagcccgtccctcccagatctggccggagggggctgcggggagcgcagggcggcggcaggcggtggcggcggagggcgacatcggcgaggaggcaaggtggcgcggcttccggccacggcggtgaggacggcggcggcggctccccccccctcactcccagatctggccagaggagggaggggggaggccggcgggggcggcgacagcgtggagcggcggtgacaacggcggcggctcccctcccccctcactcccagatctggccggaggtaggagggaggagggcggcggcggctcccctcccccctcccttacagatctggccggaggagggaggggggaggccggcggcagcgacaacagcgtggagcggtggcggcggcgatgacggagcgggccggtgatttttttttttgtttgttcattccattttcgcagacgggccacgttgccccgatgattttcgcagtcgctgtggtgcaggcggacctccctcccgcctcggaaaattagttttgtcctcatgtaaaaatgctttttctagtagtggtacccctaattctcaatcaagactataactaatttggttcgagatagagtgtaatttattcggtataaagagtttggggtttaaaatgtttggtttcgtgattcaggggtaattcgtacaatcgctatatagttcaaagtagtaatttagactttttccttttacaaattgcagaaagtatagaacattctagctatctgcaatgatttttctttcaccggtttgggtgtgtgaaaccatttgcaagcctagttggtccatttggcttgctaaaatgattgacccaaaaacaaatttcagggagtataagctgaccatgacatgttcaaaacaaacattttatccaagtgtccgaatggcccacgtgaagggagtttattgtttttatccatagtcatgcatgacagcatcctctgcctgaattttctaccgacctctcattttccttagttgttttcccgatagggcggataacagactctccgaggaaagctgcatacgtggcaagactatccacaatgtgttccatctctacttacgtcttattctattatttgcactccatattcaacttggcagtccagttcaactgatttttaattaattttctgttttaggctccgttctataggagggtaaaagagaagaacgataagatttttaaaataataaggtgagactttagcatatgattaattgagtattattttttaaaaaaaataaaaatgaattattatgattttacaaagaaattttcctatataatattttaaaaaatacattgtttaactgtttggatagcgtgtgcgtggaaaacgagagatttcttcattctcgtccgaatgaacgcagccttattagtccctgtatatcttgctttcaatttagcatttggtttcctaaattctatttacctagtaatgtacattgatatctggcatatgataataataacaaaggaaataaaagttaaaatcaaaaaatgaaaagaataaaaaagaaaatatccacaataaacaagaaaaatttaagggggaaaaggttgatttgaacactacaaaaaattatttgcgcagactctaggctttcgtttttatagatggcctcaaaagaaaaccggctgagaggatggttcatgccacttcaatgtcataaactgtctgttaaaaatccattttttacatttgggtcttaagaaaactacctatgtaaaataggttcattttcaaggatatcttttttaagaaaactgcatcttcaaatcatgattttaagagccatgaagaaaattataacctcagatagagatatgttgtatatcaaagttgtagacctcaacatgatctatatgttacttgatatgttttgaatagattcatgtaaaataagttcgtatatgtgtctaaatttatatgaatgttagtgaatatagatgagggaaatgctagtgaatatagataagggataaagacactaaacgtcttacaattgaaaacaagctagagagtacaaattctagagaggtaaagtgggcattcataccatgctcacaaactagagtgagattgtaaaaccgttacgcgtggagtgtggagtaagaggtgctaggtttgaatcctatatatataccacacacgagtgtaaaatcgtgtgatttttgactttacactacctgctaccctatatagataactactaaaatttttatttttggggggagagggggagggtggtggttgtgcctaaaaaataaaaaagaagaaatctatttttgagaaaaataaaataattttcaggtgcggttgtgaaatccatgtgcataaatccatgatttctgtaggttgtcagttgcatgaagatcgtaaaacgcttttgttctggacattcattttcatgaatccttgatttgaggctctatttccctgcgcaaatccttgatttctgcaggcaattagttttaaaaaaaacacatatgtatacacaggcggagcgggacggaccttaattaagcggttcgtaggaggacgcccatcgcacccccacccaggactttaggctgtcacttgtgctatcatgtgtagctaaaaatttgacccgtttgcacagtgatatgggattcatatgcgaaatttattttttatagtggtaaatgggttatcaagcacctacaaaagtgtatttttttacaagtggaatttactgaataattatgttggggcacatgaggcttcgatcgatgcatggtacatggcattggtcatttgtttgctggacctatacataattgagtctataatgggcaaaccaatttgattagtccattatatcaaggcatatacgtcgaggaaaattaaataatagtccagatattattatttaatttgctggaccaatatattatttaattttcgcattacctgatttgagattcctcgacgtactgttccttgatatatgtttatctctacagaaagactagcagctaattcaaatctacacttgatttttgacaatgacaaggtgaactcatttgtacataaatattgcttgaatttagaaactagaaagctacataatactagaaacgtagggacgcggatgctatcataccccagttttttatcagcaagagggaggacagggacatcgtagacgactcagcgcaaggaatagcctgaaatgagatgatgaccatcgagagggacatcttagactctccacaagaggttacagaactagcaacttggtgaagttggatgagaagaatgaagaattggcactccaattaattttcaaataattaaataagaagaggtgtacagtatatactagcaacttggtgaagttgcatgcatcagaagaattgaagaactgacattccaatttttaaatattattaaataagaggaacatataggttttgtgctatgtaggttttgtttggttttcatacattcgttgcttttggatctcgcaggattgcagcacaaatcattgtgttgcccagactaggaatgaaatctgttcggatagtttcgattttcagacgcattttcgtaaacgaatagtcttggatagataatttttagatggtaaacgaatatggatagttttattttcagaaatggaaacgaaaacggtgggactagtatatgatggatatcggaaacggtcagatggaggatcaacttttcaaaaaaacaaaacacgtatgtgtacgtaactttatcatataaagtcggatgaagataaactttatatcagaattgtagagattgatgagatctacaactttattgctgacacctttatcatttgagatcatttaggagacaaaatattcattgtaaaatcataaatctatgattcaaacaatctctgatggggacatgctctataccaaagttgtatagctcgatgggatttactactttctagtctatgaccattttatctaaaaatattaggagtgcataaaacattacatgcttcggagaggtaaaataaaatgaatagcatcatcaatctacacagcgagaccttgatatatgagattattaattagtaagctacacgtggagtggaggaagatatcttggatcccattaaggcaccaggaagtgaaaactcattttcacatgcagatttttcaagggatggactatggaaatcaattcacaaaaagtcatgtaaccgcctagggaaattgatgatataaaatttagaaatattgaccttttattttagaaaaataacaagtcatatctttttgttgattcaggtatctcagtttgagtttttatattccgataaatatttgttaccatattcattccattttgtatttgctccgtctttgtacgcgacagtattcgattgcatgacggttagacaggcagactccaggaaagaatcggttacggattgttttcgtgaaatttattctaagtgaaggtgttgtcttatccctatgtagtctaaattaaaacatttggttaaaacagatgacctaacgtgcaatttactcagggttttatattctggtaagttaccgtatttgtttcatatccgtattcgatgaaattcgataccatttccgtatccagagttttcaatttcaaaaaattataaaaacaactagtaaaatgttcatgcgttgcactgggtgaagccaaaataagtagtagtgagtgtgagagcatgaagccaccagattaattgaagttattataaagccaccggtgcaacaaaaacgctaacatgacataattattaattgctctaaatccactagcgcggatgattataagaaaactattattcccactttaaaatgaaattatgtattacagactaaacttcgaaaccttagaaagaaattatgagtcggttgcaatgcatgattttttttacttgatattgataaacactagtttgtcatactgtaaagagtactcacagtagaagaaatgattttggctagctatctgatcacactcactacactccaatcgcagaatggctttaactaaaaaacagtcggaaggaaatcatgcaatgaatgaaaaaaaaaaagaatactttcactctaagaaaaatcataaggaaatcgtaccatgaatgagaaaaaagtgatgtgatgaggaaaaaattcttgatgtaaacacaattcattttgttggtgattacgtgttttttttaaaaaaaagtatgcgattcttttttatttttttctaaaataattcattttgttactgattacatgttttttttaaaaaaggtatgtgattttttttcaacaagaataattcatttttttgtgattacttgttttatgaaaaaaaagaaagacatgtgattgttttttatttttttacataataaaattgcatattcttttctatccctgcttcgcgtttcgcgtaagcacaaaccttatttcgtgttatcagtcttaggcattcctacttcctccgtaaaaaaaaaactaggttaactcaatctaggaggagacgtgactcctcctacgacaacgaatctggacaaaagagtagttcagatttatagtcctaggactataaatatacgattcttttttatttttttacataataaaattgcatcttcttttctatccctgcttcgcgtttcgggtaaacacaaaccttatttcgtgttatcagtcttaggcattcctacttcctccgtccaaaaaaactaggttaactcaatctaagagaagacgtgactcctcctacgataacgaatttggacaaaagagtagttcagatttatagtcctaggaagggtcacatacatcccttattaggttgagtttttttggatagagggagtaccgatacagtgttacgcggtactgtgctgggccgttgcttctcaactctatgggctggctgttgggccagcctgctgctgctttgtttgggccgcttgctagctttctttgaaattttttgagaattaatattatttttatggaaaatcgcaaaagtagtggccaaccggggaaaatcgcgaaactaggtccctatcgaacgggtgcaattcgatagggcacctatcgaacgacgggcagtcgacaaagccctgtcgaacggctggcgttcgacacgctcacctgtcgaacggagggagttcgacagggcccaccacccggcgccgcgaggcctgtcgaaccgggggcgttcgacagggccctccaccgaccctgtcgaacaatgggcgttcgacaggccggtttaaagccccgtccacccaggccgcgagttcgatttgttttgaggaccacatcgccagctgccgccgagagtcgccagatcatcgccgtgagcgccggatggagcgaggggaggggatagcaggccggagaggaggccgaggaggcgccggccgggaggaaagggtggcgacgccctccagcagtgaagttaaggtatacattagtaatccctaagtacaatgcatatgaaagtttaataaaaaattggtttaagacttgttaattgtttcgcattgttcgatgttagtatgtatggttagcacatatttgttattgctaaatgttggtagaggtatttaagtaattgtacggttaaattagttcttagttagtacatattattgatatgttgtgtgtaaaaataggtacaaaggtgttatattttatttggattatcaaaactagttgtttgttactaatagttgtaaattagtacacggcaatatagtataagttgtaatagggtaattatcgaatgattaaatgattaaacgtcagactatttgtcatgttttattaggatgtcaggtgatatgcccattcgtctgtattatggcgatgctcctatacaaatatgtgatagcggggtagatttgactgtatatgccttccatgatactagtctgaatgcaccggagcatatgggtttgaacgacgtgttagggtggttgtataatatgtttggggtagatccagtgcacgataaatttgtcataaataccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgtcgatcgatcgggggagtcaagtcatgtcgtggtggaagaaactccgttggaaggtggacaagctgaaaatgtttggcggactgagcaagatcgaggggaagaagtagtagagggtaatacacaaggaaaggtcattgttcgtggtactaatcgtgaggccaacgactcggacgatgaagaaccggattcgcctatgcgtgttgatgcagcggaggagaatgaggcggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccattggtgttatgatagtaagcaggtgaaagttggacagatgtttcatgacaaaggtcacttacatgatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagagtacgtatatgagatatcgtacgacaaggcttggagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgttcttcgtcgggttttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgcggcacattaaaatgtgtgttgttgaaaacagaccaaatgtgtttgctatcagcgatacagaagcttcaagaagatgtcacacagtccgtgccatggccagatttacatagcagatggtgcatgcgacattttggggctaatttttatagacaattcaggagtaaaagattgatggacctgttcaagaagttatgcaagcagaatcaacaaagaaagtttgatgccatatgggatcaactggatcgtttgaccactacacacatggaagaggttaggaaaaaacctatagttgccagacaggaggagccggagggacttgaacccattcctaatgaagcaccaagtattactcggcgcaggaagcgtggaagggccacgaagtgcttcacgg
